United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 11

SEQ ID NO: 52054 - DNA, 378 bp, Glycine max
  Peptide Sequence Number=SeqID_143739
atgtgtatgccgaaaagggttacatctacaagcatagacactacagtgcctccagttgatccattgggagaattggttaagaaccttttagatgtttaccaaaagtcatttcagttgccatgggatggggcaaaatttgggattcctaatgtcaaaaagggttttttcatcacacatgaagatgtaaccgagataattttaggtgacaaatgtttgaacatattcatactacaactgtggaccatggcacattggcaacttattgttttgtgtccacaggacaatattgttgtttggttatgttctctacgtaagaagcctgatgttaacatcaagggtgcaattaacaggttacttagtaaatttaaagtcaaatag

SEQ ID NO: 52055 - DNA, 351 bp, Glycine max
  Peptide Sequence Number=SeqID_143740
atggaatggttagtggacctagcagtgattgacgctttcctcgcctttcatcatggcaaggaaagcccggtcgtcgccattttgaccatgtatgacacgttcgaccggggatgtgaaaagagcaagaattgtttgttgtgcactggctctctatgtgtggctggtttcacacctttttctccaagaaggggttgtattaattataatcccgtcctcgccataagacagcatggctaccccatgagaggagtgccatcagacgaaagcatcacgcctttcatcgcacggggtttcagtgaccacaacgcaagggtactccaaggagttcgcaaggcatgggatgcggcatga

SEQ ID NO: 52056 - DNA, 129 bp, Glycine max
  Peptide Sequence Number=SeqID_143741
atgaagggaactcttaaggtggttggcctctttcttcttgactcaaattcttcaagggatggcaccaatcctccttccaattccctatatggcaacccacaaacaaggaaacaaagagacaagcaataa

SEQ ID NO: 52057 - DNA, 87 bp, Glycine max
  Peptide Sequence Number=SeqID_143742
atgggggagaagcttgccacccagcaaggttgcttcctccagaagcaacagccttctggaggaatcttctgggcccaagtgggcctg

SEQ ID NO: 52058 - DNA, 429 bp, Glycine max
  Peptide Sequence Number=SeqID_143743
atgtgcatgatctacactcgtctctttgcaacgggatgggtgaaatcttgccccggtatgcatagtggttgcgcaatagcctcctcctctggttgtgctcacataattggccctcctcgaggatcaggggggtggaggaccttgagttctctagaggcgcagatatggagcccactgaaagtgaggacgcgtagccctcaaaaggtgagggcgtgcaaccctctgaaggccagggcgtgcagccctctaaaagggaagatgtgtagtcctctaaaggggaggatgtatagtcctctgaaggtgagggcatgtagccctctgaaggtgaggacgtgcagtcctctgaagtcctctgaaggcgaggacgtgcagcctctaaaggtgaggacgtgcagtcctctgaaggcgggggcgtacagtcctctaatg

SEQ ID NO: 52059 - DNA, 498 bp, Glycine max
  Peptide Sequence Number=SeqID_143744
aggatcccctcgttccgtggaagtatacccctcccgctttcggagaaagagttgcaacctgaagttgactccttgtcagccaaggtgaccaacatcaccggccttagtggcgtaacccacagtggtcggctgttcgcttccccccactcggcggaactgccctccaaggggaaagcgcccatgatccaagagcccacagacgtagccaccccctcaaaagaagtggaccctccggtggtaaaaggagctgaaaagaaagaaggtcttcaaggaaagacggtgactttggaagaagctcatgagttccttcgtctcatccaacaaagcaagtttaaagtagttgagcaactaaataaaactctggcaaggaactcgaggcgcttccgtaacgtttccgtaggtgattccgtgaagattttcaaccgttcttcgtcattcatcgttcgttcttcaatgttcttcggtcttcaatcggtgcttcagtcattcctcgcctaa

SEQ ID NO: 52060 - DNA, 300 bp, Glycine max
  Peptide Sequence Number=SeqID_143745
atgacaagcagagaccaagtttggtcattctgcacccttgtatcatccagaggcggcgggcccgatgatacgcggagataccttacggttatccgcacccttttgtcatccagaggcggcgggcccgatgatacgcggaaatacccgagtgaggctgacatagtcttctgcaccttttgttcctccgggaacaacaagtcatttacatgtggaaatttcatggtcacccgcgactctcgtcaaccgagaggagcgaaattagtgtcatacactaattttcgtccggggacctttgcttga

SEQ ID NO: 52061 - DNA, 593 bp, Glycine max
  Peptide Sequence Number=SeqID_143746
atgaccggccctctcaatgagttaatctcatgctttctcataagggtggacccttgggtactagaacctattacctttagaggactacacgtcctcgccttcagagggctaaacgccctcaccatcagaggactacacgtcctcaccaacagagggctacacaccctcaccttcagaggactacacgtcctcgccatcagaagactacatgtcctcaccttcagagggctacacgtccttgtcttcagaggactacatgtcctcgcctttagagggttacacgccctcaccttcagaggactacacgtcctcaccttagaggactacacgtcctcacctttagaggactgcacgtcctcctcttcaaagggctgcttgccctcgccttcagaggactacgcgtcctcgccattagaggactacacatcctcacctttagagggctacacgtcctcaccttcagagggctacacgtcctcaccttcagaggactacatgtcctcaccttcagaggactacacatcctcaccttcagaggactacacgtcctcaccttcaaaggactacacgtcctcaccttcagaggactgcat

SEQ ID NO: 52062 - DNA, 378 bp, Glycine max
  Peptide Sequence Number=SeqID_143747
atgagtcatggattttgcggtactcatttgcagatcatggttaggaccagaggattaggtcgtgccttaggtcaggtcactcgcagaggtgtgggcagaggagatcatgatgattccgatgatgctccacaacgtcgacgacctactgcatccgcatggaggcagcgagtcactgtgactgcggatcacgtcgatgacccagtcatccctgacccaaatgttcaggatgatccgatggaggcaccaactgttgtggagggcattcttgcagacgcaggcacagaggcggctgaggatcagcctcagggatttccgggtggtccgagcggcccatctgtgctaacaacatatgcggatcacgttgctcgtagcgtatga

SEQ ID NO: 52063 - DNA, 348 bp, Glycine max
  Peptide Sequence Number=SeqID_143748
atggcggcgcagctaatccatgatcaagtggagatggagtgcctagagggagcttgggagaccctcgaaggcaacacgaggtgtcgattttggggcacgattcgatttacggctacgtcattgccagtccaagtgattgaggtaacgtcatccgaggaagaccctgaggaggatctcgaggagctacctcctgagcctgctgtggatgctcttgactttctagagggtgatgaggacccactccctgaggtggattctcccgaggacgtcatgtcggcatccgaggcagactctacggaggatagtggccttggagagatggcgatcagtggaggctcttcatcatag

SEQ ID NO: 52064 - DNA, 219 bp, Glycine max
  Peptide Sequence Number=SeqID_143749
atgtctcagaaatctaaaggaagcaggcttgcgcgatccgtgaaattccgtgaggtggcggaagtcgaaaagaggtgtttttgcgcaatcccaatctggcccacttgggccctccagaagattcctccagaaggctgttgcttctggaggaagcaaccctgctcgcctgggaaagctgagctcgcctgggcggcaagcttctcccctattttgctataa

SEQ ID NO: 52065 - DNA, 324 bp, Glycine max
  Peptide Sequence Number=SeqID_143750
atggaggctgaggaaccttggctggggttatggctaccattgaattatcaagtagatatgggagcaagtcagcataggacaccggaattggggtggtgtttagcatgggttgtgtggaaggtgggttttttggttgatttagggatggcctttgggtataactgggtggtaggtaaggagaagggttgttattggctaagtaatgacattgttgggttggtggggaaacttggccgtataggaatggcagtcacaacatgggtttctccctcattctcaccctcttcatttgccccagttttctcattcatacaagcaggatga

SEQ ID NO: 52066 - DNA, 492 bp, Glycine max
  Peptide Sequence Number=SeqID_143751
atggcaattgggaaaatcataacacaatttaccaagattgttacaagccatgtagaaatatcttcccagtatggtcatagagaaggaaacattgtcaatgcctcccccaacaaggtaggcataagtcaatcaaaaatgcctactcaagacaagatagcctctggctgcactggaattttgcgccctggccattctgcacgctgtcctaaaagcgcggctttgatgctgatgctctgccagattctcctttgcgctaagcgcgctgaagctgcgcttagtggtggatatgtgagggtacatctacttgggggtttctatactgagaacaagagagggtacatctcttgtggatcagttcaagtggagggtacatccacttggttattcaaagagaacaagggagggtacatcccttgtggatctttggcttgtaaaggattttacaaggttgaaagaaatctcaagaactggttggttgcttggggactggac

SEQ ID NO: 52067 - DNA, 1377 bp, Glycine max
  Peptide Sequence Number=SeqID_143752
atggagaatgattctatagaggacatggacattgaagcccttccttcaatgtggcctcaagatattggaaccgaggttgggaagcagtttaatatagaaaaggctggaagggaccaagacatgttagaggaggttacaatcatagaggagccaactatagttgatttcaagcgtctcatcgagcttacagattttacagaaaagggctcttctcagttggcatatctaatgaagcaatgggagtacaaacaggccaatgtcgtgcgtcttctcagagaagaacttgacaacctaagcaagcaaaggcaggatgctgagctcaggaagttggagatattggaagagcatcgattcgaggaagaacaatatgggggagataagcgtccagtttctatattggatgaagtttatgatggtatatggcaagatataccttgcaggaaaagtgatgttgtggttcaaaacaagaggagtgagattgatgttgagtatgacactgtcatgtactggaaacagcgagcgttgcattcagagaagcagctggaggcaagtatccaaagagaagagatacttgaagaaaagttgcatgaaagaatagcaaacattgaaaggcagtcctctcctgtggaagaactctcccagatcctgaagagagcagataatttcttgcattttatactccaaaatgcacctgttgttattggccatcaggacaaagagttgcgctattgctttatctataatcattttccaagtttacacgaggaggatatcataggaaaaaccgatgttgaaatattcacgggagctggtgttaaggaagctcaagaatttaagagagaagttttggaaaaaggattacctgcaaaaagggaaatcacttttgagacagaactatttgggtcaaagacatttttgatatatgtagagcctgtgtttagcaaagcaggggagacaattggaataaattacatgggaatggatataacagatcaggtgagaaaaagagaaaggatggcaaagattcgggaagagattgctgttcagaaagccaaggaaacagaactgaataaaaccattcacattacagaggagactatgcgagcaaaacaaatgttggcaacaatgtctcatgagataagatctccattgtctggggttgttagcatggctgaaattctttctaacacaaaactcgattgggagcaaagacaactcctggatgtcatgctatcttctggagatttggttcttcaaattataaatgacatacttgatctttccaaggtcgagtcaggttgcaaatctatccttgtgaattatataaagactaattttaattatttggagagcaacttggaagttgcttatgattaa

SEQ ID NO: 52068 - DNA, 179 bp, Glycine max
  Peptide Sequence Number=SeqID_143753
ggaaacatcccttagcaccgctatacctcttgagcttgaggttattcctcaagtaaaggagttgttggatgaggggcttcccatggaccctaagagaataaaggtcattcttgagtggcctactccaccaacaccactcattgagttggtgaggaactatgttctctcatgggaagatg

SEQ ID NO: 52069 - DNA, 249 bp, Glycine max
  Peptide Sequence Number=SeqID_143754
atggctacaccacccagttcccctcctcctcctcctactcattcaacatcacattcaccttctaccatgaagaggacaagaaaagtgacttgcctaagatcattggctactagaccagttggggcagagaaacccctagtccatgtggatcctgcaacggggaaagccgacagtccccacataaagaagttaagaacatatttggggatcgtcgctcgtgataaggtagatgtcacatacaagaactag

SEQ ID NO: 52070 - DNA, 168 bp, Glycine max
  Peptide Sequence Number=SeqID_143755
atgccaaaagatagggggaggattgtcatcatcaaaaaagggggagattgtagacaaaggatcaagctgaatgttttgatgatgccaaaggatcacatgcttctcaaagctttattcaagacaaagaaattaaagatattcaagatggatgatcaagacagtctctag

SEQ ID NO: 52071 - DNA, 291 bp, Glycine max
  Peptide Sequence Number=SeqID_143756
atgcataaggcattacgggccaatgcacctcttccttatccacatttgattactctgtttttgcgtcattttcaaattccgcttgatgatgaaccctttgttcaagtcaagcgttcctttgcaattggtgctggtgccgtgacctcctttgggtatcgtaaagatcggaatggacaatggctgaagaaggatgcactccctcctcaagatgaacgtactccttcacgtcccaagggacggcagcctaaggggctgaacccttttcttcttcacttcctcccctatttatag

SEQ ID NO: 52072 - DNA, 354 bp, Glycine max
  Peptide Sequence Number=SeqID_143757
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagttgaaggtggaattatgttgattatagggaaaaagaagtttgtgaagaatcagacaggaaaaacagtaaagtgtcttaggtctgacaatggcttggaaaaaagcaagttgaagtcattactcagtagtgaatttaagatgatggacatgagagttattgaaaagattttaggcatggagatcaagagggatgaa

SEQ ID NO: 52073 - DNA, 633 bp, Glycine max
  Peptide Sequence Number=SeqID_143758
atgtcttcaatcatttatgctttcaaagactacaatgtcttcagtcatttacatttacaagactacaatatcttcagtcatttacgctttcaaagactacaatgtcttcagtcatttacgctttcaaagactacagtgtcttcagtcatttacatttacaagactacaatatcttcagtcatttacgctttcaaaggctataatgtctttagtcatttacgctttcaaagactacaatgtcttcagtcatttacgctttcaaagactacagtgtcttcagtcatttacatttacaagactacaatatcttcattcatttacgctttcaaaggctatagtgtcttcagtcatttacgctttcaaagactacaatgtcttcagtcatttacgctttcaaagactacaatgttttcagtcatttacatttacaagactacaatatcttcagtcatttacgctttcaaaggctacaatgtcttcagtcatttacgctttcaaagactacaatgtcttcagtcatttacgctttcaaagactacaatatcttcagtcatttacgctttcaaagactacaatgttctcagtcatctacgctttccaagactacaatgtcttcagtcttttacattttaa

SEQ ID NO: 52074 - DNA, 372 bp, Glycine max
  Peptide Sequence Number=SeqID_143759
atggccccgaggaagcttgcctcaaatagatctaggaaggacgccgcggccgcagggactagtgtcgcttccgaagagacacatccagctcagggacgacgagtacacgaatttccaggaggagatagctcgccggcgttggacatcgctggtcactcccatggccaagttcgatccagatgtagtcctcgagttttatgccaatgcttggcctacagaggagggcgtacgggacctccggtcatgggtgaggggccagtggattcctttcgatgcagacgcccgcagtcagttcttgggatatccgctagtattggaggagggccaagaatgcgaatatggtcagaggaggaaccgggccgatggacttga

SEQ ID NO: 52075 - DNA, 584 bp, Glycine max
  Peptide Sequence Number=SeqID_143760
ttatccagaactacgtaggtctgagttcctcattggaggatacgtaggagcaaaagcctcgcttttgtcgaccgcgccgttttctgttaccatgacccaagagctggtagcccgcgaagacaccttacggttatccgcacctcgtcatttagtgaccccaagtgtgattgatgagcagaggccaatgtggtcatctgcgccttttccggagatgtcagcattttccgatggagacttttcaagtctcacaagttatccagaactacgtaggtctgagttcctcattggaggatacggtcatgtgacatgcacccttgtatcatccagaggcggcgggcccgatgatacgcggagataccttacggttatccgcacccttttgtcatccagaggcggcgggcccgatgacaagcagagacaaaatttggcggcgggcccgatgacaagcagagaccatgtgtggtcattctgcacccttgtatcatccagaggcggcgggcccgattatacgcggaggtaccttacggttatccgcacccttgtgtcatccagaggcagcgggcccgatgacgagcagagaccat

SEQ ID NO: 52076 - DNA, 834 bp, Glycine max
  Peptide Sequence Number=SeqID_143761
atggcatccaggccacctgagacttgcgccaggaactgttcgcccgcttcggttaaggtcaggctgcgtgtgctgcgatgcagcaatctgacgcccaaatctgcttccagtttagcgacatttttactcacacctcccggtgtcaggcttaatcggcgtgctgcggccgagaaacttcctagctcggcactgcgtaaagtggctatcgtgactggcgccagttcaggcataggccgtaccactgcgaaattatttgctcagcatggcgccaaagtcgtggtcgctgcccgccgcgaatccgagctgacaacactggtggcagaaatcgtggcggatggtggtgaagccattgcctttgctggtgacgtgcaatcagaggcctttaatcaatcgctggttgaactggctgtgaacagcttcggcaagctggatattgcgtttaataatgcaggcacgctgggtgaaatcggtgcctctgacaaggtgtccctgcaaggctggaacgatactctgtccattaacctgaccagcgcatttttaggggcaaaataccagattccagaaatggctaaacaaggcggtggctcagtcatttttacatcaacttttgtcgggtatagcgctgctttcccagagtttgcagcctatgctgcaagcaaggcaggcctgattggcttgacccaagcactcgcggttgaatatggcactaaaggggtacgcgtgaatgcggtattgcccggtgccgtggataccgatatgttccgtgaaaaaaataataccgcagaagcccatggcatttctggccgggatgcatgccctcaaacgggtgggtaa

SEQ ID NO: 52077 - DNA, 285 bp, Glycine max
  Peptide Sequence Number=SeqID_143762
atggttggagcattctcacaaaacaaagtgaccttgactggtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 52078 - DNA, 791 bp, Glycine max
  Peptide Sequence Number=SeqID_143763
gacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaatattcaaatgagaactttgaaggccgaagaggggaaagggacgggggaagcccgtctgatagcgctctgtgcgcgtactccgaaagggaatcgggttaaattcctgaacgggaccctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaag

SEQ ID NO: 52079 - DNA, 219 bp, Glycine max
  Peptide Sequence Number=SeqID_143764
atgaatgcttatggtgacaagcaatcagacttggggatcattgacaaggtattaagaaccttgacaccaagatttgatcatatagtggtggcaattgagcaaggccagaatcttgaagagatgaagattgaagaactgcaaggaattcttgaagctcaagagatgaggctcaatgaaaaaaatttacaaagatcagctgagcaagctatgcaagcctaa

SEQ ID NO: 52080 - DNA, 147 bp, Glycine max
  Peptide Sequence Number=SeqID_143765
atgaggcttaagaatcaaggaagtcactcagtccattatgtaagccaccaagggaatcaaggagctggaaagaaatttatgaagaagcatgataaaggcagagggacatttctagaaggattacctaaagtgcaagtcttggtttga

SEQ ID NO: 52081 - DNA, 640 bp, Glycine max
  Peptide Sequence Number=SeqID_143766
atgaaaagagaaaaacatgtctcctatagtagtcataactcttgcaagagcctaagtgaagaacttcgtgactattatgaaggaaagcataggtcacatcttagacctcactcccataggagagaaaatgaaagaaagcctcaagaggttaacattaaactcccatacttccatgggaaggacaatgaagaggcttacttagattgggaaataaggcaccttctaagctccaatgatgataaggggaagacaatagaaaagcaaccccctaaggctagtatgcaagaaaagactagctctataaagtgctttaaatgtctttggaagaggacacattacttctcaatgtccaccaagaaaaccatgattatgaggagtcaagacatttatagtagccaagatgaggctgctacttcaccttcctctagtgaaagtgaagaagcaaaaagggaagaatctagtgaagaaatctacccccaagaagaaggaaaacctttaatggttaaggaggagtgtaaggagacacttgttagcattgccacaccttttgggcttgagtttattcctcaagtaaaggagttgttggatgagggtttggttcgcaagagcttaaatccttgtgctttgttggtgcccaaaa

SEQ ID NO: 52082 - DNA, 273 bp, Glycine max
  Peptide Sequence Number=SeqID_143767
atggcacgcaaaccgaggcagggactgaaaaacattgcagaagccttctctctccctctccctcacgttgcctttcttctccctcattctccattgaagctccacacaaagcttcaacctttggccatcattttgccccaaatcgtgaaaggagagcattttcggggtcgtgaagtgcgtggctacgagtgggacttcgaaatttcaggtttgggtggacttctttccctcttgattttcgtgggtatggggtttgggagatatgatgggtag

SEQ ID NO: 52083 - DNA, 648 bp, Glycine max
  Peptide Sequence Number=SeqID_143768
atgggcttgggccgcggcccgatctccttcacctctcaactcgcccgcaaactcagcaacacaaagaccaaaaacaccttctcttactgtcttctcgactacaccctctcccctccccctactagctacctcaccattggccccacccctaacgacgtcgtttcgcgaaactcattcacttacactccgttactcactaaccctttctctccttccttttactacatttctattcagagtgtttctgttgacggcgttaggttaccgataagtgaatctgttttccggattgacgccaacggtaatggcggcaccgtcgtggattccggcaccacgctcagctttctcgccgagccggcttacgggaagatcctcgcggcgttccggcggcgcgtgaggcttccggcggtggagagcgctgccgcgctggggttcgacctttgtgttaatgtttccggcgtggcgaggccgaagctgccgcggctgagattccggctcgccgggaaagcggttctgtcgccgccgccggttcgaccggattcggggttttcggtgattgggaatctgatgcagcaggggtacttgtttgagttcgatttggaccggtcgcggatcgggttcacgcgtcacggatgcgcggttcgttga

SEQ ID NO: 52084 - DNA, 972 bp, Glycine max
  Peptide Sequence Number=SeqID_143769
atggccaccttccatggctgccatagccatttccacacacctttgttgctgcacacccctcctccctttgcacatccaactcaattccttgggattgattttgaaagtacccgccaacggttgctgagtttgttcgattctgagaggacccctccttcatttcaacaaccaccatacgaagcttccatggcggtcgtccatggctgccactttccgtacggagcttccaccttccactaccaccatccctttcctagtcattctttccacacagccaaccaccagcaaccatgttcgcagcacccattcccttccatgtttgacacaagcaagcacgaaggatccttgactcacctcgaggctgtcctcactcgtctcgacgagagcatgcactccatgaatctaaagatagatgaactcctgaaccgttttccccctgccactccgatctcaaatgcaaacccaataccagttccgcacccccaccacgatgctcctgcaaataatcacaagatcaacttagaaggaccacggaccgacgacatagcactacaccttcaggaagagaagcttttggaatgtcgttcgcagactccgtctccgccaccacctccatcgccgactccgccaccgccgccgccgccacctccgtcaccacctctgccgtcacctccattggtcgcactcatacagccgctccccacaaccttgccgggtccgcttcacattgtgattgtttccctcatcgccaacagcaaccctcacatgtcctccgaccaccgcggaatcaccattcccggagtccgcaagaagcacttcagtcgcggaaaggagctcgaccactccttccccctcaccttgtacaccgcaaaatggctcaacactaacctccatctgctcatttcttcacccattttaatttgggatccaggttcaaattttgaagccatggttgaagccccaacaccttga

SEQ ID NO: 52085 - DNA, 1017 bp, Glycine max
  Peptide Sequence Number=SeqID_143770
aatttctgtattgatctacaagtgcagatgcttcttgaacctttaaaacttctgaagcaagcagatgcccaactcaatatgactcagggcacacttggagggattgttggagaagaacttggcattttgcctgggatggactctatctttttggtacttgcgcttgagaggcttgtaggatttttgcggattgcagcatcaaagagtcaacaggataaatttgacctaataatatatgatggtattagcagtgaggaaaccctgcggatcataggtgcaagcagtaaagcaagattgtacttgaaatatctccgcaccttggctgagaaaactgaacttgggagattggctgctccttcactactgagacttgtggatgaggccatgttaataagtagcagcagatcttatttcaatgggaaaatgagttcagaaatatgggacactttggatcaaatgctggagagaggatcttctgccttctcaaacccaaagaaatttggttgctttcttgtgatggatccgaacaatccaacttcgataaattctgccttacgatattgggggtgtacaattcagactggtgctcgggtttctggtgcttttggaatcacctctcagctagaaaatttagaatcattggaaagagcaaagaaagaattttctcctttgccgtctgcttccatttcaagattgtcaatgaataattctatagattggagcagagttctactggataccggaaatgaagatgctaggcatcttcttaattcgctatcaagtcaaggtggtgatatgccatcaccagttagatttgataaaaaaggaaaattggttactctcttcatgccaggttttgacaaatcagagatcaagctttaccaatataggggaggatctgagctgttggtagaagcaggagaccaaagacgtgtcattcctttgcctccagaaattcaaggaaaggttggcggagccaaatttggggacagaagtcttgttattacgttgctgtga

SEQ ID NO: 52086 - DNA, 1446 bp, Glycine max
  Peptide Sequence Number=SeqID_143771
atgccattgtgggattcggcacttcgctcgcttttgttctcgccgtctttgctgcctcaaggaaaggtaggtgtagccgtgtatggtgtaggttttatttttcgattcccgaggccgatgtggagcgctgtggagacccgacacgatcaaaacgacgctcgggagtttgacgtttctggtgggagcaagtcaacgctgtccgaggctgacacggaggacaacaacgttgctgttacgcaaactgataaatctgtagttgtagaaaagcctaaacgtgttgtcatcccggtttgtgtggattctacccaagaagaagcgttgtcagtcttaaagtcattgaagataattgaagatgatgtggaagctaatgaattgtgtaccagaagagaatttgctagatggctagttaaattgaattcttcattggaaaggaatcctaaacacaggattgctcctatagtatcactttctggatctgtatttactgcatttgatgatatcagtatcgatgacccggactttagatccattcaagtcttagcagaagcgggagtgatccccagcaaattatcttggaataatagtttcgattatggtggatttgacactcaacaaaacatcaatttttttcctgatagattcatctcacgacaagatctaatagactggagagctcagttggagtatgacttcttctctggggtagttgaccagatatcaattaaaaaagcaggttatatggatgtgaaggagatcatttcttccgcagtttatgtggacatgttggcaggggataagagtatacttagaaaagtttttggacagagcaagcgatttcagccaaacaaaccttcaacgaaagcacaagcagtggtggctctgacaggtggcaggatgaaggaagcaatatctgctgaattgttaagaatagaagcagagaattctgccagactggccgaggcagaggagatcaggtctgagttgcttagccgaggagacatacagagattttgggatgaaaagcttaatgaagagaaaaatcgtggttttgatgtagagaggctttatcacatggaagtaaagaatttggaagaagaggagatcaatcaagataagatatctgctgagtatttaaaagaaaaggcagcaatggattgtcagaagcagcttctgcttaacttaaagaaagaagttgatgagatatcggaaaaagttgcattggagagagtcacatatgtagatgaaaggcatgttgttcaaaagttgcttggagatttagaattaaagcatgaagaattgctcaacaccaaatccacgctggaagctgaaaaagaagctcttcagattcttaggtcttgggtagaggacgaggcaaggagaagccaagctcgggcagctgttcttgaagaggtagggcgaagatggaaatgggatgaccaagcttga

SEQ ID NO: 52087 - DNA, 120 bp, Glycine max
  Peptide Sequence Number=SeqID_143772
atgtcgatgggatctgagaagtatgaaatggaatcattccgtgacgtgaagaggaagaaaaagttgggtttcaaaggtcagaattttgttgttgaagctaagttggtttccaccggttag

SEQ ID NO: 52088 - DNA, 483 bp, Glycine max
  Peptide Sequence Number=SeqID_143773
atggcagccctatggccactttggcagaatggcacgacattgttttttgccaatcgccataggcaatttgtgaaaggatacccactacggcggtgcataggccacaatgaaaaagtagaacagaacatcagatatagtgcagagaacagagcaaggcaaggaaacaccaggaaggtgccaaaaaacatcagaaattgccggaaatgtcaccaaaaagtagtgggtcatgtttcagagatacgagggaacgacagcgaactgcaacgcaccacactacatggagtgaactgcaaagcgacacgctacaacagttctagagcgcatgattgccaatccgggaaaacagatatgagatacagaataccttcgtatctgatctcactcttaaaggtcaagcttatcaagctcccaatgtacgaatcggccgcggaactcgatcgagaagcgctctcagacgccataatcgcaagtgaaccagaatag

SEQ ID NO: 52089 - DNA, 153 bp, Glycine max
  Peptide Sequence Number=SeqID_143774
atgtgggatcggcacagacttaaaggagcactcaaaccgggtgtatttatcctcaagacctacattccaaatagtccgtcagggcatctccctcctgattcagacactgctcatgaattatacaatactcacgacctcacagtcgtattttaa

SEQ ID NO: 52090 - DNA, 777 bp, Glycine max
  Peptide Sequence Number=SeqID_143775
atggcgcctcgacttctttccgtcactctctctctcttagtggagaccaactctaccacacccaatgagctcaaaagcccaccatctccctcaagcaactctaccacacccgccattgctgagagaatctcctcggcttctggtgccgaagcggaaccggaatcctttctgatgcaatcctaccccgcaagggcattggatagaaaactccaagtagattgggccagagatgcaagagaaggccctagggttcttatgagccttaggactcatcttctccttgaagtggcgtctcctctctctctctccctttctccattccgctgccattcatcttccaagaagcaaaggaatccattgatgaagaagatcctaggcctacaagctccaatggagcttgcatcactttccttgcttttcttcgagtggggcccattcttcatctccgcttctagggttttccttcccaactccgattcaaacacttacgatgtcaccaaaacgtcgttcctcttgatgagcctctctaaggaaggacacgtggtcgcattttttgatcctaacaggaggagatccgatttcaaactcgagaatcggagcgaattggtggctgtggatgggggtgatgacgatgtcgtggtggtggggagcagatcactactggagagactgatggtggagatttaccagcggttcgcgaacccgcagagccccaagagtgatagcatagagtttgactgcgatgatgatttgtttgctattgttggggtttcccag

SEQ ID NO: 52091 - DNA, 288 bp, Glycine max
  Peptide Sequence Number=SeqID_143776
atgtttgatactttgaaaattgatggagaattcgaccatttcaagttaggaaatggggagatgacatcacaagggaataagtatgttggttcaaagtggggatgcaaggtgtacaaggggagatacttggtgttgcagaaaaataaaagtaacctttgctatttggatgaacaagccttgaagaggaaccatgatagcaaagtgaagaagaaaatgaaattttctaatattgttgaagtattgggagagacttctgttggagggggagtttgtttgctttcaaattga

SEQ ID NO: 52092 - DNA, 2196 bp, Glycine max
  Peptide Sequence Number=SeqID_143777
atgacttttgagcatcttttaccacccatttggcatgttcatccttatgtttgtctttatcaggagcaaaagcactgccatcaatgtgaccccgaagatcttttcattcgacaaatatctggaactggaatgcccaggctggggcccagttctagtggcactgatatgaaccaccagtcttccttgaatcatgtgcaaaatgcagtagatttctgtttgtcagattataggggatcttctggtgagactgcatgtttacgtggtactggtcataatgttcagagcttcagtggctggaatactggtgaatctagttcaagactcaatctgatcaaccaagtcaatgatgaaggtctaaaatcagaacatgggctgtcttcttcgtataatgctgctaccgaggatgatctcaggtctgaggaaggacaattcaaagcaaataatgtaatttttcctgttagttcaaatactaatctacatggcaatcaatctagagttcacccttcctttttgcaaggttccagttctactcatattaaccagaatattagtctagatatggggcatgtagctaatgctgctgatcgtgggaagggcaaagaagctggtagtagtgttaatgccaacaatactagtggaatagacagagaaaagacattgtttggcagtgcttcatgtaatcacacaggagcttcatctgaaagctctggatacatggcttggggtgatagtgctaattcaagttcttctttagttaattggggtccttcctgcaagagaaaggctcttgaaggtagttctaggcaactgtgttctggaggaagctcaagcactcttgtacaatccggaaatggttgctggcctactgatcctgttgatcttaatgcttccagcgacttaactgattctacacctatagaagatattcctgttactagtcctccattatttcagaatgcaacaaatgaagagcgacaagaagctcccaatggatttcctttgataagtattgcagaaaatgtggaaaggcctctaagaaacttcgatagaagaatgagccatctacagcatcaggaatctgtacctctcaatttaccatcaacagggagtgctaggcatcataatcattcttctctgcatcaagcacctggctctcactcaatcaatgattcgttggagttgaggttaacagctggagggacatcttctgctaattctggcgcttctctgaaccagtcacctgccttgcgcatccattcttttccttggaacagaactgccaatcctagaggggccagatcttcaacttcttataactctggagaaagagccgtgcgcgaagattttaatttgagaatgtttccaagagatagtacggaacaccccatgaatgtgcctgcatcttcaggacacgaacctattggttggcatacaccatctggcaatgtgaacaattctggaggtgcacctcctccatcctggattggatctagttcaaatgttcactctcccgctaaccgtagctggatttttaatcatgaagtcccagcagaaaatatgcagagtgtgtcagagttcagtccttggtccctttttccatcaattagctctgcatctggtgttcataatgcccattctgccccatcttcttctggtcctccttcatttacccagggttctagcagcaaccaatcatacgcaagaacagcattggtgatggaaagaaggggtggtgatgttctctctggtggtccccattcactgcgagcattaacctttgacaatgaggggagacgtcgactaatatctgaggattatatggtctttgaccaccctttcttatatcatggcatggctgaaatgcacgacaggcacagagaaatgcgccttgatgtcgacaacatgtcttatgaggaattgttggcattggaggagcatataggagacgtgagcactggattgaatgaggatgtcatcattaagttgatgaaacagagaatttacgtgcgtgccattatcatgacagactcttatacagatctggaaccttgttgtatctgtcaggaggaattttctgatggggagaatgttggatcactggattgtgggcatgagtttcacagtggttgcattaagcagtggctaatgcagaagaacctgtgtcccatttgcaaaacaacagccttagctacatga

SEQ ID NO: 52093 - DNA, 315 bp, Glycine max
  Peptide Sequence Number=SeqID_143778
atggcaatgggcgggtcgggtacgggtattgtctccccaattccttatcccaacttctcaacatattcccatacccgtacccgatacccgacgggtttgagtttattatcccatccccgtacccgtcgggtatcggattttaagtggtgggacgggttcggggtcgggacgggtctagtaatctcatacccgtacccgtacccgacttttggttatcggggaaaacccgaacccgatcaactcgggtattacccgtcaaagtcgggacggattcgggcagatatccacgggtacgggttttcttgccatgtctaa

SEQ ID NO: 52094 - DNA, 888 bp, Glycine max
  Peptide Sequence Number=SeqID_143779
atggcccccaaaatagattcaattaaaattgaattgttcttccctttcctagagggaggccatcagattccaatgatagacgcagtgagagtgttcgcatctcatggagccaaatcaacgattctcaccacaccctctaactctctcttcttccataactcaatcatgcgaagaggccatcagattccaatgatagacgcaacaagagtgtttgcatctcacggagcaaaatcaaccatcctagcaacaccctccaactctctccacttccaaaactcgatcagccgcgaccaaaaaaccagccttcccgtccccattcacaccttctccatcgacatacccgatgcaaacatgcctactgtcagtcccttcatctactcctcggctctcctcgaacctcatcgacatctcgtcattctacacccgccaaactgcattattgtcgacatgttccattgtcgggctcacgaaatcagtgataaactaggaatcatgagcattgtcttcaacggtcatgaaaacccgtctcagtttcctgatcggatgaatcattttgacaacagtttaaacattgttaccaacaacttctatgacttggaattggattatgctgattacgtaaaaaagggaaagaagacatttgtaggaccagtgtctctttgcaacaaaagtacggtggataaaagtataacagggaggccactcattatcaatgaacaaaagtgcttgaattggttgacctccaagaaacccaattctgttctttatgttagctttggaagcattgctcggttgccccctgaacatttaaaggaaatttcttatggtcttgaagcttctgaacaatctttcatttgggtggtgaggaatatccataacaacccataa

SEQ ID NO: 52095 - DNA, 696 bp, Glycine max
  Peptide Sequence Number=SeqID_143780
atggccacaccattcggctcccctcatcctttttctgagtcaacaacaccttcattgtctatgtcgaagaagacaagaaaagcaacacgactcagatcattggctactagaccagctggagtggagagactagtggctcatgtcgatcctgtcactggaaaaatcgatggttctcacagaaagaaattaagaacaaatttggggattgtcactcatgataagttggatttgacctccaaatgggctctagcacacgacaacgggggcgaggatgataaagcatgtgagaaggatgacataagcaaagaggagtggacccacactgacacagtcgttgaccctccatctcccattagacgacacgtgaagtggaagatggcccgcacgaaaaaatcaagtcaaatgatgtctgaggaagcaaagaaaaatgcagacaagattggaagctttgtcacccatggatgtcaggatgcactgactgctgccattgggcgaccagagcaccttagtcgtgtctattctgctggagtcggtgtcactatcaaacactactttggaccagcttcaaggggcacccatacctctttgtccatggctcctgaagacctagagcaacttacacaaaagatcaaagaccgactagaggactcgatcacacaaaaaatgactcaacaattaatgatgttcttaagctag

SEQ ID NO: 52096 - DNA, 1338 bp, Glycine max
  Peptide Sequence Number=SeqID_143781
atggccagtaacgatgattctttgcacatgtttttcttccccttcctagctcatggccatatgatacctttggttgacatggccaaactatttgctgcaaaaggtgtgagagccaccatactcaccacaccactcaatgcacctatcatctccaaagccatagaaaaaaccaaaactcatcaaggcaaagaaatccaaatccaaaccttgaaattccttggcaccgagtttggtttacccgaaggatgcgaacactgtgactcactcccttcaccaaatctatttccagccttcattatggccactgctttgttgcaagagccctttgagcaactattgcatcaacagcgtccaaattgtgttgttgctgacatgttcttcccatggacaacagattccgcggacaaatttggaattcccaggcttgtgttccacgggattagtttcttctccttgtgcgcttcccaaataatgagtctctaccagccttacaacaacacttcttcggacacggagttattcgttattcctaatttcccaggtgaaatcaaaatgacaaggttgcaggaggcaaatttctttaggaaagacgatgtggactctagcagattttggaagcaaatatatgaatcagaggtgaggagctatggagtggttgttaacagcttctatgaacttgagaaggattacgcagatcattacagaaaggaacttgggataaaagcatggcatataggccctttgtctctatgcaatagggataaagaggaaaaacatttagaggaaatgaagcgtctattgatgagcacgaagattgctatgggacttgaggcatcgggacaacaattcatctgggtcgttaggaaaagcatccaagaaaagggagagaaatggttacctgaaggatttgagaaaagaatggaaggtaagggactaatcataagagggtgggcgcctcaagtgttgatccttgaacacgaagccattggcgcgtttgtgacacattgtggatggaattcgacgttggaagcagtgagtgctggggtgcccatgatcacttggcctgtgggtggcgagcaattttacaatgagaagttggtgactgaggtacttaaaattggtgtacctgttggtgttaaaaaatggactcgttttataggggatgatagtgttaagtgggatgcattagagaaggctgtgaaaatggtaatggttgaggaaatgagaaatagagcacaagttttcaagcagatggcaagaagagcagtggaagaaggaggatcttctgactcaaatttggatgctttagttcgggagttgtgttccctctcccattga

SEQ ID NO: 52097 - DNA, 432 bp, Glycine max
  Peptide Sequence Number=SeqID_143782
atggttagaacacgaggtttaggtcgtgcgttaggagctggtagaggtagaggcattagtgaggatgcgcatgaagctgatgttcctcggtgtcgcaggcctactgcttcagcacgtaggcaatgggttcgtctgcgtgaggacgtcacagagagacctgaggatgtggctcagttgcatgaggatgttcctcatgtgtctgatgccaccccagagatgataggcctcgtcgatgctgttcagacagagggagtggctactaatgggagcttggggtcacctgctgcagatgagggattccccgatggaccacgcgacccattgactttgctgagcatgtcgcacacagcatctggagtggacagtagaaaagtagataaaattgggagaccaacgcctgagatcgaatgctacattgctgcgaccggatga

SEQ ID NO: 52098 - DNA, 871 bp, Glycine max
  Peptide Sequence Number=SeqID_143783
atggccaaattatttgctgaaaagggtgtgaaggccactatagtcaccacacccctcaatgcacctttcatctccaaagccattggaaaatccaaaactaagcacaacagaatccatatccaaaccattgagttaccttgtgcagaggctgttttacctgatagctgtgaaaatactgactcgatcacttcacaagatttgtttgaatccttctgtatggccacatgtttcctacaagagccatttgagcaactgatagaaaagcaacatccagattgcattgttgctgatatgttcttcccatgggcaactgattctgccgccaaatttggaattcctaggcttgtgtttcatggctatagttttatctccttgtgtgctacctcgtgtatggaactctacaagtctcacaacgacgctgagtcatcatcgtttgtcattcctaatcttccggagttgaggagctatggggttgttgttaataacttctatgaacttgagaaggtctatgcagatcattccaggaacgtgcttggaagaaaagcgtggcacattggtcccttatccctttgcaacaaagataacgaagagaaagcacatagaggaaaggaggcatctattgatgagcatgaatgcctaaagtggcttgacacaaagaaacccaattcagttgtttacttgtgttttggaagtgcggtaaagttgtctgattctcagcttcgagagattgctatgggacttgaggcatcgggacaacaattcatttgggttgcggggaagacgaaagaacaaaagggagagaaatggctacctgaaggatttgagaaaagaatggaagttaagggactaattgttagaattaatgtctcat

SEQ ID NO: 52099 - DNA, 648 bp, Glycine max
  Peptide Sequence Number=SeqID_143784
atgtgtccttgtagcaatcctgatgaggtaattactagcatgggaactcgaggaggcaagactagactttctataggatcacatcaggggtcagtcatgagtccttacttgtttaatttaatcttggatgagattaccaggggcatacataaaattatccctaattccatgcttattgcgaatgatataggcttagtgcaagaggagcaatttgagacttttggaagacctcttctagtcatagagcaagaacacctttggggaatgtttttgatgggtctcaaggaggaacagctcatggatgaaggtctggagaacaagaatagaacaatgatctttgcattgcaacttcatgatcactcagcgagaatttcatatgaaacaaagggaggaaggaggggcaagactggaattagaggaaaaagaggccagtcttttgagctaaagagccaagtcctaatgaatgtagagaagaatttggatgctaagaaaggaagtaattttcaagaattagtggaacatgacctaatggaatcaaccattatggtagcaaaggataagggttcagctagtaatattgccaaaatctctacagagagaggggagcttaacttggctgaagtggttttttatttgtcaaaggtgtaa

SEQ ID NO: 52100 - DNA, 1443 bp, Glycine max
  Peptide Sequence Number=SeqID_143785
atgagtagttgtgaacatcatcctctacacattttcttcttccccttctttggccatggtcatatgataccaaccgttgacatggccaaattgtttgctgaaaagggtgtgaaagccactatagtcaccacacccctcaatgcacctttcttctccaaagccattggaaactccaaaactaatggcaacaaaatccacatcgaaaccatcgagtttccttgtgctgaggctggtttacctgttggctgcgaaaacgttgactccatcccttcaccaaatttgtttcaagccttcataatggccaccggtttactacaagagccgcttgagcaactattgctcaagcaacgtcctgattgcattgtcgctgattttttcttcccatggacaactgattctgccgccaaatttggaattcctaggcttgtgttccatgggaccggtttcttctcctcgtgcgctaccacgtgtatgggactctacgagccttacaacgatgtttcttctgattccgaatcattcgtcattcctaatcttcccggtgagattaaaatgacaaggatgcagctgccaccttttttcaagggtaaggagaaaacaggcctggccaaattgttggtggaagcaagggaatcagagtcgaggtgctatggggttgttgttaatagcttctacgaacttgagaaggtctatgcagatcatttcaggaacgtgcttggaagaaaagcatggcacattggtcccttatttctttgcaacaaagataccgaagagaaagtgcatagaggtaaggaagcatcaattgatgagcatgagtgtctaaaatggcttgacaacaagaaacctggttcagttgtttacgtatgcttcggaagcgtagcaaagttctcggattcacaacttagagaaattgcaataggtctagaggcttcagggcaacaattcatctgggtcgttaagaaaagcagagaagaaaagggagagaaatggttacctgatggatttgagaaaagaatggaaggtaagggactaatcataagagggtgggcgcctcaagtgttgattcttgaacacgaagcaattggcgcgtttgtgacgcattgtgggtggaattcaaccttggaggcagtgactgcaggggttcccatggtcacttggcctattgctgcagaacaatttttcaatgagaagttgttgagtgaggtccttaaaattggtgtacctgttggtgctaaaaaatggttacgattggagggggatagtatcacatgggatgctgtggagaaggctgtgaagaggataatgattgaggaagaagcaattgaaatgaggaacagaacaaaggtgctttcgcagttagctaagcaggccgtggaaggaggaggatcatccgattctgatttgaaagctttaattgaggagttaagttcattgagtcactaa

SEQ ID NO: 52101 - DNA, 264 bp, Glycine max
  Peptide Sequence Number=SeqID_143786
atgaaagggaagaaggggtgtggcaaagatgatgcgagtatagatgttgttgaggatgatgccaatgaaggccatgatgatgtagagctcgttcatggcaagaatattgggagagtgacaaagacgacgtggccgctatggatgccaggggaggagatgacaaaggctagtgttgttgtagatttggaagggttatgtgataagggttttctgagaatggtgttaagtgataaggaagttatggacattttgtttaaaatttaa

SEQ ID NO: 52102 - DNA, 1737 bp, Glycine max
  Peptide Sequence Number=SeqID_143787
atggcaactataggaattggagtaggagtgacaaagcttcaacaaccccacagaccaaagtctaagtccttgtttcttggacagaggcttagaattagtcccttttggggggagcctcaatgcagtgaaagaagactattcggtgtctcaaacccaccaagagtggttcaagtttttgcactagggggtggtgaatggcttgacacagttcataatctctttgtgggtgttggggttggacttccttgcagtgtgatgcagtgtggtgatgtgatctatcggagcactcttcctaagtccaatggcttgacactcactgtccctggggtgattctggctttggggactctttcttatctttgggccacacctggtgtggcacctggtttctttgacatgtttgttcttgcttttgttgagaggctcttcagacccacttacaagaaggcatggggtttacaacaagatgattttgttctggggaagaagttgggggaggggtcatttggagttgtttatagagtgtcactggccaacaaaccctcttcaaaggaaggtgacttagtcttgaagaaagcaactgaatatggtgctgtagaaatttggatgaacgagcgtgtacgaagagcttgtgcaagcagctgtgcagattttgtttatggttttcttgagagctcttcaaagaaagccgctgaatactggcttatatggcggtttgaaggggatgccaccctagctgacttgatgcagagtagagactttccatataatgttgacttgcccaaaggattggaaagagaaaatagaatcattcaaacaatcatgaggcagatcttgtttgcactggatggtcttcactcaactggtattgtgcatagggatattaagccacaaaacgttattttctctgaagaatcacgtacattcaaaattattgatcttggagctgctacagacctgcgagttggcatcaactacattccgaaggagtttcttttggatccaagatatgctgcaccagaacagtacatcatgagcacacaaactccatcagcaccctcagttccggttgcaactgcactttccccagtcttatggcagttgaatttaccagacagattcgatatctatagtgctggtttaatctttcttcaaatggcattccccagtttacgttctgataatagcctcatacaattcaaccgtcaactaaagaggtgtgactatgacttggtcgcgtggagaaaaaccgctgaggctcgatctgaacttaggaagggctttgagttgttggatttggatggtggaataggatgggaacttctgaaatcaatggtaaggtacaaagcaagacaaagactgagtgcaaaagcagcattagctcatccctactttgtcagagaaggcttgttggcattgtctttcatgcaaacactgagactgcagctcttacgtgcaactcagcaggattattcagaagctgctaggtggattattcagctaatggcaaaatcagggacacagaaggatggtggattcaccgaagctcagcttcaggaactgagagaaattgaacctaaaaagaaggctagtgcaccaagaaatgctctagcttcagcccttaaacttcagaggaaaattataagaactataagaaccttaaatgagagtatggatgagctcacaagacgccggaaaagcttttggtggagcagatggatccctagagaggaatga

SEQ ID NO: 52103 - DNA, 1632 bp, Glycine max
  Peptide Sequence Number=SeqID_143788
atgatcatcgttatgttcaccgtcgtcaccattaacataatctccgcccttaccagtgatggtagtggtgacaacgatgaaaatcatgttggtggcgataacaatgatcatgaaggcaattacaatggtgatggtggtggaagtaacgatgacaaccatcatgacgatgaacccgtctccccttccaggagaaggtcagcccccaacctccctccgtctaacaacttcacggcggcccaaccctcctccgccgaacccctccacggcggcccaacctcacctttgggtcctggaaactgcggcgccatcatcaaacgaacgacacagcgtttgccttgttcgttggcgcagcagggcaagcttaccctgcgcattgttatgctctcaaagtggatccctccaatttcgttgggagcaaaatctttactgagaaggaaatgcaacctaaacccaaacccgaacatcccgagagtgcaatggttctcagtttcatcgtcgaaagcagctccgatgatagagatggctgcaagagatggggaactgagggtcttccttgttgccggtgaggtttctggagattccatcgcttctcgcctcatggcttcgcttaagattctctctcctttacctattcgcttcgctggtgttggaggggttaagatgacaagtgaaggattgcagtctttgtttcccattgaggatatttctgtaatgggactttgggagctattgccacatttgtatagaatcagagtgaaactgaatgaaactgtcaaagctgctgctctatttgaacctcatgttgtattaactattgattctaagggcttttcatttcggttcttgaaacagcttagagctagatatagacaaaagaagttgcattcgccagcacactttcactatgtagctccatcattctgggcatggaaaggaggtgaaacaagactcagaggactagcggaatttgtggatcatttattgtgcatacttccaaatgaggacaaaatctgtagattaaatggattgtgtgcaacatttgttgggcatccagtcctggaagatgttctggaattgaatttgagaaacaattcctcgattcatgaatggaaggctgaaggaaatggtgaagacttccgaattaagcatgcagtgccagcaggagccactatcattagcttgcttcctggaagcagaatgcaagaagtcagtcggatgcttccgatcttttcaaacacagtggaactgatgaaagacatggttccacagttgatgacaatcattcatgttgcacctaatgagcatgtggaaaatttcatagctgatgctgttcacagatggcctgtgccagttgtattgataccaggtggaacaacacaactgagatatgatgcttttagtgcaagtagagctgcgttatgcacatctgggacagttgctgtggagctgcagcttgcacgattaccctgtgttgtggcatatcgtgcccatattttgacagaatggtatatttggtacaaagcgaagatacagtatatatcacttaccaatattcttttggacaaagccattattcctgaagcactctttcaatcttgcaaaccacttaacttagccttgttgctcaagtaa

SEQ ID NO: 52104 - DNA, 237 bp, Glycine max
  Peptide Sequence Number=SeqID_143789
atgtggttgcagtcacgagcaatttgcggcagtcagtgctcaggcgaaaggagaaaggagaaacattcaacactaacaccaacactgttgtcgcaacgtgcccttttgcgggcgagcgaaggtgaggctcacgggtgcgctttccaaaggaggaaagatgcgcagagtcgccaccaacgtttatttgaggaaaacgtcaaaaaaaccaaaggaaaccggtcgaaacaaaaattctaa

SEQ ID NO: 52105 - DNA, 476 bp, Glycine max
  Peptide Sequence Number=SeqID_143790
gagactacttctttcccttcttctagtgaaagtgaagatgaagtaaggggtgaagagtctagcgagaaagtctatccccaagaagaaggtgacctcgtaatggtagctaaagatcaagtacaaataaaatacaattgggataaggaaaagaatagaaaaagaaaagaagaacaacctttaatggttaaggaggagtataaggagttaagtctctcctccaagaggacacttcttagcactgccatacctcttaagcttgaggttattcctcaagtaaaggagttgttggatgaggatttggttcgtaagagcttaaatccttgtgctttgttggtgcctaaaatatgtattatgaggcaccaaatccctaagataggtggtatgatgaatgtgttgagtggtgcaacccgtttttgtaaaatcacctatgcaaccaacatcttcatgattcacatacatagggactcattaggtag

SEQ ID NO: 52106 - DNA, 471 bp, Glycine max
  Peptide Sequence Number=SeqID_143791
atggtagccataaccccaactaaggttcatcaacctccatttctccaagaatacgactcgaacgcaacgtgtgcttgtcatggagaagccccggggcattccattgagcattgtaggggcctgaagcgtaaggtgcaaggtctaattgatgcgggctggctgaaatttgaggagaatcgcgtattttcaactttcaccggaatatgggtgcaagccattggtctgtttgctcaagcgacctgtgctcctgagtttggacttccaagaccgttcaatcagagattactcgtcttgcgcgttggtgggggtgccgtaaaacaacaatcctcaagcaacctacttgagattttccactctctttgtaaaactccttttacaaagtctgaaccacatagggacaacccttcccttgtgttcaagaatcccctacaacaagagacccatggtctcttaatcccttttcagaaataa

SEQ ID NO: 52107 - DNA, 303 bp, Glycine max
  Peptide Sequence Number=SeqID_143792
atgtttgcacattcgattaaaggctgccgtcccttgggacggacgtgtggggtgctaataccttccccgtgcgtaaatacaactcccgaacctttcaacttaaaagttcgtagatcgcgtcttttccggtttttccgacgttttcctcgaataaacgttggtggcgactccgcgcgtattcctttcgtggaacacgcatcccgcgagtctcgcgtcgccctcccgccgaagggtaggttgcgacacaaggaatttgaggaacagatttaccaatcaatgcggagacatttccccccatgctaa

SEQ ID NO: 52108 - DNA, 549 bp, Glycine max
  Peptide Sequence Number=SeqID_143793
atggggacaaatcaaactggcaaaaggttttatcaagtcaagattaagagcctagatatcaccagcattaaggagttggggcggttgatgggacctctccaaatacaagccttccgcaaggcgtacggaaagatcttagatttgaccataacaaagatatccacagaagccattgcatcactcacccaatactatgaccagcccttgaggtgcttcacgtttggagacttccaattagtaccaaccgttgaagaatttgaggagattctaggatgtccccttaggggaaggaaaccgtatcttttctccgggttttttccctccttgagcaaaattgcaattgtggtcagggatttggcgagaggattggaccgcatgaagcaaactcgaaacggcgtagtgggcctaccacggaagtacttagaaggcaagatgagggatatggcgaatcaagaggagtgggtttcgtttatggatgtattagcattgctaatctttgatggaaataaggaaaggagggagttctcatctcatgtgagggctacctaa

SEQ ID NO: 52109 - DNA, 177 bp, Glycine max
  Peptide Sequence Number=SeqID_143794
atggaaagcagtatagttatagtatcaaatgttgtatcttcaaatttggcttctttctacgaaataaagttgcaaaaacggaagaccgagagcttaattagacatagaattcaaatggagcatgccatcattgacatgaagactgatgagaagtttgaaataacatttcttacatag

SEQ ID NO: 52110 - DNA, 489 bp, Glycine max
  Peptide Sequence Number=SeqID_143795
atggcaagaggtctacatacgtcatgggatcggggtgaattcttgagttggcctcgggggaaagttcctttatcgcgttggaaccgatgccaaagtgggcattgccggccgagcgagtcggggttggagccggagctgtgcgggggcctctccttcctttcgcctggatgggcgcataccctcaggtgtacgaaactgcgtggttgtttcgtatggaaacggaacaggtttaactaccgaggggtatcgagccgccttgatctatcatctattgcaacaggtcctcctagcgtactgcgtccatgttatgtagctcgccgggatgacatcaatgaaggaacttccctctctgtcaagcccaccggggaattacgcctttcccctttggcctcgaataccaagtcctgcgaagctggagggcatgtagcccacgaatttctcacagtaaaacttgacctagcgcaaggtgtctaccatcacatatggtaa

SEQ ID NO: 52111 - DNA, 135 bp, Glycine max
  Peptide Sequence Number=SeqID_143796
atgaaggcaaccattaggtccttccaagaatggactcaggaaggttctaagttagtgtaccaggtagtcaccccaaggaaaacgcaaggatcatacatgagtaaacatgaaaataagtatgcaaaaaacatgtaa

SEQ ID NO: 52112 - DNA, 366 bp, Glycine max
  Peptide Sequence Number=SeqID_143797
atggttctatcagctgttccctcctgttcagctactgacgggtggtgtatccgtaatcggcaaaagcataccagccggacatcagcgctggcaagtgtagccggggtgctaaacgctgacgcggtgttccagtcgaatgcgttcgtcagaaaaaaagctgcaccggtgcgtcagcatgaatatgtgaatacagactcactatattccggcgaattccgtcagagctcctaccgctcggtcgtcactgcggcgagcgctcagaaatggcttaccccaacggggcggaattcggatagacgtcgccaggaacacgttcacagggaagtgcccagccaggcacgccgcggcaaagccgtttttccatag

SEQ ID NO: 52113 - DNA, 138 bp, Glycine max
  Peptide Sequence Number=SeqID_143798
atgactagcattccacaacctgttgctgataatccagtagatcaagttgatcatcaaattcttgaaaatgatgaacaaccagttgaaccacatgatccacaagaaaatgttgatgcaacattaaggagatctactaga

SEQ ID NO: 52114 - DNA, 380 bp, Glycine max
  Peptide Sequence Number=SeqID_143799
gcgatccaatggttaacgaatcagaacgaagagaatgttactgagggtagtttcatgacaaatggaattgaattgtttggatattgtgaaagcttggaggggttgatggggacccgacttgtggaagtgggagagttgatttgcgccatcgcccgatctccacttagtaccacatatgacaaagtggtacctggagatatgtcgcgggggtcaggagaccttggggacgtcaggtggggtgctattgcccaaaaacaagcttggccaatcccgacccaacccgtgcatagtcagtcagtgagaacctgtgacgtacctaaacaggcgagctcctggcagtcaaccaataaaagaacaaagtccatgaagcaaggaggctt

SEQ ID NO: 52115 - DNA, 491 bp, Glycine max
  Peptide Sequence Number=SeqID_143800
catcggctaactctgtgccagcagccgcggtaagacagaggatgcaagcgttatccggaatgattgggcgtaaagcgtctgtaggtggctttttaagttcgccgtcaaatcccagggctcaaccctggacaggcggtggaaactaccaagctggagtacgataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcagtcatcatgccccttatgccctgggcgacacacgtgctacaatggacgggacaaaggatcgcgatcccgcgagggtgagctaa

SEQ ID NO: 52116 - DNA, 156 bp, Glycine max
  Peptide Sequence Number=SeqID_143801
atgacgctaagcgccagtcatggtagctgtcgcaacctacccttttgcgagcgagcgaggcgaggctcacgggtcgacaaaagcggggctcttgctcctacgtaccctccatcgaagaggaaatcagacctacgtagttctttcaaaaggcagtaa

SEQ ID NO: 52117 - DNA, 549 bp, Glycine max
  Peptide Sequence Number=SeqID_143802
atggcgcctaccaggcaccctctggacccggataagtccaacagggccctgggatttcccgccttgatcacaggactctgccagtcgttcggcgtccccgtcgcacctagtaaggtgattcggccgcccatcacccgagcttttattgagaagtattgcacacagagacaggcccagggggatgctccgcaggtcgcagacgtgccgccacctcatcaggctggtccagccggatcgtttgatacggagcagtatttgcagcatttggttcgccagcaggcggccaaccaccgggctcatgtacagacccatgattgtctttacaagatgagccttagcctgcagagccagggttttacttcgtttccgtgccttactccagaccagttcagggcagaggtcgcatggcctggagattggcctgaggcccgggcgggagaggcacatgcggaggcaccagcagaggctcccgacgaggcagatgaggcccgcgaggacgaggagatgaccgatttacttgatttcttaggagggagcggagccacatga

SEQ ID NO: 52118 - DNA, 192 bp, Glycine max
  Peptide Sequence Number=SeqID_143803
atgtacatcagtatggcccaaaaatacatcatgaagcatagccaacaaaacatgttatcctacaaaaccccccacacttattcccaaaacaattccaaagctccaaaattccttaaggcttgtaatgagctcaaaacaaagaaaggggaacataggctcaaaggggctatcaaaggaattaattcagggtag

SEQ ID NO: 52119 - DNA, 195 bp, Glycine max
  Peptide Sequence Number=SeqID_143804
ccaagctgctggcttaacgagaattcgctaagcgcaaaggaggtttccggacatcctctagaggaggttttcagactatggaaagctaaatcctctgttggatcttcccttggaaactggtctgattctaaagtccttgatagtacaggactaagttgttgtgctatcacgaggaatcggggcacaagaacttag

SEQ ID NO: 52120 - DNA, 510 bp, Glycine max
  Peptide Sequence Number=SeqID_143805
atgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgagcggttcgctgcccgcgacgttgtgagaagtccactgaacttatcatttagaggaaggagaagtcgtaacaaggtttccgtaggtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttcgtgcgccaaggaactcaaatctgttaa

SEQ ID NO: 52121 - DNA, 417 bp, Glycine max
  Peptide Sequence Number=SeqID_143806
atgaccggtagattgctgaccggatcattgacctttgataatcgcatcatgcactatattattgttagaattttgcttcccagatcttcaaatttggctcaagcctttgaggaggacttgattttgatgtgggctttccttaccgatcgtcagattgactgggctcacttggtttggtaccgaatgcataaggcattatgggccaatgcacctcttccatatcctcaattggtcaccctctttctccgtcattttcaaattcctcttgatgatgaaccttttgttcaagtcaagcgttcctttgctataggtgctagtgcagaatggatatccgtctcacgtagcttgaagaggatatgggttatattcgtcagagcttcgatcttccaccaccaccaccaccctcttagtgtttag

SEQ ID NO: 52122 - DNA, 363 bp, Glycine max
  Peptide Sequence Number=SeqID_143807
atggcacctactaggcaccctttggacccggaaaagtccaatagggccctgggatttccagttttgatcacgggcctcttccagttctacggagtgcatgtcacccccagcaaggtaatccggccgccaatcacccgagccttcatcgagaagtactgcacgcctaggcaggtgcagggtgacgcacatcagaccgcgggtgcatcgccaccacctcggcaggccgattcggctggaccactgagtgtcgcgtggcctggagactggcccgatgcccagacaggggagaagcttgcagaatccaatttggacgaggatatgactaacctactcagtttcttcggagggagcgaagccacatga

SEQ ID NO: 52123 - DNA, 267 bp, Glycine max
  Peptide Sequence Number=SeqID_143808
atggcctcgaagcgctgctggtgctcggcgctcctgaaatggtggctatcaaactcgggggtgacactggtcccttcagccgcgacgtccctcctagatctctttgtggaaagctttttcggagatatttcctgcgaggacaaacatttggaaaggttatttgtctctagctacctattctatatattcatgtacatggtgaataacatctttacacaaactaggcaaacatcatggtgcagccccaacaatcaactgctggcctaa

SEQ ID NO: 52124 - DNA, 465 bp, Glycine max
  Peptide Sequence Number=SeqID_143809
atgacgttagtctctgcatgctatcctgcgttaagtcttacagatagcaaaaaaagtttttatacggataaccacttgggtatctctgcctgccccctaacttcacgggttagtattgacagaaattgtctgtgcggagaattacttgtctatctccgcatgttaccggacttcacgggtcaggataacaaaaagtgtgtggcagtcgacaaaagcgaggcctttgctccttcgtatcctcaatttgtgatgagggtgcagatgaccacattggcctctgcttgtcaatcgaagttggggtctccgaatgacgaggtgcggataaccgtaaggtgtctccgcatgctacccgacacttgggtcatgatagcaaaaggtggggtggtcgacaaaagcgaggctcttgctcctacgtatcctccatttgtgatgaggaactcagacctacgtagttctttcttgtga

SEQ ID NO: 52125 - DNA, 240 bp, Glycine max
  Peptide Sequence Number=SeqID_143810
atgaaatgcaaaactttggagtcttacttgcaggttgttattaatttgcaaacactaaaccagacacttgtgagcagagggaaacaccagccttgtgaggaaaatatgaaaattgagggtacaataagcaaaaaggcaacagaaattgatgaaaacgaagaaaatctaaagcaagcccagcccaacatgcgcgctaagtgtgcatcacgcactaagcgtgcaaggcaacacaggcgctaa

SEQ ID NO: 52126 - DNA, 135 bp, Glycine max
  Peptide Sequence Number=SeqID_143811
atgacatcagaagcaaagacttccattgatgaagagatccaaggcctacaagctcacatggagctacatcatgtgttattagagcatcttcgtcctaggttctatcatttttcagtcataatattcttgtgctga

SEQ ID NO: 52127 - DNA, 734 bp, Glycine max
  Peptide Sequence Number=SeqID_143812
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 52128 - DNA, 456 bp, Glycine max
  Peptide Sequence Number=SeqID_143813
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccggttagcgatcaaagaaggtagcaagtctacatacgacatcaagataggcgcgaattctggaaccttctttactggaaattccttcccgtactggcgcttgtgctcagattggagctatcggtggagcgaggggtttccgaggcgggccgaaaagctcgattga

SEQ ID NO: 52129 - DNA, 477 bp, Glycine max
  Peptide Sequence Number=SeqID_143814
atggaaagaagtatgatagatgctgccagtggtggagcccttggagacatgacccctgctgaagccaggaatttaattgagaagatggcttccaactcccaacaatttagtgccagaaatgatgctattgtcattagaggagtgcataaagtagccatgaattcatcttcatcagctgaaactaagaagcttgagggtaaactagatgccttggttaacctgcctgaagcttatgctgcaaatatctacaatagacctcctcaacctcagcagcaaaatcaaccacaacagaacaattatgacctctccagcaacagatacaatctcggatggaggaatcgccctaatctcatatggtctagccctcagccacaacaacagcagcctgctccttccttccaaaatgctactagtccaagtagaccatacgttcctcctccagtgcaacaacaacaacagcaacagcaacatcaatag

SEQ ID NO: 52130 - DNA, 210 bp, Glycine max
  Peptide Sequence Number=SeqID_143815
atgactaaagcacgtcaaaagggggtacggaaagataatgggggagatgcttgccacccagctcgcccaggcgagcaaggtgacttcctccagaagcaaccgccttctggaggaatcttctggagggcccaagtgggcttggttgctatttgcacccccacttttactaaatacacccctgcccttttttttgtgattctttttccgtaa

SEQ ID NO: 52131 - DNA, 361 bp, Glycine max
  Peptide Sequence Number=SeqID_143816
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataaggttgtaatggggccaaggacaaggtatggagaaatatggaataagtggctaaatcccaaaggaatagaggagcaatggggaataagtgcatattaa

SEQ ID NO: 52132 - DNA, 130 bp, Glycine max
  Peptide Sequence Number=SeqID_143817
gtgtcgcaacctacccttcggcgggagggcgacgcgagggctcatgggtgcatcttccaagaaaggaaaatgcgccgagttgccaccaacgtttattcgaggaaaatgtcagaaaaaccgaaaagtgtga

SEQ ID NO: 52133 - DNA, 477 bp, Glycine max
  Peptide Sequence Number=SeqID_143818
atggtcattgaccaatccctttttcatgacttaacccaattgtccagtgacggtgtaccatttgaaggtaccctgaatgacgattggaagtttgatttttctgcacatgatgcccgccagttggtttgcaccaataatgcggatatgaccagacgccttcttgccggctcattggcttttgaaagccacatccttcattatctgattgtggggatttttcttccacgatcttccaatcttgcccaggtttctgaggaagatcttgttatcatgtgggcctttcataccggccgtcaacttgactgggcacatcttagatcttttttaattggtgctgctgcgattgcttcttttggttaccgcaaagagcgtgatggctcttgggtcaaaaagggcactcaacccgctgatgaagaaggcaacctcccagatgaagataattccactcttcttcgaaggcttatggacaagttttga

SEQ ID NO: 52134 - DNA, 652 bp, Glycine max
  Peptide Sequence Number=SeqID_143819
aggactgcacgtcctcaccttcagaggaccaaacatcctcatcttcagaggactacacgtcctcaccttcagaggactacacgtcctcaccttcagagggctgcacgccctcgccatcaaaggactacacgtcctcaccttcagagggctgcacgccctcaccttcagagggctacacgccctcgccatcaaaaggctacacgccctcgccttcagagggttgtacgtcctcgcctttagagggctacacatcctcactttcagagggctccacatctgcgccttaagagaatttatgctactatgcatactggggcaagatttcacccgtgccgttgcaaagagacgagtgcgggtcatgcgcaccaacatgaccactcttacacagatatggatgacattgctagttagcaacattccaccaggcgaccgcaatgccgatctccccctgcgaaagtatcggttggtccagtttcatcccgacatagggcctagggtttcaagctctggttacgggcctcttgtcagttctacgaaaggtgcccgtcgcccccaacaagggcaagacaccacagtagcctggggatgggcggcagcggacaacagacgcactgccgccacctccaaagcccctcagttcatccacaaaaag

SEQ ID NO: 52135 - DNA, 273 bp, Glycine max
  Peptide Sequence Number=SeqID_143820
atggccgccgcgtggtcggcgctaaacccattggcgctgacgctgcggccaggccaggataagctcgcccccccagtaggggaaatccccaacgccgccgttccacccagcgattccgcgtcatatcccagggccggaccgagtcaaccattagccgccgaagcgccagccaggccaaaagggatatcaacgcataaaaacgcagcccagttcgaagacttcacctgctgcgccaggctccggtatcgttccggccttactttgcaccactag

SEQ ID NO: 52136 - DNA, 522 bp, Glycine max
  Peptide Sequence Number=SeqID_143821
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcaagacaaccaagttgcacactctctagctagggcttctaggtttcatgctaaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 52137 - DNA, 331 bp, Glycine max
  Peptide Sequence Number=SeqID_143822
ggtatatgaagagaatgatggtgtaatatttgaaggcagtaaaaaagcgattcagattaaacgtggaattagtttcaatgctttgaaaaaaattggagataaggatgtggccggtgcttctatgtttcattctgcaaattttcttacatcatacggaaatgatttatctaataatgaggtgcaaccgccaacaaatgtgagcaacttacacggtgatgatgatgatgattatcttgtgtctaactcatacattgaagagtctttagacgaagatgatagtgttgacggtatatctgatacagacgatgaagtcgccgacaacattcaacca

SEQ ID NO: 52138 - DNA, 649 bp, Glycine max
  Peptide Sequence Number=SeqID_143823
cgctgtttatgtgtcctccaccatcgagtctggagccccgcgaattcattgcctagcgctgttcgccaattctccattctccaatcttattcggagacccatgaattcattgcctagcgttgttcatgtgtcttccaccatcgagtctggagccccgcgaattcattgcctagcgctacccatgaattcattgcctagcgctgttcatgtgccctccaccatcgagtctgctgccccgcaaattcattgcctagcgctgttcgccaattctccattctccaatcttattcggagacccatgaattcattgcctagcgctgttcatgtgtcctccattatcaagcgcggagcctctgaaaaaaggagtagaaacgagagtcgttatggactaatcacggaaagggcaagacggacgaaatcagtgtcttatctttgctttcctcttatctccgataaaagatacttggcatcctttgttgcacaatatgtgaagtcccgagacgtgtcgaaaatcaaaaggaagcaggcttacgcaatccgtgaaattccacccacttgggccttccagtttcttcctccagaaggcggttgcttctggaggaagcaaccttgctcacctgggcgagctgagctcgcctgggcgagctgg

SEQ ID NO: 52139 - DNA, 444 bp, Glycine max
  Peptide Sequence Number=SeqID_143824
atggtgaaagttggaacctcttacgtgccgatcaacgtctcattttcgccaaaagttcggcccagggcttgcccggtgtttttcgagctccatggcgtaatcatggtctatcagctgtcccttcctgttcagctactgacggggtggtgcgtcaattcggcaaaagcaaccgccggaagcatagcgctggcaagtgtaagcctggggtgcgacgctgagcgccaagccgggcgatcgaggcggcctttgcgtattacgccggcgctaaagggcggagtgtgcatactggcttactatgttggcactgatgcagggtgtttcccagtcagaagtgcttcatgtggcagaaaaaaagcgacggtgcgtcagtcagaatatgtgatacggactcatatagggcgaattcctcgtgactcctacgctggtcgtcatgcggcagcgtga

SEQ ID NO: 52140 - DNA, 237 bp, Glycine max
  Peptide Sequence Number=SeqID_143825
atggctggtacattcttccttttgaaaaagcaaaatagtttagagattatgagcgggacgccacaattggtggtatcagagcaaaagttggattctagtgaacctgttatggtcttgctgtatgactactgtgtatctctgaaacttgggagtaggtttcggggagtgacgttaagtcacacattgtgtgtatttctgccttattgtcttgagcatggatgtgtgactgattcatag

SEQ ID NO: 52141 - DNA, 163 bp, Glycine max
  Peptide Sequence Number=SeqID_143826
atatgacgatttaggtgaacaacgtccggggccttttgccaggtacctagaggaatggggaatcgtcccacaatacactatgccggggtcacctagcatgaatggtgtggctgaaagacaaaacaaaactcttaaggatatgctgcctatgggaatcctttaa

SEQ ID NO: 52142 - DNA, 239 bp, Glycine max
  Peptide Sequence Number=SeqID_143827
ggcgtgcccctctgttgggaggacgtgtatcctcaaaggtgaggacaggcagtcctctgatggcgaggcgtgcccctcattgccccagtgaaggctttgagtcaaatgactcctatgtagaaggcgaagatgttgatgttttgatgatgccaaaggaatcaagtgcttccaatgttttattcaaggcaagaatccaagaatccaagaaaatcaagatatatgatcaagttgatctctag

SEQ ID NO: 52143 - DNA, 240 bp, Glycine max
  Peptide Sequence Number=SeqID_143828
atggcaggacctggtgatggtggtggtgattatcatcaattggacggatctcagtgtttattattggacgcgatgactacacaaatgcaacaattactgaaccgtaacaatgaagaactctacagacgaatagaaggactagagcaccaaatgaacccaaatgctgggagaccttatggtaggaacaaaagggtcaataatggaccaaaccgaatagaagggcaggacagaattgaggga

SEQ ID NO: 52144 - DNA, 192 bp, Glycine max
  Peptide Sequence Number=SeqID_143829
atgtacctaatatcatgcttgacgtgcaaagaagggttgtcttttaattcagatattgttggaactagttcactcttggttaatgataatctatatttacttgatactatagcctcctatggtgaatcctttaatacagaattgcgtggtactaagcgtagaattgataatacaaactcaggagcattatga

SEQ ID NO: 52145 - DNA, 672 bp, Glycine max
  Peptide Sequence Number=SeqID_143830
ggcgatcggtgcgggcctcttcgctattacgccagctggcgaaagggggatgtgctgcaaggcgattaagttgggtaacgccagggttttcccagtcacgacgttaactagtggatcccccgggctgcaggaattcgatttttgccagttgacgggaaatcagcatgccatcgcggtcagttcagccaccgccggaatgcatatcacgctaatggcgttgaaaattggcaagggcgatgaagtgattaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 52146 - DNA, 357 bp, Glycine max
  Peptide Sequence Number=SeqID_143831
atgaaaggggaaaataggctcaaaggggctatcaaaggaattaattcaaggaagcatcaacaagaatcaagccaaggctattgtgcaaccaatcaatggggcaaaacacaccaaaagattatgatgatggatgctcgaattctcacaaagaatcagacaaatgtaataaaagtaaagaatgagataggaaagaaaaactccctaagtcatggtagaggaagagtagggtggagtaaggaagtctcttccaccactacgtccactaaagaagggtttatgaggaatggcttaagtcggtgtccattgaccttgaagctcttgtttgtggagtcacttttgatctcaactatactatag

SEQ ID NO: 52147 - DNA, 240 bp, Glycine max
  Peptide Sequence Number=SeqID_143832
atgaagtctggtggcaggcgggggtaccttatggttatccacacctttcgtcaaccaggggcaagcgagcccgctgacgcgcagagactagcatcgtcttctgcaccttttgtcgtccagagacgacgagttttacttttgtcgtccagagatggtgattccgatgacatgcgggggtaccttatggttatccgcaccttttgtcaaccaaggcgaacgagttcgatggtatcaggatga

SEQ ID NO: 52148 - DNA, 381 bp, Glycine max
  Peptide Sequence Number=SeqID_143833
atggcttacactcacattccggattcaacaagcgattctcctcaaatttcagctagcccgtatcaattagaccttgcaccttacgcttcagagccctacaatgctcaatggaacgccccggggcttctccgtgacaaacacacgttgcgttcgagtcgtattctcggagaaatggaggttgatgaaccatggctagggttatggctaccattaaattatcaagtagatatggagcaagtcagcataggacactggaattggggtgaattctacaggctttctcgctgcaaaattcatttcttgacaaactttgtggttgatttagggattgcctttgtgcataactgggtggtgggtaaggagaaggaatggcagtcatag

SEQ ID NO: 52149 - DNA, 171 bp, Glycine max
  Peptide Sequence Number=SeqID_143834
atgctccaaccatatgggatcagcatagacttaaaggagcactcaaacctgatgacccccaaggcctacactccgaagagtccgtcagggcctctccctcctgattcagcttataactcaatacacacatctcaatacacatatctcaatacacatgtatctcaaatctaa

SEQ ID NO: 52150 - DNA, 471 bp, Glycine max
  Peptide Sequence Number=SeqID_143835
atgagaaccactaaggaggtggaggttgaaactacgaaagaagacgaagaggtacaggccctcaagacagaactcgagaaagctcaaacagtcaaagaaaagttcaagtcagcagctattcggatccgaaaggagaatgccgaactgagagacgtcaatatagccaccaccaaggccttagaacgagagaccaaaagggcccatagggaagaacatggccagaacaaattccgaggggctctgtggggcagtaacagcgagcttaagctccggagagaggaaagggaccaatcgcgagtagacagtttgatcttgaaggatgagttgagggtttggcagaggtccaagaggagcttgtctcaacggttatgcgagaccgaaaccaacatgttagccatcatcagcaagtaccaagaaaagttaaatctagccacggcccacgagcataaagtagcggacgaatatgcctga

SEQ ID NO: 52151 - DNA, 219 bp, Glycine max
  Peptide Sequence Number=SeqID_143836
aaggctgttgcttctggaggaagcaaccttgctcgcctgggcgagctgggtggcaaccatctcccctattttgctataaataggggaggaagcaagaaggaaaaggctgaggcgcttccgaaacatttccgtaacgttttccgtgaggaatttcacgaaggttttgaccgttcttcgacgttcttcattcgttcttcatcgttcttcgatcttcaacgg

SEQ ID NO: 52152 - DNA, 234 bp, Glycine max
  Peptide Sequence Number=SeqID_143837
agcatccccgattatgcagtgtccgacatcgtggatcctgcagcttcacttctgcacttgacttttatcttgcattgtacagcaactccagtattctcgggctggatgtcaggacatcgtgtccgacatcgtggatcctgcagcttcacttctgcacttgacttttatcttgcattgtacagcaactccagtattctcgggcaggatgtcaggacattgaatccgacatcgtga

SEQ ID NO: 52153 - DNA, 234 bp, Glycine max
  Peptide Sequence Number=SeqID_143838
atgcgtaatgacgcgggtcatgtcctttcccccatccttgaaggggagcctcctcgacagtcggacgaggttcacgaggatcgtagagagcatgcccacggagacatcgattcctactccccggtcctcgtcaaggggccgacacccaacacaccacctcagcccaacctcacgggagaacctcaaaacctcctagcacaaccaatattcttgtccgcagaaggaccaccgccg

SEQ ID NO: 52154 - DNA, 213 bp, Glycine max
  Peptide Sequence Number=SeqID_143839
atggctactccacctgccttgccacctcctcctcctgcagtagcatcaacgtctccgtccaccttgaagcagacacgcaaagcaacacagctacgatccttggccactagaccacctggggtagaattgatcctgcgaccggcaaggccgacggtcgacgtgacatacgagacctggaaagaagtctctgctgctcagaaggatttaatatga

SEQ ID NO: 52155 - DNA, 513 bp, Glycine max
  Peptide Sequence Number=SeqID_143840
atggatatggatgacgttgctattagtacattctaccggcgaccacaatgcaacctcccctgcagatgtatcggttggtctgtgcgtcatgacatagggattgcgcccataagacgcccaatggacccgaaaaagtccaacagggccctggggtttccagctctggttgcaggcctctgtcagtcctacagggtgcccgttccccccagcgaggaatcgcacccacaaagacacccagtggacccagagaagtccaacagggccctggggtttccagctctgggatcgcgcttgcaagacacccagtggacccgaagaagtccaacagggtcttggagttatcaagctctaattacgagtctctgtcagttctacggagtgcctgtcgcccccagcaagggcatcaggccccctactaatcgagctttcatcaagaagtactgcgtccccaggcaggcacagggctccacaaaaaggttagagcgttgcttacaacccatggccgaccaatag

SEQ ID NO: 52156 - DNA, 228 bp, Glycine max
  Peptide Sequence Number=SeqID_143841
atgaaggaaatctctccagataaaagttgtgaggtatctttgagaaagaagtgcaagatagcggatgctcaaaaagtcattaatgactggagatgcatcaagttattttacacactatctccaaagaaaagcgggcattcaacatttaaaaatgaattcaaattaaacaaagaagtagaatctcttggagtgggtaaaataggtacaaattctttcaaaactccatga

SEQ ID NO: 52157 - DNA, 295 bp, Glycine max
  Peptide Sequence Number=SeqID_143842
tctcgagacgtgtcagaaatcaaaaggaagcaggctagcgcaatccgtgaaattccgtgatgtggcggaaatcgaaaagagatccttcctcctgaaggctgttgcttctggaggaagcaaccttgctcgcctgggcgagctgggtggcaagctcctcccctattttgctataaatagggggaggagtgaagaagaaaagggtccagccttcttggcatttcgtatcctcttaaatttgctgaggaaaaatgttcccgtgaagaaaatccaagccgaggcgcttcctcttcaacgg

SEQ ID NO: 52158 - DNA, 551 bp, Glycine max
  Peptide Sequence Number=SeqID_143843
tttgcatatttcagggtgatcaaattcatgctatttgtaaatcggaccacctcaagtcttggaaagctgatttgaaagagaattgcacttatgttatgcataatttcaaaggtgttaagaatgatggtcaatttagagtgtgcgaacatgagtacaagttattttttattggagtgatggttgttagagaagatgatttgcatgaactaccttttaaggaatttagatttgttgaatttccaaatgttgttgctggcaattttgtgtctggcctgctggttgatattattggggtcgttgatcaagtggtctttcggcatgtttcatcgaaaaataccagggttgtttttagaatgaaggatttgagtggtgaaattttgtcttgcacactttgggagcattactgtgctcagttcctatcctatttgaatgaacgtggggatgatgggccgatggttgttatattgacgcatgccagaataaaagatgcacagggaagttatcccaacttcagtgagcaattccttcaaggcgtcaaaactattgattaa

SEQ ID NO: 52159 - DNA, 465 bp, Glycine max
  Peptide Sequence Number=SeqID_143844
atggagttaattgagaatatggttgctagtgaccacacaatcttgcgtgacagaacacatatcgccaccaaaaggattttattggagctgtcatcacaagatgctttgttggctcagaataagttgctgtccaagcagcttgaagctttaactgaaacattaagttgtgctatttgtggtggtgctcataagtcaggctactgcatttccactgaggatcatgcacatgaagttaactacatgggaaaccagcctagacaaaattttaattatggacattggagagctcatcctggtaatcaattcaacaaagaccagggagggccatccaataggctgcaacaacaagggcctaacctctatgagagaacaacaaagctggaagaaactcttgctcaattcatacaggtttcattgtcaaatcataagagcactgagtcagccattaaaaatttagagatccag

SEQ ID NO: 52160 - DNA, 246 bp, Glycine max
  Peptide Sequence Number=SeqID_143845
atggcttcgaaaaagctttccacgaagaggtttagaagagacgccgcaacggaagggtccagtgccacccccgagtttgatagtcaccatttccggagcgccgagcaccagcaatgcttcgaggccatcaaaggatggtcgttccacagagagaggcgcgtccagctcaggaaggatgagtatacggactttcaggaggagatagctcacagacatttggacgtcgctggtgactcccatggctaa

SEQ ID NO: 52161 - DNA, 659 bp, Glycine max
  Peptide Sequence Number=SeqID_143846
gggcatcatcagaggaaggcctcacaccttttattacacgaggtttcaatagcatcaacgcgggggtgcttcagagggtccgcaaggcatgggaaatggtgcaaaggaaggacaaggaacttaggggaagtagcaacgggcctatcggtggttaccatagatggttgaaagcctatgcacaaggtttggattggctcccgagtttgaggaccactaaggagatggagggtgaagctctggaaaaagatgaagaggggattcgaaaagagaacgccgaactgagagacgtcaacatagccaccaccaaggccttagagcaagaggccaagagggcccgcaaggaagaacatggccggaacaagtttcgaggggctctgtggggcagtaacagcgaacttaagctccaaagagaggaaagggaccaatcacgattagatggcgtaattctgaaggacgaattgaagacttgcctaaggtcaaagaggagtttgtctcagcggttaggcgagatcgaaacaaacatgttggccatcatcaacaagtacaaagaagaattaagtttggccatcgcccacgagcacaaagtggcagacgaatacactcgagtgtacgcggagaaggaggctagaggaaaagtaattgactcattacatcaataa

SEQ ID NO: 52162 - DNA, 132 bp, Glycine max
  Peptide Sequence Number=SeqID_143847
atgggcccgaaatctaccttaaggcttatgagaatcctggggccttctcttgcatctctggctcaatcttcatggagtcttctattcaattcccttggggggggttttgggatgaacactttaatcgattga

SEQ ID NO: 52163 - DNA, 843 bp, Glycine max
  Peptide Sequence Number=SeqID_143848
gagctctatgccaacctctacagtcctgagggaccttcaccaaaacaagtcagaatacgaggccacttgataaggattggtgcagatagcctcaatgcctttttagaaacacctgtggtgcttgctgaggggttcattctaaatgctgaaggtcacttggggaagatcctcagaaaagatctaaccacccttgctcaggtttggagtgttctatcctactccaacctggctccgacctcccacacatcggatctgactgtggatcgagctaggttaatctttggcctagttactcagctggacatgaatgtcggagccctcatttctgggcagattacttctatggcccagtctaactcctcaagactcgggtttcctgctcttataatagctttatgcaggaccagaggagttgcctccgacagtcttgtctttgaacgtttgagcccggctccttctacatcagtagctcctcatctaggttctacatcagcagctcctccttcagctcgtattgcaacagctccttctatcctacctcctgcaaattttcaatgttttgaagccatgcttcaaagcatacatcaagggcagattattttactgcaaagcctacaactggtagcacctccagactccatcccgatgacagagcaatttaatgaatgggtagcttggccagggactcagcctcctcttcatagggaagacgaaaatcccgccgctcaggaagctgtagccactcttgaaaagtctcctgaggccactccagagcctccggcaccactggcagataccacttctccacaacaggcagcagacccttccacgcctaaggattaa

SEQ ID NO: 52164 - DNA, 228 bp, Glycine max
  Peptide Sequence Number=SeqID_143849
atggtgggttacacaccttcaagttttacagatttggtcttcgccagcgaaaggatcgaagtgggtctgaaaagaggaaaatttaatcatcctattttgatgaataagaaaagtggggcaaatgaagagggtgaggatgagggagaaacccatcttgtgactaccattcctatacggccaagtttcccatcaacccaacaatgtcattacttaggtgggatcctctag

SEQ ID NO: 52165 - DNA, 458 bp, Glycine max
  Peptide Sequence Number=SeqID_143850
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttagcacttcatctgaagggctttgttgtgcactctgttatcttcttctttctatcatcatgggtgatggagatcaaacacctggcgttcatagctatcggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 52166 - DNA, 462 bp, Glycine max
  Peptide Sequence Number=SeqID_143851
atggcaagaacatcaaaagtggtcaagatctcagcacaagagttagaccgagtgaagcaatataagaatggggtggtagggataccaaggaagcgcttggaggagaaggcagaagctttggtagatcaaggaaagtggacctcgttcattgacatattagctttgttggtgtttgggactatactatttccaaatgtaaacgggctagtggacttagatgccatcaatgcctttcttgcttatcatcaccgcaaggaaagcctgatcatcgttgttttggtcgatgcatatgatacgttcaacctgagatgcaagaagagaaatgtaagaattgtctattgcacacctgctctttatgtgtggttaattaggcaagctttggaaagtgttgtttttcaccttctcgctaagccaatctgctggcttagcgagcgtctgctaagcgcaacactcttgggctaa

SEQ ID NO: 52167 - DNA, 340 bp, Glycine max
  Peptide Sequence Number=SeqID_143852
gattcaacaagcgattctcctcaaatttcagccagcctgcatcaattagactttgcaccttacgcttcgaggtcatacaatgctcaattgaatgtcccagaactcctccatgatatgcacatgttgcgttcgagccgtatccttggaaaaatggaggcaggccttgtggctgatttggggatggcttttgtggatgattgggttagagggactattcgtgccccctcttgcatatgctctgtagttgcatcctatccggagccatatcagaattgtaccgatactgactaccaaatgcaacccttaggtccttccaagaatggactcgggaaggttccaa

SEQ ID NO: 52168 - DNA, 219 bp, Glycine max
  Peptide Sequence Number=SeqID_143853
atgaagatgaaagctaacaaaacaagaaatgaattgaaagtctcggattcgaaaacttaccgattgaagaacgaagaacggatgaagaacggtgaagaacgacggaaaaccttcacaaatttgctcacggaaacgtctcggaagcgttacggaagcacctcggcttggattttcttcacggaaacaatttttttcatccaaaacagcttaaatgcatag

SEQ ID NO: 52169 - DNA, 475 bp, Glycine max
  Peptide Sequence Number=SeqID_143854
atgagtttgtgtgggagccgtacacaaaaatgtaatatcactgttgcctcccgtttgtgtagtcaaagtctcgcgtggcgaaagacaaagatgtttgttgacccagcaaatgcaaagacggctacattgggtgaagttgcggaggcattacaatacatggtgtctcctcaagggaggaatacatgcacatttgatgatctcgtgccttatgtggaaaaaattacaattttatccgaagagcaagagagagtcactgagccagtgtcacatggtcccgcatcagagcgtcaatttcctgcacaacagtttcacatgcttcagtcaagtattgaaactcaggggatagacagaagaagggacattgttgaagcggaagaatattcccaacaaatggcggagcgtggccatggaatgtattacacgccacaaacatttgctgagtatccgacccagatgtatcaatatccttttcagg

SEQ ID NO: 52170 - DNA, 133 bp, Glycine max
  Peptide Sequence Number=SeqID_143855
atttatgatgatcgcgctaagcggaccatgtcgcgctaagcacgttcatcttggttgttgcacccaaaacgatgcagacgctaagcgcacctgtgcgctaagcgtcaatggtatactgaaatacccagtgtag

SEQ ID NO: 52171 - DNA, 504 bp, Glycine max
  Peptide Sequence Number=SeqID_143856
atggctgtggtcctggaagcagggaaaaaattttctaagatactctcaaaaattaagtcatcccagctcggatggcggagcaagctgccacggcaatgtagaaatttttttctcccaaatgatattattgtgcggtattcactgagccataaacttggaagcaaacagtccagttttaagaacataacatctcatgcagggtatttttggatgccaagctttctgaaatcaggtgcaaccattcccttagagtcctctcacgaggtggaggttgtgccatgttctcagaatggcaaaatcagaatgctcagaatcagaatgctccaaaattataattgctcaagacaggatgttcaacaatcaccaataacagaatgcacagattcaccagttaatggaatgtcagcaatgatcaaaaggatcaaagggtttttcaagcagatggattctctactactactctgttttcagcacaatcttcacagcaaaacagcccaagactga

SEQ ID NO: 52172 - DNA, 417 bp, Glycine max
  Peptide Sequence Number=SeqID_143857
ggttactgttgtgagggagtgtgttctaggggacatcccttttagaaaatacagatttgttggatttgcagatgttgtggttggccagtttgaacatggactattggttgatgttattggtcttgtggaggaggttgtctttcggcaagtttcaggaaaagccagcaattgctatcttgcactttgctgggatgattattgcttgcagtttgtgaacttcttagatgattatgaaggtgatggtccaattacagttctattaagccattgtaggatcaaggaagcgcagggatcttatcccgcatcgatcaacaattctctcaaggcttcaaagttaattattaaccagcccgtgatggatattcaagaattcaatgaacgatattttttgcttgcagagttgggcattgaggcccg

SEQ ID NO: 52173 - DNA, 505 bp, Glycine max
  Peptide Sequence Number=SeqID_143858
ggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatactcacaaaaattgcagatattgcaatttttgtgagtaaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 52174 - DNA, 448 bp, Glycine max
  Peptide Sequence Number=SeqID_143859
gagtggtggatattgctgttctgagcatcaaattgccaaggaaatcactgccaagcaagtccagcattggccaaagaaagggaagctttctgcagggaagctaagtgtgaagtatgcaatcctgcataggattggcactgccaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctcctctatccctgcattacaaactgtttgaggggacacatgtcccagacattgtctcgacatcagggaaagctgctgcttcagcagctgaggaagaagaagatgcagcagaggatacagaatcagatgatgatgattctgatgccaccccatga

SEQ ID NO: 52175 - DNA, 516 bp, Glycine max
  Peptide Sequence Number=SeqID_143860
atggccccgaggaagctcgcctcaaagagattaggaaggataaagcggctgaaggaaccagttctgctcccgagtatgacagtcaccgctttaggagcgctgaacaccagcagcgcttcgaggccatcaagggatggtcatttcttcgggagcgacgtccagctcagggacgacgagtatactgatttccaggaggagataggtcgccggcagtgggcatcactagttacccctatggccaagtttgatccagacatagtcctcgaattttatgccaatgcttggcctacggaggagggcgtgcgagatatgaggtcctgggtgaggggtcagtggatctcgtttgatgcagatgctatcggccagctcctgggatatccgttagtgctggaggagggccagaagtgcgagtatggccagaggaggaaccggtctgatgggtttgatgaggaggccatcgcccagttgctatgtataccagggcaagattttgctcggactgctgccgggagacgg

SEQ ID NO: 52176 - DNA, 50 bp, Glycine max
  Peptide Sequence Number=SeqID_143861
gcgacacccaacaacaaaacttcctttaccgtaaaggtgggatcctctag

SEQ ID NO: 52177 - DNA, 293 bp, Glycine max
  Peptide Sequence Number=SeqID_143862
gtgctggtgcagtaacttcatttggttactgtaaggatcgtgatggacaatggttgaagaaggacgagctacctccacaagacaagcgtactccctctcctcctcctcagcgggatgattcctcagcccttatgaatgaagttatttcggaattaaggggcctccgcacctatgttggcgaacgctttgattccttggatggtcactttgaaggcatggatacccgcatcacccagcttgaagaggatgtgacttatcttcggcgatgcttcgaccttccaccaccgtcttag

SEQ ID NO: 52178 - DNA, 150 bp, Glycine max
  Peptide Sequence Number=SeqID_143863
atgactgaagacattgtcgtcttcgaaatgaatgtaatgactgaagacatttttgtcttcgaaatgtgcgtagattaccgtataaggcgtctccgcatgctacctgacttctcacaggtcggggtagtagaactgtgtgtgtacggataa

SEQ ID NO: 52179 - DNA, 327 bp, Glycine max
  Peptide Sequence Number=SeqID_143864
atggggatcgcacccacagagacacccagtggacctgaagaagtcaacagggccctgggggcgcccgttccccccagcaagttcatgtcgtcgtggcatagggattgtgcccgcaagacacctagtggacccgaagaaggccaacagggtcttggagttgccagctctaaatacgggtctctgtcagttctagggagtgtctgtcgcccccagcaaggtcatcaggcccccctaccaatcgagctttcatcaagaagtactgcgcccccaggcaggcgcagggcgaaacaccacatcagcattgggatggctggtagcgggcaatag

SEQ ID NO: 52180 - DNA, 394 bp, Glycine max
  Peptide Sequence Number=SeqID_143865
atgattatgaggggccaagacatttatagtagccaagatgagactactacttcaccttcctctagtaaaagtgaagaagcaaaaggggaagaatctagtgaagaaatctacccccaagaagaaagacaacctttaatggttaagaaggagtgtaaagaggtaagtgtctcctccaagaggttagctaagaaggaaaatcatttttcaataaaggcaaacattaaagaaacttcccctcttagaaaacctccacatcttctcgtttgtaaaaagacacttgttagcactgccacacctcttgggcttgagattattcttcaagtaaagaagttgttggataaggatttggttcgtaagagcttaaatccttgtgctttgttggtgtccaaaatag

SEQ ID NO: 52181 - DNA, 282 bp, Glycine max
  Peptide Sequence Number=SeqID_143866
aatgtttatacggataaccactcgggtatttccgcccgtcagcgtgactcaaatgtcagtatgacagatcttgtgagcgcagaagatgaccaaaagaatgtttatacagataaccactcgggtatttccgcccgtcagtgtgactcaaatgtcagtatgacagatcttgtgagcgcggaagatgaccaaaagaatgtttatacggataaccactcgggtatttccgcccgtcagcgtgactcaaatgtcagtatgacagatcttgtgagcgcggaagatgac

SEQ ID NO: 52182 - DNA, 180 bp, Glycine max
  Peptide Sequence Number=SeqID_143867
atgtggaccaccacgggtacatataatgaatcgaaaagcttggttcaaggggaggtggttgccgcccagctcgcccaggcgagccaggttgcttcctccaaaagcaacagccttctggaggaatcttctggagggggcccaagtgggcctgggtgctatttgcacccccatttttactaa

SEQ ID NO: 52183 - DNA, 2100 bp, Glycine max
  Peptide Sequence Number=SeqID_143868
atgccgaggcggatcagccacggatgggttgcagcacagccagataaagcgttcgcccggcattatcagaacgttttttaccggaatagcgcgaacagcgcggatgaagcgaaaggaggccgcgtgaaaaccgtcggactgaataatttccaggtgcgtaagcacaacaaagcgctgtttatgcagctgatgtggcgtcataaacgtctgagcaaatcgcagctggcgcagctcagcggcctgaccattccggcggccagcaagattttgcaggagctgctggagcagggccacgtgcagcactccagcgccacgctgagcacgcgcggcaacagtaacggcagttttcagctgccagcgcaaggcgcgtggacgctgtgcctgtgcgtcaagccgaccagcattgaactgcagctggcggatgcgcagctggtgtcgcagggcgactatcagcaaatcagcattaacgcgcagacgccagagcagctgctggcggagattgaaacggtgtggcgcgctacctgtaaacgctggccgaagcgacagattaatctggcgctggcggtgcacgggcaggtcgatccggtaaccggcgtctcgcagcatatgccgcaggcggcgtggcgcagcccgctgcagctgaagtttctgcttgaggagaagctggcagttgacgtccgtgtcgataacgactgcgtgatgctggcgctggcggaaaagtggctgaaccgcaatgcgctggccgaattctgcgtcatcaatgtcgattacggcatcggctcatcatttgtcatcaacggtgagatctttcgcggcaacctgtacggcagcgggcagattggccacaccattattgatccgcacggggagcgctgtaactgcggacggcagggctgtctggagacggtcgcctcgctcagcacgcttaagcggctggcgcatcagcgcgcgccgcaggcggtgcagcccaccagccgtcagctgctggccgcctggcaggccggcgagccgtggatcgtcgagtgggcgcagcgcagcgcggaagccatcggcatgagtctgtacaatttccttaatacgctgaatatcaatcaaatctggctgtacggtcgcagctgtacttttggtgagagctggctgcagaccatcgtgcaccagattgatttcaaccccttcgatccgcgcgatgcgctgaaaagcaaagccaccaacgtgcattttggtcagctggatcgcgcccgacaggtcctcggcatcggttatctctatgtcgaggccgatcccggtacggcgtaccgcactttgaccctggtgcggagagtggccgtgaacaatcatcaacatctgaatatgcgttacgtgtggagcatctgtctggtggcagcctgcggcggtttgctgtttggctatgacaatgggtgcggacaagctggggcggcggctgccgttgatcgtcgccgcatttctgctgtgttgtgggtcggcgatcggcaccgcgctggccagcatttacgctacgacgcggagatcatgcccggcagacagatcgcgcaaacgcgttgtcccgcgttccagccaatcgctgctggcaccgcgcacgctgccgattgtcatcaccggcatcgtgctggcgattttccagcagtggtgcggtatcaacgtgattttcaactatgcgcaggagatttttgcttcggccggtttcgatatcaacggtacgctgaagtcgatcgtggccaccggcctgatcaatttgctggcaacagtgctggcactgccgctggtggaccggctcggtcgccgcaaactgatgctgatcggcgccggaggactgacgctgtgttatgcactgattgccggtgcctacacgctgggcatcaccggctggccggtgctgattctggtactggcggcgattgcggtttatgcgctgacgctggcaccggtcacctgggtgctgctggcggaaattttccccaaccggattcgcggtctggcgatgtcggtcgccacgctggcactgtggattgcctgttttgtgctgacttatacctttcccatcctcaatgccggacttggtgcagcgggcagctttatgct

SEQ ID NO: 52184 - DNA, 906 bp, Glycine max
  Peptide Sequence Number=SeqID_143869
atgagagagttaccgcctaccgccatgctgcgcgcgtttgaagtggcgacgcgccatccgacctttaccgccgccgctgaagagctgtttatcacccaaagcgccgtcagccatcagctcaaaaacctggaagagatctggggcgtgcagctctttcagcgcggcaaaacgctgagtctgacgccggccggcgcggcgctggcaccgattgtgcgcgagtttttcagtaatctggaaaccaccttagccgacttacgcgaacagaaaggccgcgtgcggctgcgcgtgaataccacttactcatttgcgctgaagtggctgttgccgcgcctgccgggcctgacgcgcctgcacccggaaattctggtaacgctggaaagcaccgatgatgccatcaccttctcgcgccaggattctgatgtggcgatacgctttggccatggcaattatccggcgctgcacagcgaatttatgtttcgtgaacagctgtttccggtcgccagcccggcgctgctgcagcgcttcggcacgccacaggaaccggcagaactgctgcgctacccgctgctgatgcgtgatggcgccgatctggtgccaaaatgggagatctggtttaaacaggtcggcctgacgctggatgccttacaggagagcgtacgttttgccgataccaatatgacgctggaagccgcgctgctggggcaaggcgtggcgctggcgcgcagcggtcacgttgaaaaagagctgcgcgacggcagcctggtgcggctgttcagcgtcgcgttttcctcgcccgccgcctactatttcgtctgtccgcagggcatcgaaagccagccgcatattgttgattttcgtcgctggctgctcgctgaatcacgtcaggcgcagcaggattatcagtga

SEQ ID NO: 52185 - DNA, 2523 bp, Glycine max
  Peptide Sequence Number=SeqID_143870
atgaccggcattccgattgcgctgattatcggcacgccggtttccagcctgttgttagagctgcacggatggctggggctgcgcggctggcagctgatgtttctgctggaggccattccggcgattgcgctgggattgatcgtcccctttgcgttgcccgatcggccggaagatgcccgcttcctcagcgcagatgagcagcactggctggtgacaacactggctgctgagcggcaaaaactgccgtcgcgcggccacggcggtctgctgaaagcgctgttcagcccgctggtgttattgttcagcctcacctattacggactggcgaacctcaacggcgcggtgagcaccttcctgccgctgatcatcagcgaaaccggcttaagtcatgttcagaccggattcatcaccatcatcccttacgtatttggtctggccggcatgctggtgctgggacgcatagccgatcgtcccgggtcgcgtctgctggccaattatctggcgctgatcttctcctttgtcgggctgttatgcgttgcgtggttcgataactcgctggtgaaaatgatgtttttgtgctgctcggcatttggctttttcggcgcgatgccggtgttctggggattgcccgcgcagtttatcccggcgtccgtagtggcgggtggcctcgccctgatcaatgcgctgggcagtattgccagtgtggtgaatccgtgggtcatcggcgtgatacgcgaccgcagcggcagttataacggcggattttactggctggcggcgatggcgatgctctcgatcattaccctgagcatcatcttccgtcgtcagcgtttaccggcttaccaggccagcaatgaacaacgcgtgatgccgggagagggcgatttctgggaggagcgtctcgcgcgtcccaccgatatctatgcgcagtttcgtaccgtgaataatcatgacggtggcgttcagctggaagacggttttgccattaccaccgtgtttcttgagatcgtttctgatgagggcgtggacgggctggcagggccggtgccgcatgccgttgcatcaatcattcatggccagctgcgaccgttgttgctgggtcaggatccgcgcgacaccgagcgtttgtgggatcagatgtaccgggcgcagattcatgggcgtcagggcgatggcatgctggcgatcagcgcggtggattgtgccttgtgggatttgcgtgccaaatggatgcagcaaccggatatggcgcgggtgcacgagcgggcgctggagtataaggcgctgggatatcgcggacaaaaatggtttttccgccacggcccgatgagcggcagagaagggctgaagaaaaacatcgaactggcaaaaacgctgcgcgaagccgtgggggatgattacgatctgatgtttgattgctggcagtcgatggatgtgacgtatctgcttgaactggcaaagggcatcgagccgtatcgcccgcgctggctggaagagtgcgtaatggctgacagaatcggcagtatgcaacgactcaaagataaactgtcgatcccgatggcgggaggcgaacatgagtacacgcgctggggcttcaaacgcttctttgaatccggggcgctggatgtgattcagcctgatatttactggtgcggtgggctttcagaaacgctaaaaattgccgctatcgccaccctgtacgatttgcaggtaatcccgcacggtcattccagcatcgcaacggcccatttcagcaccacgcaatcgccgatccacacgccttatcaggagtatctggtgaaatggaacgatattcatcagtacttcctgcgcgatccgctggtgccgcaaaacgggttaatcccggtaccgcagggacccggcatgggcatggcacttaatccagcgcatattcagcagcagacatactttgcccatcgtcattctgaccccctaaatgctcgctgtttaaaggacgctcgccacgctatgcccgccgataaactcatcattgactggtcatcgaaaaacatcctccgcccgcagtcattgagcagcattctggccgatcatattcgggacctgatcgtgaattgccagattgcacccggtgcattaatttccgagaacgacattgccacccagcttaatgtgagccggacgccgcgggagatgcgcgaaacctgtgagatgcggcaaattctggaatcaggcgcattaaagctggcgctgcaacacgatcgtcaggcgctgatcgcgcgcctgaacgaacagctggcgcgtggacgcgatgcattacaaaacgcgccggagacctaccgcgaaaccgatgcggcgtttcatatggcactgattgaagccagccagaacagcgagctgggttcgcaaaacgatcatgaagcgatcgtggcgcggttaactaattacgaggatgaacaggcgctggaacttctgcactggcatcttggcggcattatgcgcatgttccagcggtcggtggcggacaccgactcagccagttaa

SEQ ID NO: 52186 - DNA, 506 bp, Glycine max
  Peptide Sequence Number=SeqID_143871
atggcggaatatacattatcggtttatctggaaaagagtgaattcaatcgcggccctcatcttgatggcgcggagggtgcagaggcgatagccgcctttattttgcggcctgagcatgaggaagcactggctagcggattagcgcattttaccggattacccctgattgatctgcgcggagacagcgcggtagtcacctcttatttacagttaatttatctggatgataaaggcgaatcacgcatgctggccaatcacggcagctctcctggctatcgcatacatcgcgttgtagtgaatcgctgggagttaaaacgcattgcgggtcaatggaaaattcatcgcaggacgttgattccggtggacggtagcgccagaccacgatgtgcagcgacgtcatcaatgataatccgctacgagactggcggcgcaggttggtgtccagcatggcaacagtctggctattcctttcagccaaatcctttggtgatgtacttgccagtaac

SEQ ID NO: 52187 - DNA, 1284 bp, Glycine max
  Peptide Sequence Number=SeqID_143872
atgatgtcatctgcagtggctcccgccgttaatcaaaagcgcgtactgattgccggatccgtcggcaattttatcgagtggtatgaattcgccgtgtacggtttcatggccacgctgatcgctaaacatttcttccagctggaaggagaaagcgccctcaccagcctgatcctcacctatgcggcctttgcggtggcgttcttttttcgcccgttaggggcggtgctgtttggccgcctgggcgatcgctatggccgtaaaccggtgctgatcgcggtgctggtattgatgacgctggccaccgtcgccatcggtctggtcccggtttatgccagcattggcgtggctgcgccgctgctgattacactgctacgcattttgcagggactgtttgccggcggagaatacggcggcgcggtctcgctgatgaccgaatcggcgccgcccggcaagcgcggattttatggcgcatggcagtcgctgacggtggcgctcggactgctggcgggcgcgggcgtggtggcagtactgccgctgctgctgggagacgccgccatgaacgcctggggctggcgtattcccttcctgctggcgctgccgctcggcgcagtggcgttgtggctgcgcagcggcctcgatgaatcaccgcagttcagccagacaccggcggcaccacaacagcaggcatcgctgggtgtcacgctgcgcgctatcgtgctgggcattgggcggttaatgatatggtcagccgccggttatacctacctggtaatcatgcctacctatctgcaggccgcgctgcataccggctttaaccaggcgctgctgattgcggtaatctctaacctcggctttgccgccaccatcctgccggccggcatactcagcgatcgctatggccgccgcacattaatgctgctggcaacgtttttgctgctggtgctggctttcccgctgctgaaagtgttgcagcacccggagagcggtatggcgatcaaagcgctggtggtgtttatcgccggtgcgttggtgggcatgctggccggaccgggaccggcgatgctggccgagatgttcccgacccgcgtgcgttacaccgggctggggctggcctattcgctctccaacgcgctgttttccggctgcgcaggtctgatcattaccggcctgatgaagcaaaccggcaacgccgacattcccgcctggtatgtgatggccaccgccgtagtgagttttgtcgcgctgctttcgctcaataaggacgatcaccgcagacccctttga

SEQ ID NO: 52188 - DNA, 1584 bp, Glycine max
  Peptide Sequence Number=SeqID_143873
atggaatccacaacgttggaaaaatcctggggtgctgaaatccttgctgacggcagcgtgcggtttcgcctttgggcacccggtcagcagcaaattacccttcacgccgatggtcagcagcatgccatgcagccgcagcaggatggctggttcagcctgacgctgcgcgggcctggtcacggcagcgaatatcactacgagctggccgatggcagcacggtgcccgatccggccgcgcgggcacaacgcgccgatgtcaacggcccttctctggttatcgaccctcaccattacgactggcaacagcgtgactggcagggacggccgtggcatgaaacggtggtctacgagttgcacatcggcacctttaccgccgaaggcaccttccgcgcggctatcgaaaaactccccgcgctggccgacctcggtatcaccatgatcgaagtgctgccggtatcgcagtttggcggcacgcgcggctggggctatgacggcgttctgctgtatgcgccgcactcggcgtatggctcaccagatgatttcaaagcctttgtcgatgccgcgcacgcattgggactgtcggtggtactggatattgtgctcaaccactttggtccggaaggcaattacctgccactgctggcaccggcctttttccacgaagagcgcatgacgccgtggggtgccgggattgcgtacgatgtggacgccgcgcggcgttatatcgtcgaagcgccgctctactggctgaaagagtttaacctcgacggcctgcgctttgatgccatcgaccagattgaggacacgtccagcaagcatgtgctaatcgagattgccgaacgcattcgcagcgaaatccactctcgtccgatccatctcaccaccgaagacagccgcaacgtgatcttcctgcatccgcgcgatgcggacggtaacgcgccactgttcagcggggaatggaacgacgattttcataatgccattcatgtctttgccaccggcgagacgcacgcgtattaccaggatttcgccgacgtaccggagaaattaatcgcgcgcattctcaccgagggctttgcttatcagggcgagctgtcaccacagagtggccagcggcgcggcgtacccagcgcaggccagccgccggtcgcgtttgtcgatttcatccagaaccacgatcaggtgggcaatcgcgcccagggcgaacgcctgattagtctggccggtgtcgatcgcaccaaagtgctgctcgccaccctgttgctgtcaccgcatattccgctgctgtttatgggcgaagagtacggtgaaaccaacccgttcctgttctttaccgatttccacggcgagctggcgaaagcggtgcgcgaaggacgtgcgcgcgaatttaccggtcacgccggtcatgacgatacggtaccggatcccaacgctgaagagaccttcacgcgttcgaaactggactggggcaaagtggaaaatcccgcaggccaggcgtggctgacgcttacgcgccagctgctggcgttgcgccagcagcacatcgtgccgctgctggcggatgcccgcaggcataacggccag

SEQ ID NO: 52189 - DNA, 249 bp, Glycine max
  Peptide Sequence Number=SeqID_143874
atgaagtcctctccgaattacgagggtcttcgttcttatgttggtgaccgcttcgacttgttagattcacgctttgccgggtattgtattgtcatcatcaaaaagggggagattgtagatgcaattggctttgatgttttgatgatgatcatgcatgatgtgttgcaattgatgcaaatgggcttttcaagattaaaattcaagacaatacttcaagattacaagtcacaacatcaagatgatcactag

SEQ ID NO: 52190 - DNA, 513 bp, Glycine max
  Peptide Sequence Number=SeqID_143875
atggagagaagtatgatagatgctgccaatggtggagcccttggagacatgactcctgttgaagccagaaatttaattgagaagatggcttccaactccctgcagtttagcaccagaaatgatgttatagtcattagaggagtgcatgaggtagctacaaactcagctgcatcatctgaaactaagaagcttgaaggcaaactggatgcattggttaacttgacctttgcccttccatgcagcaacctggagcaattgagcagcctgaagcttatgctgcaaacattttacaatagacctcctcaacctcagcagcaaaatcaaccacagcagaacaattatgacctctccagcaacagatacaaccctggatggaggaatcaccctaatctcagatggtctagccctcaacaacaacaacagcagcctgctccttccttccaaaatgttgctagcccaagcagaccatacattcctccaccaatccaacaacagcaacagccccagaaatag

SEQ ID NO: 52191 - DNA, 723 bp, Glycine max
  Peptide Sequence Number=SeqID_143876
gggagcaccgatggaagaaagcatgtctcctttccttgtgagcgatttcggcgcacaaaatttcaaggctatacaaagaatccgtaaggcatgggaaaccccggtgcaccggaagaggaacgaagaagtccaagctctcaaaagcgagttgaggaataggcgaaactgtgccaaggagaagtttcaagaggtttggaccgctaacacacatccggaaggagtgtgccggattacgggaagagaatgcaactaccgcaaaaggcccttgaagacaagaggccaagagggcaacaatgaactcaagctggaaggtttgaagagagtggaccagcgtgagcacatgcacggtcttgaaagacgagttagtcgcctgcaaggtcaaaatggagcttgtcttgcagcgatttattgcgagacgaagaccaacatgctagctatcatcgccaagtacaagaagagtagcacgcccacgagacatagggttgcggaagagtatgcccaattcgccctctgtgtttggttggtttcgcacttgttccaacaagacacaaggcatccatgtccgctcctgagccatcgctcgtgtactgaaaagaggagaatagattgggaccagcttttggctgggataggaggtagaacaatcaattggttcccccgatggaaggaaggaaaggaaaggagtccttttctcatgtggaggatacctaaacattctcgctg

SEQ ID NO: 52192 - DNA, 249 bp, Glycine max
  Peptide Sequence Number=SeqID_143877
atggtggttgtgggtgatggagaaaaagcttgggtcattggaaatgactttggaagaaagaaaggagaagaaatggcatttttcctaaactacatgaaagcaaagcttcgcacagactccaaacattttctcaaagatcccaatggtcagatcgtggaaaagtgtcttgtgaagctgcagaccgaatttcgaaaagatccaactgttaacgaaggctgggaagggtttttaccgaggcagctcatgtag

SEQ ID NO: 52193 - DNA, 256 bp, Glycine max
  Peptide Sequence Number=SeqID_143878
gctgcgcaactgttgggaagggcgatcggtgcgggcctcttcgctattacgccagctggcgaaagggggatgtgctgcaaggcgattaagttgggtaacgccagggttttcccagtcacgacgttgaattcgatccccaccgcctccactggcatcatcgccaggggacaaggattcgatcgtacacgtatttataccagtgtcgaagctgtcccgatcaagcttatcgataccgtcgacctcgagggggggcccg

SEQ ID NO: 52194 - DNA, 333 bp, Glycine max
  Peptide Sequence Number=SeqID_143879
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggatgcgccctgtagcggcgcattatgcgcggcgggtgtg

SEQ ID NO: 52195 - DNA, 370 bp, Glycine max
  Peptide Sequence Number=SeqID_143880
ggcgcgtcccattcgccattcaggctgcgcaactgttgggaagggcgatcggtgcgggcctcttcgctattacgccagctggcgaaagggggatgtgctgcaaggcgattaagttggatcgtgttaaagacatcctagcaaatcctggtgcttcaggctccacttttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 52196 - DNA, 344 bp, Glycine max
  Peptide Sequence Number=SeqID_143881
gatcaacatgcaccactggtctctcaacaccaggtggtctagtggacaacgatcgtagacgcgaggcttttcgtgtctgcttcacggcagacgtcgaagctgatgcgtccgaagtaggaggaggaggaggagaagaaggaggaggaggaggaggaggaggaggaggagtaggagtggaggcaggtggagaacctgtcgcaacctacccttcggcgggagggcgacgcgagactcgcgggatgcgtgttccacgaacggaatacgcgcgaagtcgccaccaacgtttatttgaggaaaacgtcggaaaaaccggaagagacgcgatctacgaacttttaagttga

SEQ ID NO: 52197 - DNA, 519 bp, Glycine max
  Peptide Sequence Number=SeqID_143882
atgtcagttctggaattgtacatagaaaaagatgtgagcaatttacatggtgatgaagatgatgatgatgatgatgattatcttgtgtctaactcatacgttgaagagtctttagacgaagatgatagtattgacggtatatctgatacagacgatgaagtcaccgacatgattcaaccaataagaattgttcacccagtagaaggtgtacaaggaattcaaaatccattttggaatgatgctttgcattataagaatatcaactggagtcatcctgatgaggaggacatttgtggtttggagatgccatcgagttttaatgttggccaagaattatatgttggcatggattttgatagtaaagatgcggtcaaaaatgtagtcaaacaatatgttatgaaggtgcatcaaagtttcaaagttgttgaaagcaaatcgaacaagtatgtcgtttgttgcttgaataaaagcgcagagtgtccttgccctttctatatgaggacaatttcatctaaataa

SEQ ID NO: 52198 - DNA, 1192 bp, Glycine max
  Peptide Sequence Number=SeqID_143883
cctcgtccatgttgatgtcgatgatctgcgcgccgttctcgacctgctggcgggccaccgccagcgcctcgtcgtatttttcttcgcggatcaggcgcgcgaacatcttgctgccggtgacgttggtgcgttcgcccacgttcacgaacagcgtgtcctcgtcgatgttgagcggctccaggcccgacaggcgggtcttgaccggaatctccggcaccacccgcggcgtcagcgccgtgaccttttcggcgatggcgcggatgtggtccggcgtggtgccgcagcagccgcccgacatgttcaccagcccggcgcgggcgaattcctccagcagcgccgaggtgtcggccggcgtctcgtcaaagccggtctcggccatcgggttgggcaggccggcgttggggtagacacagacgtaggtgtcgcagatcttggacagctcggccacgtacgggcgcatcagcgccgcgcccagcgcgcagttcaggccgatggtgaccgggcgcgcatggcgcaccgagttccagaaggcttcgacggtctggcccgacaggatgcggccggaggcgtcggtgacggtgcccgagatcatcaccggcaggcggatgccgcgctgctcgaacacctcctcggtggcgaagatcgccgccttggcgttgagcgtgtcgaagatggccacgcgcagctcgtcgaaggtgacgttgcgcgcgcccgggtcgttcacgtcgggcgagatagacgccgtcttgggctgcgggccgagcgcgccggccacgaagcgcggtttgtccggcgtgctgtactggtcacaggcctcgcgcgccagttgcgcggacaccaggttcagttcgtaggccagttccggcaggtcgtagtcgccctgcgcgatcgaggtggcgccgaaggtgttggtctcgatgacgtcggcgccggcctccaggtactggcggtggatctccgagatcacgtccggccgcaccagcgacagcagctcgttgtcgcccttgaggtccttgccatggccggcgaagcgctcgccgcggaaatcggcctcgcccagcttgtagcgctggatcatcgtgcccatggcgccgtccaggatcaggatgcgctgacccagctggcgggcgaattcgccgccgcgggtgaagctctcgggcgggtaaggcaggcggggatacgacacgttcag

SEQ ID NO: 52199 - DNA, 531 bp, Glycine max
  Peptide Sequence Number=SeqID_143884
tcattctagaccctaagtacattgaccttgaattttttgatgaagaaacatttgattgttaccaagtgtttcaaaattctgctttgattgatttcatgactctgaaacatccctactttcctgaattagttaaggttttctataataatttgaaaattcaagatggtattctttactttgaggtgcataatattcccattgttattgatcagcccttgttctattctttgactaaactgcccagtcaaggtgttccttttgagggcacccttgttgatgactggaaatttgattattctagtcatgatgctcgcagaatggcattacgggccaatgcacctctgccttatccccaccttgttactctttttcttcatcatttcaatgttcctttggatgatgaaccatatgtcaaggttaaaaggttgttttccattgttgccggtgcgattacctcctttggttatcgaaaggatgttgatggtcagtgggttcgcaaacaggacttgccaccgcctattctcgacgaac

SEQ ID NO: 52200 - DNA, 309 bp, Glycine max
  Peptide Sequence Number=SeqID_143885
atggccggagattggcccgaggcccagcagagaggcaccccagaagctcccggcgctggagaagaggcccacgaggacgaggagatggccgatttgcttgacttcttgggagggagtggagacacagttcttcgtttaggaacatcgtccgaaaaatatgtatgtaaaacaaacaaaaatcatgataaaagtagaaaagaaaaaaatgaaatggaaaagagaacaaaagagaaaagaagagagcaagtaaagaaaaagaaagcaagtaagaaaaaaggtggaaaaagagaaaataagttgtctagctaa

SEQ ID NO: 52201 - DNA, 427 bp, Glycine max
  Peptide Sequence Number=SeqID_143886
acagcaaaaagtttttacggataaccactcgggtatttccgcccgtcagcgtgactcaaaagtcagtatgacagatcgtgtgagcgcggaagatgaccaaaaagtttatacggataaccactcgagtatttccgcccgtcagcgtgactcaaaagtcagtatgacagatcttgtgagcgcggaagatgacgtaaatctccgcgtgttaacgggcatacagcaaaaagtttatacggaaaaccactcgggtatttctgcccgtcagcgtgactcaaaagtcagtatgacagatcttgtgagcgcggaagatgacggcgctgaagacgacgttagtctctacgtgctatcaggcttttcatcttacagacagcaaaaagtttgtacggataaccactcgggtattttcgcctgtcagcgtgactcaaaa

SEQ ID NO: 52202 - DNA, 120 bp, Glycine max
  Peptide Sequence Number=SeqID_143887
atggggaggaggttgccgcccagctcgcccaggcaagctcagctcgcccagcattacgggtgtccgggaagccccggaatcccatcttttaacaaaacgggggaggtggttgccacctag

SEQ ID NO: 52203 - DNA, 468 bp, Glycine max
  Peptide Sequence Number=SeqID_143888
atggcttccatgatgaaggccatgttaggaatgagacaactaatggagaaaaacatggccaccgctaccgctgttagtttggctgccaaagcagacccaactctcccggctaccgcacaccatcctctcccaaacgcggtaggacgagaaaggagcacactggggcacaccagcaacccccatttgggatacaactgggtggcttacccttatgggttaccacccaattacacgccaccagtcatgcgtgatgacgtgggtcgtgtcccttcccccatccttgaaggggagcctcctcgacagcccgaggggatgtcgaattctaccccccggtccccatcgagggaccagcgcccaacacattgcctcagcacaacctcacagcatagccaatattcttgtccacagaaggatcacccccggccgcagaagaaagaaggaaactcgatctcatcgaggagagattga

SEQ ID NO: 52204 - DNA, 108 bp, Glycine max
  Peptide Sequence Number=SeqID_143889
atggtagctcgcccaggcgagctgatgcttactcctgaagtaacttgctcgcctaagcgagctgcagctcgcccagatgcatgcaacctttatcttgaaatgcagtaa

SEQ ID NO: 52205 - DNA, 405 bp, Glycine max
  Peptide Sequence Number=SeqID_143890
atggggatcgcacccacaaagacacccagtggacctgaagaagtccaacagggccctggggtttccagctctggttacgggcctctatcagtcctacagggtgcccgtaccccccccccccccgcaaaaaaacgtcatcatagggagtgcctgtcgcccccagcaaggtcatcaggccccccctaccaatcgagctttcatcaagaagtactgcgccccagacaggcgcagggcgaaacaccacagcagcattgggatggtcggcagcgggaaacagacgcaccgccatcacctctagagttcacctctgctcatccacaaaaaggtttgagtattgcctacacaacatggccgaccaataggcgaccaagtccaaagccaaaggacgcacctagttgctcataa

SEQ ID NO: 52206 - DNA, 616 bp, Glycine max
  Peptide Sequence Number=SeqID_143891
atgaaatttattggaaagctgctcgtctatcttctggtagccctgctcattgtgctgctggcgctctatattctcctccagacccgctggggcgcgactcaggtcagcagctgggtgacggtgaataccgactacgaactcagtttcgacaaaatgaaccaccgcttttcgtcgccttcccacatcattctggaaaacgtcaccttcggtcgggacggtaaacccgccaccctggttgccaaaaaagtcgatattggcctgagcagccggcagctcaccgatccgctgcatatggacaccatcaccctgttcgacggtacgctgaatctctccccgcaaaccgcgccgctgctcttccaggcggaccgtctgcaactgaacaatatggcgtttaacagccccaataccgaatgggacctgagcgcgcagaaggtgacggggggcgtcagcccgtggcagccggaagcgggcaacgtgctgggtaaaagcgcgcagatccagatgagcgccggctcgctgaccctgaacggcgtgccggccaccaacgtgttgatcgagggccagcttaacggcaaagaggtggtgctcagcaccattggtgccgatatggcacgcg

SEQ ID NO: 52207 - DNA, 261 bp, Glycine max
  Peptide Sequence Number=SeqID_143892
atgcggggttaccatatggttatccgcacctgtcgtcaaccaggggaaaacgagcccgttgacgctcgaagactaacatcgtcttctgcaccttttgtcctcctgacccgtgaagtcggacccatgaagtcagctgacatgcagagttaccttatggttacctgcacctttcgtcaaccaggggcaaacgagcccattgacgcacgaagactaacattgtcatctgcaccttttgtcgtcctgacccttgaagtcaggtga

SEQ ID NO: 52208 - DNA, 459 bp, Glycine max
  Peptide Sequence Number=SeqID_143893
atgcgcctcgctgctgagacgtaccatggcgtagggctcgcggatctccacggtcgtccccgcggtcgggacctcgcccagctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 52209 - DNA, 330 bp, Glycine max
  Peptide Sequence Number=SeqID_143894
atggaaatataccacactgagctggacgagtttaaggctgaattggagaggcgtaacttccataaacgcctcaccaatttagttgacagcagcatagacttggctttagtgaaggagttttatgccaacctttacagctctgaagacctttcaccaaagcaagtcaaggtcagaggccatctggtgaggattgatgtagacaacctcaacacattcttggagatgcctgtgatattagctgagggtgagactttaccagcatattccagatactgcaggttgcccatagattataaagagattgaggctgctttatgtataccaggctga

SEQ ID NO: 52210 - DNA, 1286 bp, Glycine max
  Peptide Sequence Number=SeqID_143895
ctcgcagccctgcgcggggccgaggtatgggcgacgtgtggcgcccggaacgccccgctggtcgagcgcctcggagcggtgcgcaccttcgatcagcgcgtgtcgccgccgagcgacatccccgcggggcgcttagatgccgtcgtcgacatcgccggggggatacccctgcgcgcgatgcagcgcctcaccgcgcaccgcggaaccatcgtcctcgtcaccggggacggcggccatgtgctcggccccgttccgcggatgttgcgcgccgcggtcctgtcgatcggctcgcgccgcatccgaccactggcggagacgccgcggcccgaggtgctcgcgaaactgctggagctcgtggccgaggggcgcgtggtgccggtgatcgagcgcgaatacccgttcgccgaagggtccgccgctctcgcacagaacgaggcgggacacacggtgggcaaggtcgtggtgcgcggctcgggggtgctacagcactggaattccgggaatcaagcggcggcatttgacgccgttcggcccagagctgaggaaggccaggcatgggcagccgcgcttctatcgtggctccacatgcagcagggatatccggggatagacgagagcgttacctgggccattgccgcagcccacggtgggctccccggacaactggttcacgcatacaacagtttattggcgcatctcccctccaatcctgctctggtcaatcgtcttcccgagatatttcaagtgggctctccgtggggcaacggcacggaccacgtcgggcaaggctggaatcttgtcgccaacggccaggcggagttgggcctccaagtaatgatgcttcccacgccatatcccactccggagccgcagctaagcgcgctcgtagctcaagcgaacgatcgagcaatcgagctcgacaacgttatggcggccctgcgtgagcgcgaagctgaggcaggtctcctggtcaccgcgacaacatcggatgcgacgaacgcgctctttatggccgacgctcggcgcaataccgaagagtcgcgcggcgcgtggagatggggtcttgtagtgcttggcggcgcggccctcgtcgctgtcctacccgtggttcttcactatctgcagctcgggcccgactacttggcttttgagcaaatcgccgtacacctcgtttcgacggcggcactcgggaccttcgcgggagtgttgctcgctcgcgctcgatcgcgtgatcatgcagcccagagagcaaacgatctgtccaccgcaatgggaaccatgatttc

SEQ ID NO: 52211 - DNA, 219 bp, Glycine max
  Peptide Sequence Number=SeqID_143896
atgattttgcctatggactctatgagccttactccttacaagcatgatctttcatccgaaaactttcgtatacttgactcatactccaacttaagggtgagaattttatccatcctgtcacacattccacgaacacatagtggtcatgaccaggtacacatagaggccacaatagtactaaggtattccttgaagcatccacaaacttttccaattaag

SEQ ID NO: 52212 - DNA, 672 bp, Glycine max
  Peptide Sequence Number=SeqID_143897
atggagagaagtataatagatgctgccagtggtggagcccttggagacataacccctactgaagccagaaatttaattgagaagatggcttccaactcccaacagtttagcgcatttatagatgctatgatcattagaggagtgcatgaggtagctacaaactcatctgcaccatctgaaactaagaagcttgagggtaaactagatgccttggttaacttggtaacccagctggccttgaataacaaatttgtacctgtcgcaagagtctatggtttatgctcctctactgaccaccatacagacctttgcccttccatatggtctagccctcaacaacaacagcaacctactccttccttccaaaatgctactggcccaagtagaccatacattcctccaccaatccaacaacagcaacagccccagaaacaacaaatagttgaggctcctccgcaaccttccctcgaagaacttgtgaggcaaatgactatgcaaaccatgcagtttcaacaagagaccagagcctccattcaaagcttaactaaccagatgggacaattggctacacagttaaatcaacaacagtcccagaattctgacaagcttccttctcaatctgtccaaaatcctaaaaatgtgagtgccatttcattgaggtcgggaaagtag

SEQ ID NO: 52213 - DNA, 201 bp, Glycine max
  Peptide Sequence Number=SeqID_143898
atggtggcatgggtaatgctcaggcatggttatgagcccggaatgggtctgggcaaggacagccacgagaatgccgatgtggtcgacattagggggaacccatacaaatatgggttggggtatgaacccgggaaaccgggaagaaggaatgcaccgtcaagactccgggcagatagggcatggcccggccatgttagctag

SEQ ID NO: 52214 - DNA, 832 bp, Glycine max
  Peptide Sequence Number=SeqID_143899
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgctcttgttgctcaggctggagtgcaatggcacgatctcggctcccacaacctctgcctcccagagacaaggtttctccatgttgatctgttgatcaggctggtctatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 52215 - DNA, 500 bp, Glycine max
  Peptide Sequence Number=SeqID_143900
ttttcctcgcctttcatcatggcaaggaaagcccggtcatcgccattttggccatgtatgacacgttcgaccggggcccgtctatccgctacaaggaaggaagaatcaggattctatcttcatgcgaaggatttccaaatgttcccttaatgggaacaaggggttgtataaattataatcttgtcctcgccataagacagcttggctaccccatgagaggagtgccatcacacgaaagcatcacgcctttcattacacggggtttcagtgaccccaatgcaaaggacagagagcttaggggaagcagtaatgggatcatcggcggctatcataagtggctgagagtccggacacaaggattggattggctcccaaatctaaagactgtgagagacaatgaggttaaagcttcggaagaaagtgatgaggtacaagccctaaaggcaaagcttgaaagagcccgggtagtcaaagagaagttcaagtccatagccatcaaa

SEQ ID NO: 52216 - DNA, 261 bp, Glycine max
  Peptide Sequence Number=SeqID_143901
atgagaggtgctaataccttcctcaaatgtaaatacaactcccgaatctggaatattcttcatgaccggtttccttctgtttttccgacgtttcccacaaataaacgttggtggcgactctgcgcattttcctcctttggaagacgcacccgtgagcctcgcctcgctcgcccgcaaaagggaagctggaaggtccatatcactttcttaattgaacacatggggcactacgcccccaaatgcgcatgtaagaagagatga

SEQ ID NO: 52217 - DNA, 195 bp, Glycine max
  Peptide Sequence Number=SeqID_143902
atgacaccggtaaaccgaaaggcaggaacaggagagcgcacgagggagccgccagggggaaacgcctggggggcggagcctatggaaaaacggctttgccgggagccctctcagagttccctgttaattcttacctcatcttccgaattccgccccgttgtaaggccatttccgctcgccgcatcaccagcgtag

SEQ ID NO: 52218 - DNA, 130 bp, Glycine max
  Peptide Sequence Number=SeqID_143903
gaacagaatcgtctcaggccacggtcagaagtcaagacaagtcaatggcagaaatcaaccaagggtcacgaccgaccgtcgtctcttcccggcactagacaagcagagaacgtcgctgcaaggcagccca

SEQ ID NO: 52219 - DNA, 501 bp, Glycine max
  Peptide Sequence Number=SeqID_143904
atgtcgatctccccctgtagaaggatcgcgcccacaagacaccaagtggacccagagaagtccaacagggccctagggtttccaactctggttacgggcctctttcagtcctacagggtgctcgtccccccagcaaggtcatgccatcgtgacatagggatcacgcccgtaagacacccagtggacccggagaagtccaatagggtcctagggtttccaactctgatcacgggcctttgtcgattctacggagtgcccgtcgcccccaacaaggtcatcaggccccctactaacgagctttcatcaagaagtactgcgccctcatgcaggcacagggcaagacaccatagcagcctggggatggccgacagcgggcaacaaacgcaccgccgccacctccagagcccctcagctcatctacaaaggctggagcattgcctacgacccgtggccgaccagcaggcgaccaagtccaaagccaaaggtaagcaaaagtactag

SEQ ID NO: 52220 - DNA, 388 bp, Glycine max
  Peptide Sequence Number=SeqID_143905
tgtgccttctacactccaccaaaagctgaaattcgtagtggagggacacttggtcatcgtgtcaggcgaggaagatatcttgcatttcctccgtggactccctctttgggcaaccttgtctgtccgatgcggggcaaaagtggtggaggaacaagatggcgaagcaccccaactagcttcgaataaagatattccgcaaggggcccccggaaaaatggtggagaaaggtaggtgtcctaggcttaagccagcgagttccttcaggggactgaattcagcaagcgaattcgcgggaaggatattgaacagctcaacaaaaccccggctagaggtctcgctgttggagtacaagaaagtgaaggaagctccgagcctgccacataagtag

SEQ ID NO: 52221 - DNA, 123 bp, Glycine max
  Peptide Sequence Number=SeqID_143906
atgggcaaccttcgcttgactgcttcggggtacataacacccatcattagacaatccgtgaagttccgcgataagctggaagtcgaaaggaagcattgttgcgcaatccgtaaagtttcataa

SEQ ID NO: 52222 - DNA, 315 bp, Glycine max
  Peptide Sequence Number=SeqID_143907
atggaaaagttcgatttcgggaacttaccggttgaagaccaaagaacgacgaagaacgaacgaagaacgtcaaagaacagtttaaaatctttgaaatcacccacgaaaacgttacggaagcgttacggaagcgcctcggcttggattttcatcacggaaacattttttctcactaattttaagagcttgccacctagatcacctagacgagctaggttgcttcctccagaagccggaagaagcaaccggcttctggaggaacatcttgcaaggcccaagtatgcctgttttctatttgtaccccctttctactaa

SEQ ID NO: 52223 - DNA, 902 bp, Glycine max
  Peptide Sequence Number=SeqID_143908
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaggagcggagccacaggaggaagagtgtttgctgggtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 52224 - DNA, 393 bp, Glycine max
  Peptide Sequence Number=SeqID_143909
atgggtgaagtagagaaggtgcaagagcagatgaaggccgacatggaggccatgaaagagcaaatggccacaatgatggaggccataataagcatgaaaaagataagggaagtcgatatggttgcagttgccgctaccaacgctgttgctaaggtgaacccgatgcccccatctggcctcaaccaaatgaatcatccaacctcaaatatgacacatatctctcaaaccatgggggagacacatgaaattccccatcacaatctagccgacttcgagccttgcctcggatatgccactgaagggcaagcaattggtggtatacccctgcaaaaacactttggagggccctcagtgtcacccacaatcacaaccctcacattccacagcggttaa

SEQ ID NO: 52225 - DNA, 438 bp, Glycine max
  Peptide Sequence Number=SeqID_143910
atggggatcgcacccacaaagacacccagtggacctgaagaagtccaacaaggccctggggtttccagctctggttacgggcctttgtcggccctacagggcgcccgttcccccaagcaaacacctagtggacccgaagaaggccaactgggtcttggagttgccagctctaaatacgggtctctgtcagctctagggagtgcctgtcgcccccagcaaggtcatcaggtcccccctaccaatcgagctttcatcaagaagttctgcgtctccaggcaggcgcagggcgaaacaccacagcagcctggcaatggccggcagcgggcaacagacgcaccgccatcacctctagagttcacctctgctcatccacaaaaaggtttgagtattgcctacaccacatggccaaccaataggcgaccaagtccaaagccaaag

SEQ ID NO: 52226 - DNA, 489 bp, Glycine max
  Peptide Sequence Number=SeqID_143911
atgactcaagagctggtagcccgcggagacaccttacggttatccgcacctcgtcattcagtgaccccaagtgtgattgatgagcaaaggccagtgtggtcatttgcaccctttccggagatgtcagcatcttccagtggagactttttcaagtctcacaagttatctagaactacgagcaagagccttgcttttgtcgaccgccccacaagatcttttatactgaccctgaggtcatatgacatgcggagacaaaatttagtcattccgcacccctttgccattcagacgcagtcgtgtccgatggcgcgcagagacaaaatttggtcattctgcaccctttgtcatccagaggcggcgggcccgatgacatgcggagacaaaatttggtcattccgcacccctttgccattcagacatagtcgtgtccgatggcatgcagagacaaaatttggtcattctgcaccctttgtcatccagaggcggtag

SEQ ID NO: 52227 - DNA, 453 bp, Glycine max
  Peptide Sequence Number=SeqID_143912
atggccgaatatgaagcatgtgccctagccgtccaggcagcaattgactcccgatgtcaaactactcaaggtgtacggcgaatcagcgttgcccgggggatcccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 52228 - DNA, 453 bp, Glycine max
  Peptide Sequence Number=SeqID_143913
atggctccgagaaagctttccacaaagagatccaggaaggatgtcgcggctgaagggaccagtgccactcccgagtttgacaaccatcgtttcaggagcgttgagcaccagcagcgtttcgaggccatcaaaggatggtcattccaccgagagagacgcgtccagctcagggacgatgagtacacagatttccaggaagcgatagctcaccggcgttggacgtcgctggtcactcccatggccaagtttgacccagatgtagtcctagagttttatgccaatgcttggcccacggaggagggcgtgcgggacatgcggtcatgggtaaggggccagtggattcctttttatgcagacgccctcaaccagttcctgggagacccgctattgttagaggagggccaagagtgcgagtatagtcagagaaggaaccaggccaatggatttgattga

SEQ ID NO: 52229 - DNA, 756 bp, Glycine max
  Peptide Sequence Number=SeqID_143914
atgcgctgggcgccggccgggctgacttcaccccgcgcgtcagcctgttgttgtacgtgctgtacggcgtgccgctggtgttcatcctggcccgggcgcggcgcgagcgctcagcatcagcctgatcgatgcggcgatggcggcgctgctgggcgtgctgttcttcgtgcacacgcagtccttcgccgaccgggtggaggtcgacccgatggcgatggtcagcatgcagcgcatgttcgacatccagaacctgtgcattgccggctttgcggtggtgcgatggctggccggcgatgtgcccgagcggcgcagcgtgttccgcgcgctggcgctgtacgcgctggcgtacctggtggtggcgttctacatcaaccactacacctcgggggatgcattcggcgcctacaacgacctgctgatcgacctgccattcctgctgctggcgttgctggcgctgagccaggcgcccgcgccggtgttcgtgccgcacccgcggatggcgcgcaccgtgcaggcggcgggcccgatgatcctgccgttgctgctgttggtggtcggcaccctggtggtcgaccatgcacggcccctggcggtggccggattcgtggtggcgacgctcggtttcggcctgcgcagcatcctgctgcagaccgacctgctggaacggcaggcggcgctggatcagctggcgcgacgggacggtctgaccggggtgccaaccgccgcgaattcgatgccctgctgttggccgagtga

SEQ ID NO: 52230 - DNA, 326 bp, Glycine max
  Peptide Sequence Number=SeqID_143915
atgggggagacacatgaaatatcccatcacaatctagtcgacttcgagcctcgcctcggatattccactgaagggcaagcagttagtgatatacccctgcaaaacactttggagggccctcagtatcacccacaaccataccccttgcattccacagcgggtaaaaaccctcctactatggcagaaatgggaaagttggatcatctagaggaaaggctcagggccattaaaggaggcagagattatgccttttctaacctagaagagttgttcctagtacccaatatcgtcacccctcccaagttcaaggtgccggactttgacat

SEQ ID NO: 52231 - DNA, 486 bp, Glycine max
  Peptide Sequence Number=SeqID_143916
atgactaggggcaatccaggtgatttacaaccctttgatcctaaaatagatagaacctttcatagattagttaggcatagtgtgcatcctggtcattctttgcattttgagcatcctgatcattttgagcattctgttgttggtgattctgaatattcgactattaattttcatactgagaacatggctcaacctccacctcgtgagaggactcttagggagatggctgcacctgatttcactttgaaagcttgtgaagatcctcataagcatcttaatgtggaagcaaagcttcatgatgaatcaaaaatgattcaaagctcaaaagatcaaagaacaactcaagtgaatcaaagaacatctcaagtgaatcaagaacaagtcaagagttcaagaatcaagaagaattcaagactcaagaagaaagcctacaatcaagaatcaagattcaagatctcaagaatcaagatcaagattcaagaatga

SEQ ID NO: 52232 - DNA, 331 bp, Glycine max
  Peptide Sequence Number=SeqID_143917
atgacaacacaaccaagtttggaggaagctcaatcatctgaatcatcttcagcatttccagacttaagggaatgcaaagtaggtgcatctgaagcacatattatggctgaagatcaaccacggagggtgactcttgaggactattctagctccaccgtgccgcaattctttataagcattgcgcggccggaggtccaagctcacaccatcacatatccttattccttgatccagttgatccaaggaaatttgtctcatggtttgtcaaatgaagacccttatgcacaccatgctacatacatagaaatctacaacacaatgaaaattactg

SEQ ID NO: 52233 - DNA, 438 bp, Glycine max
  Peptide Sequence Number=SeqID_143918
atgggtccatgcaagaatagcccagatggagaggccatctatcgtggctctaacaagtcatccgcccatgacggagatggagactgtccatctcaatgtacggttagggaagcggagaaaccggatgctgcagcccgccttaaatccgggtcgagactacgaaaagcaatgtgttggtcgaagtatagtctgcaactttatggcttgcctccggacttcacctcccgtgccaccccggaagttaagagcccctatcgaggggctatgacgaggcaaaaaggaaggagattgcccacgcggtccactcaaaactgcgccccgacgtggatgaaagcaccccaaaatatccaaagctcataccagcccaatcccccaaatatccgagtcgggatccctcctgactcaacctgtaaaaggaacttcccttcgcgaagataa

SEQ ID NO: 52234 - DNA, 201 bp, Glycine max
  Peptide Sequence Number=SeqID_143919
atgtgggatactctccaattaacccatgaaggaaccactgatgaacatgagatggaacttcaatgtcataatcaaaatgaagaaaatgacaaaaagaagagaagtatagcccttaaagcctcatcatcaatgcaagaagaaaacgaagaagaagattcagatgatgaagaagatttttctttctttgtgaagaaattttag

SEQ ID NO: 52235 - DNA, 309 bp, Glycine max
  Peptide Sequence Number=SeqID_143920
ggagtcgtaccgcctcttgagcttgaggttggtccttctgctgcacgtgtcaacacaaagggaagtcatgtcaacccctcaagagtttatgagggggtcgacaactatccacaacgtccctttgggcatatgcctattgagaaagttcataaactcttccaagggaaaccagaggattatattaagaaatggatagagaattcacaaagagatgtctaccaaggagcctacttgaatagtgttttgaagggattcgacgatagtcaaggaagtaaatccaagactactgctaaatggatttcagttaaa

SEQ ID NO: 52236 - DNA, 180 bp, Glycine max
  Peptide Sequence Number=SeqID_143921
atgatgataacaaaagatgatgacaaagttcaagataagaatcaagaagaattcaagactcaagaagaaagtctagagacaagaatcaagattcaaggttcaagatctcaagaatcaagatcaagattcaaggctcaagattcaagaatgaagagaagactcaatcaagataagtattaa

SEQ ID NO: 52237 - DNA, 414 bp, Glycine max
  Peptide Sequence Number=SeqID_143922
atggatgaaatcacaattaaaaagcacaactacctatcttttagagtcctttgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 52238 - DNA, 300 bp, Glycine max
  Peptide Sequence Number=SeqID_143923
atgcaatgtggtaccatatcagtgaaaaacctcgtcgggcgcctaggagtacatgacaagacaaaccacacactaggagacgagtcagggtcacagtgttttgcgagaatgctccaatcatatgggatcaacataggcttaaaggagcactcaaaccgtgtgacccccaaggcctacactccgaagagtctgtcagggcctctccctttgattcaggtccaacccagaaaacattttagcacacagactctatctatgaactgtacaaaacacacgactcctcaattgttctcaaaataa

SEQ ID NO: 52239 - DNA, 378 bp, Glycine max
  Peptide Sequence Number=SeqID_143924
atgccatatgtggaagccgtggaggagtcattggaaacaactttccaatcttttgaggtagtaagcattgcctccgtagattccctctctgggcagccttgcctgtctgatacggcaatgatggtggcccgggtgatgttagggaagaacagaggccaaggcttgcggttgggacaacaagccaaagggcccccgccctgccacatcagtagaagctttataagtgcaggtctaagacacgaaggccaagtcgccgcgatatgcgaggatgactcctcgaggagatcggatttggtacggccatgtcctcctggtttccgactaggaaattggcgagtggaggagcgcccagacgtttacgcgacaagcataatgtaa

SEQ ID NO: 52240 - DNA, 1071 bp, Glycine max
  Peptide Sequence Number=SeqID_143925
atggcgtcacgacttgaagagcttggagcgaaaactgacaaggcaagcggaggtattcagaacaatgctattgcgctgatcaccagtactctcgcacaggttaaccagcgcaaccttctgagcgttcaatatggtgataacaaagccggtatagagcgagtcgacaacgtcatggcagacgcaagtaaggctgtcgctgagtctctgcgcaccctggattccagcgccggtggaaacacgtcgaatgttaccgatctgtctaagacgcttgctgactttacacaggcgtctgctacgcaaattaactcgctcaaggtcacggtaaacggtcagtctgcagctattatccagaacagccaagtatcagccgacatcaataataacctgaatgcgatgtacagcatcaaggtagctgttgattccaatggcaatcagtacgcggctggaatgggtattggtgttcagaatacaccttcaggtatgcagactcaggttctgttcgtggcagaccgattcgctgtgatgagccaggctggtggtgcagtaactctgccttttgttatccagaacgggcagacattcattcgggccagcttcattcaggacggcaccattgataacgccaaaatcggcaactatatccagtcgaataattatgtggctggctctgcaggctggaagcttgataagggaggaacgttcgaaattaacggcgtggccgggggcgggaggatgctgatatccagcactcttattcgcatctacgacagcaacaacgtgctgcgtgtcagaatggggttatgtgcagggttgattgcggttgatttaagcgattatgcgatccggtatatcggaagcacctctgtaacattcgctgcgggggaaacgtcgaagaacgtttccttcgccgggataacccaggatggctcattcatttcgattgtgtcgactgggcccaccgtcaacgaataccactgccgagcctataatggcggttttactgcgtactatttaccaacaaccggaagtcctgcgatcacactcaatgtggaggtgtataactttcaatga

SEQ ID NO: 52241 - DNA, 115 bp, Glycine max
  Peptide Sequence Number=SeqID_143926
gtcgactctagaggatcccctctccctctcccttcattcatctccttcttcctccaagctcttatccatagcctcctatggtggtgagcttcttctagactcatcttctccttaa

SEQ ID NO: 52242 - DNA, 243 bp, Glycine max
  Peptide Sequence Number=SeqID_143927
atggcctcctatggtgtggcatctcctctctctctccctttctccattccgctgccattcatcttccaagaagctaaggaatccattgatgaagaagaccctaggcctacaagctccaatggagcttgcatcaccacctatgcgtcaaactccttcatgctcataatggagggcaagcccaagcctcgacagctagggggggcccggtaccaccctttgttcccgctagagagaataatttga

SEQ ID NO: 52243 - DNA, 240 bp, Glycine max
  misc_feature (211)..(211): n is a, c, g, or t
  Peptide Sequence Number=SeqID_143928
atggctcaattgatttctgatgccatccactatttgcaaggatcgcgcccacaagacacccagtggacccggagaagtccaattgggccctggggtttccagctctggttatgggcctctggatcacgcccgcaagacaccagtggacctgaagaagtccaacagggtcctggggtttccagctctaattacgggcctctgtcaattctancggagtgcccgtcgccggggatcctctag

SEQ ID NO: 52244 - DNA, 267 bp, Glycine max
  Peptide Sequence Number=SeqID_143929
atggtcattcccaagttcaaggtgctggactttgacaagtacaaggggactacttgtctcaagaaccatctaaagataggagtatacaagaatgatgaaggccggacatggaggccattaaagagaaaatggccaaatgatgaggccatgatgagcgtgaagaagataatggaagcacattatgcggttttgcaaattgccgctaccaaaagctgttgtttgctaagtgaacctgacgtccccatccggcctcgaaaagacaaatga

SEQ ID NO: 52245 - DNA, 825 bp, Glycine max
  Peptide Sequence Number=SeqID_143930
atggtaacaagaagtacctccaaattaatcaatgttattaatgaagatagtggccaaaactcagataacacaactgagataggatcagtgtcagagaagaatataaatccaattaattccaaacactggaaaacaacctccaaattatattatcaacgtccaactgcccctgaccttctattagaggaaagaggtgaaaacaattttaagagttttagtgcaaacaacatctatgaatggaacatagatacacaaacggagtataacatcatgaatacactccaacatatgaccatggtagctacggcttaccaaacctcccatgaatgttcagaagagaccattatagatatcttagtggcaggattttctggacaactgaaaggatggtgggataattatctcactaacgaagagaaatcaaaaatttacagtgcagttaagacgaatctcaatggaaaagtcattactaatgacgatgataaagagattcctgacgctgttaacacattaatttttacaatagcccaacatttcattggagacccatccttgtggaaagataggtctgcagaattattgtcaaatcttaagtgtagaaccttagcggattttaggtggtatagagatactttcctaactagggtttacacaagagaagatagtcaacaacctttttggaaagaaaaatttctagctggtcttcccagatcattagtgtcgcaacctacccttcggcgggagggcgacgcgagactctcgggatgcgtttatttgaggaaaacgtcggaaaaaccggaaaagacgcgatctatgaacttttaa

SEQ ID NO: 52246 - DNA, 519 bp, Glycine max
  Peptide Sequence Number=SeqID_143931
atggctccgagaaagctttccgcaaagagatctaggaaggacgtcgcggctgaagggactagtgccgctcccgagttcgacggccatcgtttcaggagcgctgagcaccagcagcgtttcgaggccatcaagggatggtcattccaccgagagagacgcgtccagcttagggacgatgagtacacatatttccaggaagagatagctcaccggtgttggacgtcgctggtcactctcatggccaagtttgacccaaatgtagtcctagagttttatgccaatgcttggcccacagaggagggtgtgcgagacatgcggtcatgggtaaggggccagtggattccttttgatgcagacgccctcagccagttcctgggagacccgctagtgttagaggagggccaagagtgcgagtatagtcagagaaggaaccgggccgatggatttgacgaggaggccattgcccagctgttatgcataccgggtcaggattttgcccggaccgctgccgggagatgg

SEQ ID NO: 52247 - DNA, 525 bp, Glycine max
  Peptide Sequence Number=SeqID_143932
atggcacaacctccaccccgtgagaggactctaagggaaatggctgcacctgatttcacctacgatagcttgtgcatccaataccctgatgaggatgtcccatatgttcttaaaactggactgattcatttgcttccaatgtttcatggccttgtagacctttgcccttccatgcagcaacctggagcaatcgagcagcctgaagcttatgctgcaaatatttacaatagacctcctcaacctcagcagcaaaatcaaccacagcagaacaattatgacctctccagcaacagatacaaccctggatggaggaatcaccctaacctcagatggtccagccctcagcaacaacaacagcagcctgctccttccttccaaaatgctgctggcccaagcagaccatacattcctccaccaatccaacaacaacaacaaccccaaaaacagccaacagttgaggcccctccacaaacttccctcgaagaacttgtgaggcaaatgactatgcagaacatgcagttttag

SEQ ID NO: 52248 - DNA, 181 bp, Glycine max
  Peptide Sequence Number=SeqID_143933
gccacaacaacaagggcctagtctctatgatcgaacaacgaagctggaagagactcttgctcagttcatgcaagtatctatgtcaaaccataagagcacagagtctgccataaagaatctggaagtccaggtgggacagttggctaagcaattggcagatcgtccgtcttgtagcttttga

SEQ ID NO: 52249 - DNA, 604 bp, Glycine max
  Peptide Sequence Number=SeqID_143934
atgggtcaacttcaacagcaagccttccgcaaagcctatggtaagatttgggacctagctagggtagaagtctccatggaaccgattgcatccctttcccagtattatgaccaacccctaaggtgcttcacatttgaggacttccagctagtgttgactgtgaaagagtttgaagaaatcctgggatgcccactgggaggaaggaagccatatcttttctctgggttctatccctccacgacaagagttgccaaggtagtgaaaatctcagcacaagagttggaacgtctaaagcaaaacagaaatggagtagtcggagtaccaaggaagtttgtcctctttccgaatatggaagggttagtggacctagcagcgattgacgctttcctcgcctttcatcatggcaaggaaagcccggtcgtcgccattttggccatgtatgacacgttcgaccggggatgcccgtctatccgctacaaggtcaccgctcgtgcgtcgaaaaagggaaagggagtcaagaacttccccccattgctagccaaggccaaagcagtggcggacacctactccgccccagaggagatccacggacttctcagctata

SEQ ID NO: 52250 - DNA, 861 bp, Glycine max
  Peptide Sequence Number=SeqID_143935
atggtcgaccgtctcgccatcctgctcgaacgttttgcgatcactgcctcggtgttccatgccggcgcgctgtgcggtatcaacacgctggacggcgaggacgaggcgggtcagtcacgggcagcagaccgtgcaggtcgaagtgccgagcctgctgctgtatccgcggccgatgccacatcgattcagtaccgacccgcagcagggcgccgacatggcctgcgccaacctgcatttcgagggcggccggctcaatccgatcagcgctgcgctgcccgatttcatctgcctgccgctggccgacctgtatggcggccacgcggcgctggaactgctgttcgaggaggcgttcgagcagcgctgcgggcgggcggcgatggtcaaccggctgttcgaggtggtgatgatccaggtgctgcgccagctgatggaagcgcccgcacagtcctggaccctggaagacctggccgaggtcgccggcatgtcacgcagcgtgttcgccgccagcttccgcgaggcgatgggcaccacgccaggccagtacctgcaggggtggcgggtcggactcgcgcaacaggcgctgcggcaggggcggccgctgaagcggatcgccgacgatgtgggctatggcagcgaagcggcgttgtcgcgcgcgttcaaggcgcataccgggcagtcgccacgggaatggcgcgggcaggcgcgggccagcgcggcctgatcggtcagcccagcaccagccgggccagcttcatgccaccaaacagaccggccagggccagcgccaccgagccaccggcatacagtgccgccagcccatgctggccacgctgcagcagcaggccgatctccagcgcgtag

SEQ ID NO: 52251 - DNA, 438 bp, Glycine max
  Peptide Sequence Number=SeqID_143936
atgctggaaagttttaaacaacaagaacaaatgtcagttctggaattgtacatagaaaaggatgtggctggtggttcaatgtttcattctgcaaattcgcttacatcatgtggaaattatttatctaatgatgagacacaaccgccaacaaatatgagcaatttacatgttgacgaagatgatgatgatgattatcttgtgtctaactcatacgttgaagagtctttagacaaagatgacagtgttgatggtacatctgatacagacgatgaagtcaccgacatgattcaaccagtgcacaatgaattgaaaatccattttggaatgatgctttgcattataacaatatcaactgtagttatcctgatgaggaggacatttgcggtttggagatgtcgtcgacctttaatgttgactaagaattatatgttggcatga

SEQ ID NO: 52252 - DNA, 309 bp, Glycine max
  Peptide Sequence Number=SeqID_143937
atgaccaggactccgatctccccctaccgaagggatcgttcccacaagacacccagtggacccgaagaagtccaacagggtcctggggtttccagctctgattatgggcctctgtcaattctacggagtgcccgtcgcccccagcaaggcaggcgtagggcgaggcaccacaacagcctggggaaggccagcagcgagcaacagacgcaccaccatcacctccagaatccacctcagttcatctacaaaggctggagcgttgcatacgacacgtggtcgaccagcagaagaccaagtccaaagccacag

SEQ ID NO: 52253 - DNA, 324 bp, Glycine max
  Peptide Sequence Number=SeqID_143938
atgacagagaaggagatgatcataataatagtagtcacattaccaatgttttactatgaaaaaaatggtggggtatgcaccttcaagctttgcggatttggtcttcgtcggcgaaagatcgcagcaggtctgaaaagaggaaaatttgatcatcctgctttgatgaatgtgaaaactgaggaaaatgaagaggatgagaatgagggagaaacccttgctatgattgccattcctacacagtcaaatttcccatcagcccaacaatgtcattactcagccaataacagtccctctcacccaatcatccctaaagtccatccctaa

SEQ ID NO: 52254 - DNA, 156 bp, Glycine max
  Peptide Sequence Number=SeqID_143939
atggaaaatgctaagcacatggctacaccattgaacactgttgcgtatttagataagatgaaaccggtcagtcaatattttatggatgttaagaaatatccagatttcaatcaaatcccaaacagtcaacatcttagtgtcgttaaaagaacataa

SEQ ID NO: 52255 - DNA, 429 bp, Glycine max
  Peptide Sequence Number=SeqID_143940
atgttagtcttgcgtgctatcaggcttttcgtcttacagacaccaaaaaagaatgtttatacggataaccactcgggtatctccgcccgtcagcgtgactcaaatgtcagtatgacagatcttgtgagcgcggaagatgacgtaaatctccgcgtgtcaatgggcttgtcggccgcgatgacgaagggcgcagaagacgacgttagtctctgcgtgctatcaggcttttcgtcttacagacaacaaaaaagaatgtttatacggataaccactcgggcttgtcggccgcgattgacgaagggcacagaagacgacgtcagtctctgcgtgctatcaggcttttcgtcttacagacagcaaaaaagaatgtttatacggataaccactcgggtatctccgcccgtcagcgtgactcaaatgtcagtatga

SEQ ID NO: 52256 - DNA, 291 bp, Glycine max
  Peptide Sequence Number=SeqID_143941
atggttcgaatgggaaacgggcgccctgtagcggcaacgcaattaacgcggcgggaagggacagctgatagaaaccagatacgccaagctggaaattacctcactaagggaacaaaagcggtaccgggccccccctcgaggtacgacgtaatcgataagttggcatgctcaccctactgcactttgaatcaaaccctagaactcatccttctacaattcctggttgtccctgtgataaccggaagccctgggccaacttttggcgaaaatgagacgttgatcggcacgtaa

SEQ ID NO: 52257 - DNA, 477 bp, Glycine max
  Peptide Sequence Number=SeqID_143942
gtgaaatgaaagatattgagctggtagaggaggaagaggcacggattggtgctgattcttctagtgcaacctctaataaatctgagaattgtaaggaggaagcacagaatgcagcacagaaacataaagtaaaaagggtggagagtgtcaatgctgatgcagaagcctttggagattcaactgtgctgaagataggagattcgactaaagttgtgataaaacaagacatgaagggaagaaggcataaatatgggtttaacaacaataaacgtgagaagccagagaagatcatgggttcaccaccagcctcccctcctcctcttcctcctcctcctcctgctcctttggacgcatcggcttcgccatctgccgtgaagcggacacgcaaagcctcacgtctacgatcattgtctactagaccacctggtgctgagagaccaggggtccatgttgatcctgctaccagcaaggccgacg

SEQ ID NO: 52258 - DNA, 447 bp, Glycine max
  Peptide Sequence Number=SeqID_143943
atgacaccggtaaaccgaaaggcaggaacaggagagcgcacgagggagccgccagggggaaacgcctggggggcggagcctatggaaaaacggctttgccgcggccctctcacttccctgttaagtatcttcctggcatcttccggaaatctccgccccgttcgtaagcctttccgctcgcgcgcagtcgaattcgagcccgaggtagcgagtcagttcgagcggccgccaccgcggtggagctcaattcctataggatcgtatctacatattctgctggcaccggtgcagccttttttctcctgccacatgaagcacgttcgactggaaaccctggcgttacccaacattaatcgcctatgcacacatccccctttcgccagctggcgtaatacgcaaaggcccgcaccgatcgcccttccattacagttgccgacaggttcctga

SEQ ID NO: 52259 - DNA, 279 bp, Glycine max
  Peptide Sequence Number=SeqID_143944
atgtcatggtttctcttgtatagtatgcttccgcttatgaagaagctggccgcaaatctcctcaaagtccttttgtcgttgtcggaagcctacggtgggtactctttgctttcaacgtatcgcttgatatcgaaataccaaggcttaccgtctggttcctcttccaccagacaacaatgtgcgggtctgccacgacaactgaactcaatgtacggtaggtcgtcgtgcggtgttagctggaacatggacgctaaagtggcaagcgcatttgccatttga

SEQ ID NO: 52260 - DNA, 833 bp, Glycine max
  Peptide Sequence Number=SeqID_143945
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcaggatacgcttgtcacgagcggtcttaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 52261 - DNA, 411 bp, Glycine max
  Peptide Sequence Number=SeqID_143946
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggtacatctacttgggttgttgactgagaacaagagagggtacatctcttgtggatcagttctagtggagggtacatccactaggttgttcaaagagaacaagggagg

SEQ ID NO: 52262 - DNA, 246 bp, Glycine max
  Peptide Sequence Number=SeqID_143947
atggccacaatgatggaggccatgatgagcgtgaagaagataatggaagccaatgcggttgcaatttccgctaccagcgttgttgctaagccacaatctaaagccgatttcggaagaccttgcctcggcatatgcgcaaaagggataagcagaattggtggtatacttccttccaagaaaatcttacttcggaaggtagcgttagtatcatccccagctacacctcttgcattccacaacaagtaa

SEQ ID NO: 52263 - DNA, 278 bp, Glycine max
  Peptide Sequence Number=SeqID_143948
ggatcgcgcctgcaggacacccagtggacccaaagaagtccaacagggtcctggggtttccagctctaattacgggcctctgtcaattctgcggagtacccgccatccccagcaaggtcatcaggcctcctactaaccgagctttcatcaagaagtattgcgcccccagacaggcagagggcaagagacaccacaacagcctggggatggccaacaacaggcaacaaatgcaccgccgccacctccagagcccctcagctcatccaccaaaaggttag

SEQ ID NO: 52264 - DNA, 348 bp, Glycine max
  Peptide Sequence Number=SeqID_143949
atgcatttcgcgaaccacgtactagctgtgggtgagctttgtctagtgcctggacgggtatctacggattacatggagtggtttttccggatatctcacccattcatgataccgactcaggcaggtgaccagcccagagatgcacctgccgcagaccttgaggagtacatgcaaccgcccatcccccaggcgatcgcacagaggttggagcgtgtgctcaatcttaggattgtcactacaggcacagagttaaatgatattatgcaggattgtctcacgatcgccagagagggtgtcagtgcagatggaagtgtcagggctcgacagagacggtgcacagagcattga

SEQ ID NO: 52265 - DNA, 788 bp, Glycine max
  Peptide Sequence Number=SeqID_143950
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatctacagcttgtctaggtgagcacgtgattatgacggtatttagactatttgagccaccttttagcactagctggttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 52266 - DNA, 252 bp, Glycine max
  Peptide Sequence Number=SeqID_143951
gatgctctgattgctgaactcaaggacacaggcaaggtgctggaagcaaccatcaaagccaccatcaaagccaccacagagaagaagatggagctggaacggctgatcaaaaggctctcagaaagtggcattgatgatggagaagcagttgaggaagaagaagaagcagctgaggaagaagatgctgcagcagaggaagaggcagatgcagcagaggatacagaatcagatgattctgaagccaccccatga

SEQ ID NO: 52267 - DNA, 342 bp, Glycine max
  Peptide Sequence Number=SeqID_143952
atggaggcttggcggttaatgcgatgcaagagtgtgaacctcggggggccgaagcggatgggagacgtgttaacctctaggaggttcatattggaagcgctacacgaagcgggtataatttgccttgacggggacaagggagattcttgtttgatacatccaggggcatcacacaacgtggagacatgcccgatgttggttgataagagcccgagcaaacccaagccattggtgatccacttcactagggacgttgccacacagaagtcccgaggtttccagcctgtcccaattaagaagcctgcgcctttcccctacaaaagtgataaggcggtgccatag

SEQ ID NO: 52268 - DNA, 441 bp, Glycine max
  Peptide Sequence Number=SeqID_143953
atgaagtatgaagcctggttccatccgctgaacggcgccggtgattttaaggtcaacgtcagcgccagcgattatcaccagatggacaaaggcgtgaagggtgagctgaaaatgcagggcacgcgctttcagctcaaatacaccaaagaagaagattttcgcctgcgtggcgcggctcagctttggcgcttcctttggttgcgtagcacgcagcagcaccagctgcaggccgtgcatcaccaccataaagaacagcgcaacgtggacaaagtagcgcagcggcgtcgggaaagggtgcaccaggttaagcagcagaaatgcccagacgcaaatcatcagcaaacgtcccagattaagccacatcatcggtctcctgttggcgttgatagaggcgataggccacctgaccggcaatcttctcgcgatacaggtcccagttag

SEQ ID NO: 52269 - DNA, 339 bp, Glycine max
  Peptide Sequence Number=SeqID_143954
cagttcgaaaggttgactatatcgggaatcccggatctacgcttatttcaactccccgaagcatttcgtcgcttactacgcccttcctcgtctctgggtgcctagctttgtatcgactaagttcacgagttggagataagcggactcgaaccgctgacatccgccacagggatccagctacaggagaaccgggaacggagagcttcccccgccccccttttttttccgcccgactctttgctcttaagaatactgggttctatggtcggtccgcgacccctggatgccgaaggcgtccttggggtgatctcgtagttcctacggggtggagacgatggg

SEQ ID NO: 52270 - DNA, 824 bp, Glycine max
  Peptide Sequence Number=SeqID_143955
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcatgcccagtttatgatactttattacagcagccctaaggaccaatattgtggaatatgcaagtcttcagacataaatgactatgtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 52271 - DNA, 519 bp, Glycine max
  Peptide Sequence Number=SeqID_143956
atggccccaaggaagcttgcctcaaagaggtccaagaaggataaagcggccgaaggaaccagttccgctcccaagtatgacagccaccgctttaggagcgcggaacaccagcagtgcttcgaggccatcaaggggtggtcatttctccgggagcgacgcgtccagctcaaggacgatgagtatgccgatttccaggaggagatagttcgccggcagtgggcatcactggttacccccatggccaagttcgacccagacatagtcctcgaattttttgccaatgcttggcctacggaggagggcgtgggagatatgagatcctgggtgaggggtcagtggatcccattcgatgcggatgctatcaaccagttcctaggatatcctttagtgctagaagagggccaggagtgcgagtatggccagaggaggaaccggtccgatggttttgatgaggaggccatcgcccaattattgtgtataccggggcaggattttgcccggactgctgcagggaggcga

SEQ ID NO: 52272 - DNA, 87 bp, Glycine max
  Peptide Sequence Number=SeqID_143957
caatagctaaagtagctcctaatactaccgttattatacctataaaagctattccgttcattattgcaggcccttccatagcatctg

SEQ ID NO: 52273 - DNA, 207 bp, Glycine max
  Peptide Sequence Number=SeqID_143958
atgacaacaccaacttatcttgatgcaactatcagcagcaatgaaaatagtgcagaaccagaactagaacaaaggaaaagaaggaaaacaaaacatgaggcaaaaagggaaaacgaaccagaacatggtgccatagcaatcaagcgacaacgatgtggtggtggacatgtggttgtgcagtggcaacatcacgattcgagagagtga

SEQ ID NO: 52274 - DNA, 507 bp, Glycine max
  Peptide Sequence Number=SeqID_143959
atgattatgaggggccaagacatttatagtagccaagatgaggctactacttcaccttcctctagtgaaagtgaagaagcaaaaggggaagaatctatggttaaagagaagtgtaaagaggtaagtgtctcctccaagaggttagctaagaaggaaactcattttacaataaagacaaacattgaagaaactttccctcttagacaacctccacattttctcttttgtaaaaagacacttgttagcactgccacacttcttgggcttgaggttattcctcaagtaaaggagttgtttgatgagggtttggttcgtaagagcttaaatccttgtgctttgttggtgcccaaaatatgtattattaggcaccaaatccctacaataagtgatatgatgaatgtgttgagtgttgcaaccctcttttgtaaaatcagtcatgcacccaatgtcttcatgattgatgtgcatagggactcattaggtaggtgctcatatgggacaccttag

SEQ ID NO: 52275 - DNA, 48 bp, Glycine max
  Peptide Sequence Number=SeqID_143960
atggctccgaggaagctttcctcgaagagatctaggaaggaagctgat

SEQ ID NO: 52276 - DNA, 785 bp, Glycine max
  Peptide Sequence Number=SeqID_143961
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgcgtagggacaagttcaggagaaagcataaccgtttcggctgtttcttcctctcttatttcctcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 52277 - DNA, 348 bp, Glycine max
  Peptide Sequence Number=SeqID_143962
atggttacccgcacctttcatcaaccaggggcaaacgagcccgttgacgtgaagagactgacatcatcttctgcaccttttgccatccagggacagcgagtcaagtggcaggcggagataccttatggtcatccacgcctttcatcaaccgaggggaaccaattcgacggtttttacactcgtcgtctggaaacattcaagcccaacaacgcacaagattcttctctgctgggcagggacgatcgagtgcaatggcaaaaggaagtgtcgtggttgtccaactttgtcattttcgagacactgaagtttgttggcgcttctgatgccttttcttttctttctgaatga

SEQ ID NO: 52278 - DNA, 234 bp, Glycine max
  Peptide Sequence Number=SeqID_143963
atggactcgggaaggttccaagttagtgtaccaggtaacagctaccccagtgtagttggggatgatactgagggccctccaaagggttttgtaggggtataccaccaactgcttgcccttcaatggcatatccgaggcaaggctcgaagtcggctagattgtggtggggaatttcatagtgtctcccccacggttgagagacatgtatatgatgaggttgtcggctctcaataa

SEQ ID NO: 52279 - DNA, 165 bp, Glycine max
  Peptide Sequence Number=SeqID_143964
atggataagagcttgaaggtaggaaaagatgagtggagggagaatgagagaaggaacatgaaattttatgcctcaaatgagctatggtccaacccactaatccaagatcaagtccaagattctccattaagtgtgcttaggtgtcatgaggcatgtaaagcatga

SEQ ID NO: 52280 - DNA, 537 bp, Glycine max
  Peptide Sequence Number=SeqID_143965
atgacgcctaccaggcaccctctggacccagataagtccaacagggccctgggatttcccgccttgatcacaggactctgccagtcgttcggcgtccccgtcacacctagcaaggtgattcggccgcccatcacccgagcttttattgagaagtactgcacacagagacaggtccagggtgatgcaccacaggccgcggacgtgccgccacctcatcaggctggtccagccggattgtttgatacagagcagtatttgcggcatttggttcgccagcaggcggccaaccactgggcacatgtacagactcatgattgtctttatcagatgagtctcagcctgcagagccagggctttacttcttttccgtgccctactccggaccagttcagggcagaggtcgcatggcctggagattggcccgaggcccaggcaggaaaggcaccagcagaggctcccgacgaggcagatgaggcccgcgaggacgaggagatgaccgatttactggatttcttaggaggaagcggtgccacatga

SEQ ID NO: 52281 - DNA, 294 bp, Glycine max
  Peptide Sequence Number=SeqID_143966
atggtggggtacgcaccttcaagctttgcagatttggtcttcgctggggaaaggatcgaagcgggtctgaaaagaggcaaatttgatcatcctgctttgatgaatgagaaagctggggcaaacgaagaggatgagaatgaggaaggaacccatgcacaaccacaaccctgtgcatatttggaggatctgggaatgagcccctcctgctatgagctgaaaagggaaaggtgtcaatctaaaggaaaggctcaggccattgaagttgaggtgaagattatgcctttgctaacctaa

SEQ ID NO: 52282 - DNA, 207 bp, Glycine max
  Peptide Sequence Number=SeqID_143967
atggggactgtctattgtcatacaccaaacagagagggttgtacaacagtttggatatgtttagcgcctagccagtgttcaccggactacatgaattggttctacatgatatatcatccctttatgagtccggcacagcctggggatcctcctagacatccgcctgtgcagcaccatgacacatttgttgaactagatgttgcttag

SEQ ID NO: 52283 - DNA, 498 bp, Glycine max
  Peptide Sequence Number=SeqID_143968
atgaccatgattacgccaagctcgaaattaaccctcactaaagggaacaaaagctggacactcttttccaacttttgttgcaaagtgtttgatgttgaaaaccaacagtatttattcatcagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 52284 - DNA, 306 bp, Glycine max
  Peptide Sequence Number=SeqID_143969
atgagtgatggattttgcggtactcatttgcagatcatggttaggactagaggattaggtcatgccttaggtcaagtcactggcagaggtctgggcagaggagatcgtgatgattccgatgatgctccgcagcgtcgacggcctactgcatccgcacggaggcagcgagtcgctgtgactgcggatcacgtcgatgagccagtcatccctgcgccagatgttcaagatgacccgatggaggcaccagctgttgtggaggacattcctgcggacgcaggcgtagaggcggttgaggatcagccttag

SEQ ID NO: 52285 - DNA, 285 bp, Glycine max
  Peptide Sequence Number=SeqID_143970
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatttccgctcgccgcagtcgaacgaccgagcgatagcgagtcagtga

SEQ ID NO: 52286 - DNA, 538 bp, Glycine max
  Peptide Sequence Number=SeqID_143971
gtatatcatgaattcaattattacagtgttgtatttcaacggaagagtatatgtagacaatgatggtgtaatatttgaaggcagtaaaaagacgattcagattaaacgcggaattagtttcaatgctttgaagaaaaaaaaattggagataagatttttagtttcaggaaaatatgttgcgttgcaaatttgtgatgacgaagatgttgaaactatgatcgaaagttttcaacaacaacaacaaatgtcagttctagaattgtacgtagaaaaggatgttgctggtggttctatgtttcatgctgcaaattctattacgtcatgtgaacgtaatgtatctcatcatgagtcggaactgccaagaaatataagcaatttacatgatgatgatgatgattatcttgcatctaactcatacgttgaagagtctttggatgaagatgatagtgatgatggaatatctgatacagacgatgaagtcactgacatcgttgaaccagtttcaattgttcacccaagagaaggtaaatgtttgtga

SEQ ID NO: 52287 - DNA, 177 bp, Glycine max
  Peptide Sequence Number=SeqID_143972
atgagagagattccaagagaacttcattgtcaaatgctctctcaaagaactcttgggcaaacacttgcacatccattaagagttcatccatggatcttcattcctatccctcttaagattattgaggccacaaggtacaacacagagctcaaagcaggagccggtttgagagcttga

SEQ ID NO: 52288 - DNA, 408 bp, Glycine max
  Peptide Sequence Number=SeqID_143973
atgggtaaagtagaggagatacaagagaagatgaaggccgacatggaggccatgaaagagcaaatggccatgatgatggaggccatgatgatcatgaagaagataatgaaagccagtgcagttgcagttgccgctaccagcactgttgctaaggtgaatccgatgccccaatctggcctcaaccaaatgaatcatccaacctcagctatggtaggcaaagatttgggaagtatgggcggcccccatgatgtgcgaattcaaaacgagcgcgccttcccgccatgtggcttgcctctcaactatacgccacccaatgtggcgtacagtcccaataaggatgtcaataactccactcctatacccattgaaagccagcaaccccaagctgatcatgcacatgtctcttaa

SEQ ID NO: 52289 - DNA, 870 bp, Glycine max
  Peptide Sequence Number=SeqID_143974
atggtgaagcatggtgccgcggaggtagttgatgtcgagggttatggctacgttaatggtgacagagggagaagagctgtagtcctcatcgttgcggaaggcgagggcctcccggaagagagggagtttcgggaaaggacagctagcaacaataatttaattatgttaaacaattttaacggtccttcgcaccgccgcctctattcctgcaatagcgctcgccgcttctactgtcggcttcgtcgctcttcaagcaacggtcgtggtcgtcgtacacctttcgcaacgaggcgtggctccgccacaaggggaactggaagaaccgttgcagtaaaagcgtcaccgatgaggacgtggacgagctcaaggcctgcaacttggtcgtcgtctccctcgggtcccacctctacgtcctcaatgggtccttctttgacacgtgctccttccccatcgatcgcccctcgccgtcctccgccatatgttgtctccgagggggagcttcgcctgcgcgatggtgccggcccgcgggagcatttatgtggccggtgggggctcaaggcatacgatgtttgggccagcggggtcgaggattcggtcggtggagcagtacgaggtagggagggaccggtgggtgctgatggagaatctccccgggtgcgtggggtttgtcggagaagaaggaagggagttgtgggtgataggaggggatgcgatagtgatgggagtggagagtggcacttggagagagttggggatatgtcggggaatagggagagggtcggggttgggaagattgtggtggttgaatataatggatgtcccatgcttttcatgcttgatagaaatgagattttgaggtactttctctaa

SEQ ID NO: 52290 - DNA, 612 bp, Glycine max
  Peptide Sequence Number=SeqID_143975
atggagatgcacataaaagccatggagaaagtgatagaagagaatcgcaaagcagtggaatcatggttgagttcgattgaagggatgatacaaaggaatttggaaatgcccatattcgatggtgaggatcttatgagatggttgacaaagatcgaaagatatttccgattactcgctgtaagggaagagaacaagctggaggctataatggtagcgatggatggggaagctctgggttggttccaatggtgggaatcttggaatccaattcattcttgggatggattcaagattgctgtcacccaaagcaagacaatgcaaggattcataggccaatttgagaagtgtgttggaatggtgaaggggttggaggagccatttctggtggaagtgttcctcaagggagtggaggataagaacaaagttttagggaagttacccatgagtaatggtaaagggagtaattttcagaaaaacgttcatttgggacagaattgggtatgggactggcagctagcaaacaataagatagctgatcctactaatgttgataaggatccattggatggcaaggtagaagaaccttccataatttgtcacccatggaagtaa

SEQ ID NO: 52291 - DNA, 861 bp, Glycine max
  Peptide Sequence Number=SeqID_143976
atggcttcagtagcttcatcatcatcattttctacaaggcttcttctgcattcacacacacctctagtatgcagaagaagatgcagacccaattttctgaggatggtgactcgctcctgtctcgatgacagctctgctctcctccgagcagcgcaacacactgtggatacatacgtgaaaagtggcatggttgtaggattggggtctggtcatgcttctggtatggccattcagcatttgggtagccagcttcgcactggtaatttgaaggatatagtagggattcccatgtctgtttcaagtgcaagtgaggcagcaaaggctgggattccattggatacctaccaaggaagttctcaaattgattttgcatttgatgatgctgatgttatagaagaaggaacacttgttgctatcattgggcgccggaaattgcaaggtggggaatccataatccaggaaaagtctataataaattctgccaataaatgtgtgttcattatcgaagaaaaccagtacaaaggaggtctggaaggttctattccagttttaattcagtctctcaactggatgacaattgctgaagagattgatgatatgtttctgggtgatgctgaggtttcactctacatttactcttttgctgagtttttacacatgaatataataaagaatgttttatctggttgcttgcttaccaacccaaaaaaggcttttctattaaatgatttaggattttgtaatgttccacaacaacaacaacaacaattcaaagcttttgccactaagtggggttggctccatgcatcaaacatgccattgtgttcttaccttaaccaattcattggagaggctatttaa

SEQ ID NO: 52292 - DNA, 441 bp, Glycine max
  Peptide Sequence Number=SeqID_143977
atgaagcagggtgggagtgacaatttcagtggaggagaccattgtttgataatcataccaagcacaccaagcgtggactccaacatcacatctatcaccgccatggatctcaatgaaatccatggaggagttgtgcaactcaaagacatccaacaatgggaagggtggttccaacgacgagaagagcagacatcaacaagaaagaagggggaaagtatgagagaggagggctatagagtaaaaggccaaatttcttcccaaatcttctcatctgagagtggaagtctaaagcaatggaccccatgcaattttcaaaaatttcttgcctatctctacgcaaacaaattggagaagtgcagggaagtccatacatttagcttctcctcttcttacatatttaggtgcaaccaaatgatctcaagagttgatttgattgtgtga

SEQ ID NO: 52293 - DNA, 135 bp, Glycine max
  Peptide Sequence Number=SeqID_143978
atgatagtggtggtgaaaatgatggtggttgtggtgatagttgtattaatggtgataacgagatgtgatgacaacaacaacaatgatgattgttgtggtgatgatgatgatgaagataagacaatgacgatgtga

SEQ ID NO: 52294 - DNA, 891 bp, Glycine max
  Peptide Sequence Number=SeqID_143979
atgagaggaaccattggaagaaagatcccaaaccccgatttttccaatgccactagaaaaatgctagttccattctctatatcttctggttttggtggtggcggacgtggtcatggtcgtggaggctctctccctggttcagggctgttcaatatcaatgaaagagctccagttaagcctaattccatactttttaatggtaaggatgatggaagtgatactggaagagaaagagaaaatagagggagaggtgggtttgatcgaggcaggggcagaggaagaggttcagagaaggggaaggggaaggtcagagagaaggatgtggatgaaaaggttatggatacagatgattttgctacagggctatataaaggagaagatgcagatggtgaaaaattagccagaaagattgggcctgagataatgaatcagttgactgaaggatttgaggagatgactagtagaattttaccattggcattggaggatgagtttttggatgcactagacatcaattatgcaattgaatttgagccagaatatttggtggagtttgataatccagatattgatgagaaggaaccaattccactacgggatgcacttgagaaggcaaaaccattcttgatgtcatatgaggggattcaaagtcaggaagagtgggagattgttgatcactacagtggaccagatagggtaactgcaaagaagcaacaagaagaattagacagagttgctaaaattcttcctgaaagtgcaccatcttcagtaaaacaatttactaatcgttctgttatttctcttcagttgtttccctcttatgttgataatcttattataagtatctctgccaatgatgttctattgcttgctcatgcagttcagtgttaa

SEQ ID NO: 52295 - DNA, 1535 bp, Glycine max
  Peptide Sequence Number=SeqID_143980
atggacaattaccaaggtgacttaactgacatactccgagccagtggtggagcatatggtagcacaggcacaggcacaggcacttcatcatctgatcaattacctactacatctcatcatcttcatcatcattcctctcacaccaccctctctcataatgatcactggcaccaccaacacttctcttcttcttcttcttctgatcccatcactttctcttcttcttcttcttcttcttcttcggtgctaattcaagaccctatgagaggagccacaaactttggtgatcctttctcaatcatgagagatcccttccttcaggtgcttgacatgccttcttcagcttctgcctacttcactggtggcttggaattagaagcagctgcaacttttggtgctgcagtcaatactaattctaatactgctactagttctactactaatactaatactactaccactactgtttttgctgctgcacacaagatgcttgtggaacatgacaacaatagcatgagaaggccttgtaaaaacatattctcaaacatgattcagatctctcccaatgcaaagttaccagtctcaccctatgattccaccaccacagccatggcaccttctccaaggccaattaagcctcctgctgtggtttcacccaacattatgctgaatgcaaacacctccaaggagtgccttgtggacaccacaggaatgcagatctcatctccacggaatccgggtcttaaaagaaggaagaaccaggctaaaaaggttgtttgtattcctgcaccagcagctacaaacagcagacagactggagaggtagttccgtctgatttgtgggcttggagaaaatatggtcagaaacccattaaaggttcaccttatcccaggggttactacagatgcagcagctctaagggttgctctgcgaggaagcaagttgagaggagcaggaatgatccaaacatgttggttatcacatacacatcagagcacaaccatccatggccaactcaaagaaatgctctggctggttcaacaagatcacagccatccaagaacaacaacaatgctgcttccaattcaaagaattcagaaggctcaaacccccaaaagggcacagctacaagaacaaaggatgaagaagagagcaacaataataacaatagtgagggaaatgtgtccccagttatggctgggaactcatcaaacagtgtgaaggaagagaatatggaagacatagagaggcatcagattgagatggatgagggagagtttagtgatggactcccttataagcctagtttgatggatcagagtactaataaccaacaatctgaggacttctttgctgagttgggagaaatagaagctgacccacttgaccttttgttcacacagggttttggtggtgctgatgatcaaagggaatccaagtccttagatccatttcatctctttgactggtcaggagacaacaacaccaacaccaacacaagtagttcatttgaagaacctaataataagagaag

SEQ ID NO: 52296 - DNA, 702 bp, Glycine max
  Peptide Sequence Number=SeqID_143981
atggatccagctgaaagagacgctgcatttattaatgaagcattaaagaaggaaacaccagattacaaagtaattgttgagattgtttgcactagaacatcagaagagtttcttgctgcaaagcgttcataccagtttcaatacaagcattgccttgaagaagatgtggcatccaaaacaatcggtgatattcgcagattgttggttgcagttataagtacctataggtatgatggagacgagtttgatgagaatctggctcatttagaagcaaacattcttcatcaagtgatcgaaaacaaggcctttaacgacgatgaaatcataagaattttatgcacaagaagtaagaagcagctatgtgcaactttcagtacctttagaaatgtgtatggcacgacaattaccaagggattatcaacaaatccaaatgatgaatacatgacagcactgcgtactgtcattcgttgcattaagaaccctcgtagatacttggctaaggtgttatgctacgccttgaatgaattgatagctgaagaacatgaattgagccgtgtaatcatcactcgtgcagagagggatttaaatgaaatcaatgacctttacttcaagagaaatggtgtcacacttgatagttccgtggctaagaagacatcaggaaattacaagaattttcttcttgcgttgttaggaaacaattga

SEQ ID NO: 52297 - DNA, 921 bp, Glycine max
  Peptide Sequence Number=SeqID_143982
atgactcagttgagcacatccacgactccgttcagctcaagcctatcattgccctcaaaaactgcattgcctgggatcccaatgggtccattcctatctttgcagtgtcaaagaggggatagagatagatgtgcacatgaaggttgcaatatttatgaagcaatatccatttttgaggagtttacgggtcccaaatacaatcttccttggtttaggttgacaccggaagctgctgagattgacagggatgagaagagagtatatgaagaatgcagggaggacttaaggtccaggttgaggaagatgatattgatgaccagagagcatgttctacctttaaagataattcaggggatgcagtggtatttggggttgcttagtgattttctgcagcacccagaacaaaatcttgatgaatctttcaggtttgtagacatggaagatggattgaaggggttggctcttgacagtggagaaaagatttattctttaatggaaaaaaatgccacaaaaagagataaaagacttgtgggagttctccatgagctactttccctttttgttgagcattcagccgagaggaagaagttgttttgcctcaagaagtattttgggttgccacagaaagtgcatagagcatttgagcggcatccccatatgttttatatatctttcaggaacaaaactcgtacagtcattctaaaggaagcttacagcaataaatcagctatagagaagcatcctctgttgagggtcaggaagaagtacatcaagttgatgaagaaatcggaagtgattttaaggaacaggagggtgaataatcgattttctaattgtaatgcaaaattggatatagattcaaatgatctaggtgaaaagggacatgagatgtcaagttgctctttggaacaggttgcgtga

SEQ ID NO: 52298 - DNA, 2760 bp, Glycine max
  Peptide Sequence Number=SeqID_143983
atggctacaaccactgtcatcactccactactattctgtatctgtgtttgtcttggcttctgctccagttctttgtcagaagcaacaccagttggttatggctacatcatctcaactgttaacagttatcccataagcgtctctttggctgcaaaccttaaactcatcaaaccatcctcggttttcggacccgacattccgcacctctctcttgctgccagttttgagaacaaggatagattgagagtaagaatcactgactccaacaaccaaagatgggaaataccccaacaagtccttcccagagggtccccttcccaatattaccctctttactacttcaataccaaccaaggtttccaacactctctcagtctcacacatccagactcagaccttgttttcactctccacaacaccaccccatttggcttcacagtctcgcgcaaatcctccaacgatgtcctcttcaacacggcacctaacccttccaaccccgaaacttttcttatttttaaggatcaatacctgcagctctcttcctctcttccatcacaaagagcctctctattcggcctcggggaacacaccaagagctccttcaagctgcgaccgaaccagacccttacactgtggaatgcagacattggaagtgacaacttggacgtgaacctttatggctctcaccctttttacttggacgtgagatcaccctccgctgatggaacagtcaaggctggcaccacacacggggtgttgctactcaacagcaatggaatggatattgtgtacggcggtgatcgcattacttataaggtcattggtggagtttttgatctgtactttttctctggatcctctccagaactggtgttggagcagtacaccgaactcattggcaggcctgctcccatgccttattggtcctttgtatgtctattcatgctgatcctcattggtatgatctttcttggtcgggaaggttttcatcagtgtcgatggggctacaagaatgtaagtgatcttgagggtgtggttgacaactatgcaaaagcaggtataccccttgaagttatgtggacagatattgattacatggatgcatacaaggatttcacattagatcccatcaactttccgctggataagatgataagttttgttgatgctcttcacaaaaatggtcagaaatatgtgcttatcttggatccaggtatcagtgtaaataagacggatgcaacctatgttagaggtttgaaggctgatgtctacataaagagaaatgaagtcaattatcttggtgaagtttggcctggaccagtttattacccggattttctaaaccctcgcagccaagcattttggggtggggaaatcaaattatttagggaccttctttcttttgatggtctttggcttgacatgaacgagttatctaatttcattacttctcctcccaatccatcttctaatcttgataacccaccctacaaaattaacaatggtgaagttcaacaatccattaattacagaacagtcccagcaacatctttacactttggtaatatcactgagtataatgcccacaatttgtatggactactagaatccaaagtcactaacaaggcattggtggatataactggtaaaaggccattcatcctaagtagatcaacttttgtaagttctggtaagtatgcgtctcactggacaggagataatgctgctacatggaatgatttggcatactcaattccatcgatattaaattcaggaatctttggaattccaatggttggagcagatatatgtggttttggaggaaatacaactgaagaactttgccggcgttggatccagttgggggcattttacccctttgcgagagatcattcagagaaaaactccatcaggcaagagctttacatttgggattcagtagcttcatcagctaggaaagtgctaggcctccgatacagtcttctcccttatttctacacactaatgtatgaagcacatacaaaagggactcccattgcaagaccccttttcttttcattccctgaggatgtcacaacatataaaataaactcacagtttctagtaggtaaaggggttctggtgtcacctgtactacaatctggggctaccactgttaatgcatactttcctaaaggaagctggtttgacctctttaatgtctcaaattcagtgaatgcagaatcaggaaagtatgtcactcttgatgctccatctgatcacataaatgtgcatgttggggaaggtaatattttggccttacaaggagaagcaatgacaactgatgctgcccgaaaaactgcatttcaacttgtggtggttatcagtagcagcagagatagttatggacaagtgtatctggatgatggggaggcacttgacatagcaggggagaatgatcagtggacattggtaagcttttatggcacattacacaacagcagtgttatcgtaacatctaaggtcactaatggaatatttgctctggaccaaaggtggatcatagacaatataatattcttggggatacctaagtatcagagatttaatggaatggatttggcagggaatgagttgaatattgtgaaaggcacggattcaatgaggacggcagttgtgaagtcagaatctgatagctcctctcaatttcttaatgtacaagtttcaaaattgtcactccttattggagaggaattcaagctggagattgaaatcaagtag

SEQ ID NO: 52299 - DNA, 192 bp, Glycine max
  Peptide Sequence Number=SeqID_143984
atgggaaaccactatgttgtcgcgaagctaagtggtgcgaggactgtgagggttgtgtcgctgcaaagtgcaaaggtgttagcaatcattgtttgctaccacccgaatcaatgtgacaaaaatatgaataagataagtgaggtcctgatccaaggaggagaaagaggactgcaaagggttgttctgtcttaa

SEQ ID NO: 52300 - DNA, 1911 bp, Glycine max
  Peptide Sequence Number=SeqID_143985
atgggaaatcccagaagacatcattcccatttcccagaggctcctcttgccaaaattaatgaccttcttggctccctcaatagcgaaaagcctcagcctcagccacaagactctccttcaaatctcacactaactcatccagactcagaccttatcttcactctccacaaaaccaccccatttggcttcacagtctcacgcaaatcctccaatgatgtcctcttcaacaccacaccagacccttccaacacctcaaattttcttatttttaaggatcaatacctgcaactatcttcctctcttccacctcaaagagcctctctttacggtctcggtgagcacaccaagaaatccttcaagcttcagccgagcctcctcaccatgtggaatgcggacattcctagcgccaacgtggacagcaacctctatggctctcaccctttttacatggacgtgagatcaacctcctccgatggaagagtgaaggccggcaccacacacggggtgttgcttctcaacagcaatggaatatatggacgtcgaatggatgcatataaggatttcacgtttgatcccatcaactttccaatcgaaaggatgaaaaattttgttgacactcttcaccaaaatggtcagaaatatgtgcctatcgtggatccaggtatcggtatcaatgacacgtacgaaacctatcctagaggtttaaaggctgatgtctacataaagaggaatggaaccaattatcttggtaaagtttggcctggaccagtttatttacctgattttctaaaccctaccacccaagatttctggggtggggaaatcaaattgtttagggaccttctccctgtcgatggtatttggcttgacatgaatgagttggccaatttcattgcttctcccattgaaaattctactcttgataaccctccctacaaaattacccatgcaacaaacaaggcattgacgaatataactggtaaaaggccattcatcctaagtagatcaacttttgtgagttctggtaagtatgttgcccactggacaggagacaatgctgcttcatggaatgatttggcatactcaatccgggctatattaaattccggaatctttggaattccaatggttggagcagatatatgtggtttcttaggaagtacaaatgaagaactttgccgccgttggacacagttgggggccttttacccttttgccagagatcattcagacaagaactccaataggcaagagctttatctttgggactccgttgcagattcagctaagaaagtgcttggcctccgttatcgtcttctcccttatttgtacacactgatgatgtcacaacttaacgaaataagctcacaatttctattaggtaaaggggttctggtgtcacctgtgctaaaatctggagcaaccactgttgatacatacttccctaaaggaaactggtttgatctctttaatttctcgaattcggtgaacggcgaatcgggcaagaatgtcactcttgatgctccatccgatcacataaatgtgcatgttggggaaggtaacattttggccatgcaaggagaagcaatgacaactgaagctgctcggaacactacttttcaacttgacatagcagggacattggtaagctttaatgccacattactgaacactactagcgttcttgttacatctaaggttaccaatggagcatttgctttggacaaaaagtggatcttagagaaagtaactgtgttggggatacctaagcaaagcaagaatttagcaaggaaaaatttgaaatttgtgaaaacacaaaatgatacctcctcacagtttgatattgtggaagtttcaaaattgtctcagcttattggagaggactttaagatggacattaaaatcaggtaa

SEQ ID NO: 52301 - DNA, 1512 bp, Glycine max
  Peptide Sequence Number=SeqID_143986
atggcaaaacctagtttggcctatcttttcactgcttttgtttttctgtctgtttcaacttcgtcggcacaacccccaaatcccccactctctgacactttcctttcgtgcctcacacagcatgcaaactcctcaaccccacactccaacatagtttttgacaataccaaccctaacttcaccaccgtgctcccaaactacatcgctcgtttgaacacccccttgacgccaaagccgttactcattgtcactgtcctccaagaatcgcacgtccaggccactgtaatatgcgcaaaaagcaccaacgttcaactcagaatcaggagtggaggccatgattatgagggcctctcgtacgtctcccagaatccctttatcctcctcgacatgttcaaccttcacagaatcacagtggatgtaaaaaacgaggttgccatgggccaagccagtgccacgctaggcgaggtttattataggatctgggacagcagtaaggtccatggcttccccgcatcagtgtgtcccattgttgccgtcggtggccatatcagcggaggagggtacggtaacatgttgagaaaatatggcttatccgttgataatgtcatcgacgcgcaaattgttgatgtcaaaggaaatcttctaaacaggcaaacaatgggggatgatctcttctgggctattagaggaggcagagtagcgagttttggtgtcgtagtgttgtttactattaaaattgttcccgtgcctgaaacggtggcgccaacaactgatgacaggcttttcatgaggttactattggcgccctcagggaaaaccgttagagcctctgttatggctttgttcctgggagaggctaacgaggttctgccaattttggagaaggagtttccgcttctagggttaaagaaggtgaattgcactgaggcgcattggattgattctgttgcctggtttaacgacgatcagggttctaaaaatggtgccaaacctgaaaccctattgaatgctaatcccagagaaggattggagattatatggaagaagatgattgaattgggggaaatgggacttgtgttcaacccttacagagggaaaatggctcagattccttctgatgcgacaccgtttccacaccgtaaggggaacttgttcaaggctcggtactcagtgagctggaaagatccttcacctgcagcggctcagaatttcttaaatcagactagggagctgcacagttgcatgaccccatatgtgtcgaagaatcccagaagtgccttcttgaattatagggatcttgatattggtgttaacagctttggtaagaatagctttcaagaagtttatggggccaaatacttcaatgacaatcttcagaggcttgtcaaggttaagactgcggttgacccagaaaactttttcaggaatgagcagagtattccttacaacgtgaagaacgatctttggcatgctgatggttcatggttcgaagttgcatatgtcttacactaa

SEQ ID NO: 52302 - DNA, 1614 bp, Glycine max
  Peptide Sequence Number=SeqID_143987
atggaaaaaccaagtccattggccactattatgctccccattgttattgtgcttttgctttcaccccatgcatcatatgctgcccaagcaacagaatcagtatatgaaacttttgttgactgtctaagaaactacattaactcccccaacatctctaacatagtctttgcccaaaccaactcttcctattcttccattctccgtgcatacattcgtaatgcccggttcaacaccacctcttcaccaaaacctttaatcatagtcgcaccagtgcaagaatctcatgtccagactgccgtaatctgtgcagaaagcattgatatgcaaattaaaacaagaagtggtggccatgactttgaaggcctctcatacatctctgatgagcccttcatcatgcttgacatgttcaacctccgcaacatcacagtggatgcgcaaaacaaggttgctgtggtccaagccggtgccacacttggcgaactttattataggatttgggagaagagtgatgttcttggctttcctgcaggggtgtgccacactgttggtgttggtggtcatttcagtggaggagggtatggtaacatgatgagaaaatatgggttatccattgatcacatcagtgatgctcaaattgttgacgtcaaaggtaggattctaaacaaggagtcaatgggggaagaccttttttgggctattagaggaggtggaggagcaagttttggtgtcatattatcatacacaattaagttggttcctgtgcctgaagttgttactgtttttcaggttgagaagactttggagcaaaatgccactgatcttgttgtgcaatggcaacaagttgcaccgtacacggatgaaaggcttttcatgagactgcagttacaccccatgatttcgaacgtcggagagaggcacaaaactgttagagccgcggttatgactatgtttctgggaggagcagaagagcttgtgtcacttttggacaaaaagtttccaactttgggtctaaagaaggagaattgcattgaaatgagttggattgagtctgtggtttggtgggatagttttccaaatggtgcccacccagaagctctacttggcagaaatctcaactcagcaaagttcctcaaaaggaaatctgattatgtgaaggatccaatttccaaagacgggttagaatggatatggaaaaggatgattgagttgggacaaacaggtatggctttcaatccatatggcggaagaatgaatgagatttcagcaaatgctacagcatttcctcaccgagcaggaaatctgttcaaaattgagtattctgccaattgggaggaacctggaggttctgcagagaagaactttacaacacaaattagaaggttacatagctacatgacaccatttgtgtccaaaaatccaaggagggcttttctgaattatagggaccttgacattggtattaatcaccatgataacaatagctaccaagaaggggaggtttatggttttaagtacttcgatgacaacttctatagactggcgaagattaaaactgaggttgatcccggaaactatttcagaaatgaacagagtatcccaacgctaaaattgtga

SEQ ID NO: 52303 - DNA, 123 bp, Glycine max
  Peptide Sequence Number=SeqID_143988
atgagggagaagagcatgttgtggtggtgtcgagagaggaaaggggaagtgaaagggggcgagtgtgttgcctgtgtgagggagaagagaaggtttgggcgtgaaagagaagagagggtgtga

SEQ ID NO: 52304 - DNA, 1128 bp, Glycine max
  Peptide Sequence Number=SeqID_143989
atgcagcagaaaactatgtcatacgcagagttttgcagcaagtcacaacccaacatcaaccttggtggaatcatcgtcaatgtaaaaaacgaggttgccatggtccaagccggagcaacacttggagaagtttattacagaatctgggagaagagtaaagttcttggcttccctgcaggggtgtgtcccactgtcgatgtcggtggccatatcagtggaggagggtacgataacatgttgagaaaacatggattatctgttgataatgtcattgatgctcaaatcgttgatgtcaaaggaaatcttctaaacagaaaaacaatgggagaagatcttttttgggctattagaggaggtggaggagcgagttttggtgtcatattgtcgtttacttttaagctagttcccgtgcctaaaacgcaggtggcgccaaccactgatgagaggcttttcatgaggctgttattgcagcccgtgagttccaaggttgtgaagggagggaacaccattagagcctcggttgtggctttgtttctcggaggggctaacgaggttgtgccgattttggcgaaacaatttccgcttcttgggttaaggaaggagaattgcactgaggtgagttggatggattcggttctttggtgggacgatgataagagtctgaaaaatggtgccaaacctgaaaccctattggataggcatgccaacactgctgatttccttaaaagaaaatctgattatgttcagaaagctattcccagagaagggttggagtttatatggaagaggatgattgagttggggaaaacggggcttgtgttcaacccttatggaaggaaaatggctcaggtttcttctatgcgacgccttttccacaccgctaggaagctgtacagttacatgaccccttttgtgtccaagaatccaagaagtgcctttttgaattatagggaccttgatattggtgttaacaactttcgtaagaatagctttcaagaaggggaggtttatggggcaaagtacttcaatggcaattttcagaggctcatcaaggttaagactgtagttgattcgacaaactttttcaggaatgaacagagtattcccctagctccgagcaaagcatag

SEQ ID NO: 52305 - DNA, 1497 bp, Glycine max
  Peptide Sequence Number=SeqID_143990
atggccttttcatctggtttagaagactcaaactcaactacagaagtaatactcacccaaagcagctcttcttacacatcccttttgcaatctttaataaggaacctcagattcttgaacagttcagtcccaaaacctaacctaattgtcactccacaaaacctagcccacattcaagcagcaattacttgttcaaggaaacatggcctacaagtgagagttagaagtggagggcatgactatgagggtctttcttatgtctctgatgttccattcctcatcattgatctcataaaccttaggtccataaacattgacattaatgatgaaagtgcatgggttcaagctggtgctactcttggggagctctgttatgcaattgcaaaaacaagtaatatgtgtggcttcccagatggtagttgtcccacagttggtgtaggaggccacttgagtgtagttggatttggcacaattttcagaaaatatggccttgcagctgatcaagtaattgatgctgaaatggtagatgttaatggaaacatactaaatagaactttgatgggggaagatcttttatgggacataagaggtggtggagggtcaagctttggagtgatcactgcatggaaagttaagcttgtacctgttcccccaaaagtgacaattttcaatgttgcaaaaacacttgatcaaggtgcaagtaaccttttccaaaaatggcaaactatttctcacaagcttcctaatgaactttttcttcactcagttatgggagttgccaattcatcatcacctaatggtggaaaaactgttgtggtttctttcactggattgtatctagggacagctgagaacctgcttcctttgatgcaaaacaattttgctgagttgggtttgcagctcaacagcttcactgagatgagttggattcagtcagttctttacaaatacagattattcaatcaatggacccttggaggttttgcttcagagaaaccaaacattcagaagcttcaaagcaacatcagactatgttacagaacccattcctgtggcaggtttggaagggctgtggaacatgttgctcgaagagaacacagtcaacacaccaatctgatcctgacaccatatggagggagaatgagcgagatttcaggatcagaaactccatttccacatagaaatgggagcatatatgggatccagtatttggtgtattgggactcaaatgaagaaacaccaaagcacatatatgggatgagaagattatattcatacgtgacaccttatgtttcaaagtgtccaagggctgcatatttgaattatagggaccttaacctaggagtgaaccgaggcagcacaagctatgaagaagcaaaatcttggggtgtgaagtattttaagtttcattttgaaagattggcacgagtcaaagctgaatttgatcctagcaatttcttctggcatgagcagagcattccaccttcgtttaattaa

SEQ ID NO: 52306 - DNA, 918 bp, Glycine max
  Peptide Sequence Number=SeqID_143991
atggttgtgcagaactttgtagttgatttgaataaggcccttgttttccaggttgggcatcttggagaagcttatgaagagtgggttcaccagcccattgtcagcaaggaaggcccccgtttctttgaaaatgagattctggagttctggaacttggtgaaactcatggcgaccacttcaactgctcctgctttgtttggaggtggtttattgggttatgtaatgtatgattgcacccattattacttgcaccatggtcagccaaggactgaagtgccccgaaatctcaagaagtaccacttgaatcatcactttcggatccaggataaaggctttgggatcacttcatcactatgggataaagtttttggaacacttcctcctaaaatggatgccaaaaccaaatatggatttggctgccaacctgtcccagtcattcgaaatgaaactgaagcctctcatacttggcgtgggatcgttatgacatggagtcatattgaagataatatcacctggagtattaataatggtgattcagcccgtttctggactgaccgttggattcctggtttccaacctctctcttctatgatgcagaatgtttgttctaccattgctgcaataaatccacctgttcaaggttacaaagatactccaatatggtgtacctcgagaaatggtatgctatcagttaagactgcatattggtatcttgcaggttattatgataatcccagggatgagtctggagatttcaagatgatttggagatatgaaggccctcagagagtttgtttgtttctatggaaattgatgcatgggaggttgctccctaatgaagaaagaatccgtcgccatatgacaaatgacagtgctagaatccattatgcacattctgtgattgtgaagacatcatga

SEQ ID NO: 52307 - DNA, 1164 bp, Glycine max
  Peptide Sequence Number=SeqID_143992
atgccgtttccgtggaagaaaaaccgcgtcccccgaatctcccaaatcgtcgccgatctccaatcgcccaaacgcggcggctccctcgtcgtcgagaccggcttccccacctccctcatcgaccttttcgtcaaaaaccgaagtcgcttccaaaaacaccgctccaaaaaaccaccgccgccgccgccgccaaaatccctctccgccaccgatccgcctcccccgccgcctccctctccggccacctctccgccgccacgcgtccccacctttccagccactccaatacaacaaaacgacaccgccgtttcggctccggatcgaattgcccagtgctctccccggtcgggtgtgaacgctgtcgttctcgtcgcgaagattctgatggtgttggttctggtcgcgagcgtggagaggctcaccgtcggaatcaccgcgtcggcgttctcccttctgcttctcgaatacgcaggccggcgcgtcgtggtttcgtgttctgttccagaatcatggtggttccaaaaggttgggatgaaggagcgtgttgaaagaattgaatttgaatccgaggaattgagcaacaagggtttgtcaatcgatgaaattgaggatgtggaaacaaccgacgaagtgggtgttagttgcgaaattggtgacgtggcattgaaggttttggagccgtgtttatgtgatgaagatgtttctgaatgcaagattagacctagccgaagtggtaggtttaggtccaagatggtgaagcttgtttctaagaaatttcgtgggtctaagaaagagaaaaagggtgaggtgaataaacacaatgagggtgagtcagggagtgaaatttcaagcgctgtgggggaagaaaagttaccaattttagaaattgaagtagaggaagagaatggggataataagtcaagtaacagtaaacttgattgtggaatcacttgttcctatgataatgagaagagagtggaaagagttgggaattcaggttcttccatggttttagttatgattattgcccttgttgggcttcttttggggcgcttcccagcattggttcttttgatgacatggtgttgcttgatgaagatagttgggattctatggagatcacagaatgtgcctatgatcaagtgttctgtttcaaactcttga

SEQ ID NO: 52308 - DNA, 1233 bp, Glycine max
  Peptide Sequence Number=SeqID_143993
atgttcaatatgagatttgtatctcaagattgggtggtttcatgtgcactaatacttctggtgtcatgcacaacatactcatcagcttctttggggaaacctgagaacaacataaaaacatctgtttttctatcacccaagattgagctaggtccagggttagtttcaaacaaattttattttgatgttgactttccaagaggccatattgcactcaagagtttcaatgctgaattggttgatgagtcagggaaatcactgcctctccaagaaacctatctccatcactggtttataataaaataccaacagccaaaaaatgtgacacacaataacccaacagataatattgtttatgtgagaaacagtggcttttgccaggatggtcctcttatccagtattttggtcttggatcagaaacaagaggaactgccactgatattccagacccttttggaatagaagttggaaacccttcagatattccatatggatatgatgagaaatggttgatcaacgtgcatcccattgacacaaggggtgtggaagataggttggggtgcattgagtgtaggtgtgacctttataatatcacaaaggatgcagatggtaaccctttgagtccagattataagggaggtttggattgttgccctgataataccacgtgcaggctaaacaaaggcttcaagggtccaaagagaaccttataccttaaatacacagtgaagtggttcagttgggacaactacgtggtgccccttaagatttatatacttgatgtgactgatgttttgagcgtgtccaaaggagtaactccaatgcataattgcgaggttgagtatcaggttgaaccttgcagcaaaggctacagtagtagtgcttgcattgatgtcagaaaaacaagcttcccaatgcaaaatggtggatatgtaatctatggtgttggtcatcagcatgtaggtgcaattgcatcaaaactatacggacaggatgggggagttatttgttcttcaataccaaaatatggaactggaagtgaagtaggaaatgagggagggtatgttgtaggaatgtccacatgttaccctcgaccaggtactatcaaaataaaagatggtgaaaccctaactctagagattatctacagcaacagcgaaatgcacagtggagtaatggggcttttctacatcttggtggcagaacaactgccacaccaacacctcctttga

SEQ ID NO: 52309 - DNA, 1242 bp, Glycine max
  Peptide Sequence Number=SeqID_143994
agtgggaagaatttgaatgttggagaggatgaattgcaagagatttcagaggatgagatagagctcgagagacaggaagaatatgagtacagatttcaggaaaatccaggagatagggtgttgggtcatgctcggaaggtggagggatcagtgaggaagaagacgaatgcaaggaaagagcagagaaagagcaaagaggagagaatggctatagaacaaaaggagagggaggaggagttgaaacgcttaaagaatttgaagaagcaggaaatacaggagaaggttaaaaagataatgaggggggcagggatccatggtgatgatattattccattgtccatggcagaaattgaagaggaatttgacccagaggagtatgatagaatgatgaagaaggcatttgacgagaaatattataatgcagtggatgctgaccctgacttttgtagtgacattgatgacaatgagaagccagattttgaaaaggaggatgaattacttgggcttcctaaaggctgggatgcatgcggatctaatggtgggtttttagctgcaagggaaaaagcactgaaagaaaagattgagaatactagtgatgacgatctccctgaagcagaagatgaaaaagaaaggtttgagaatactagtgatgacaatctcccggaaggagaagatgaaaaagaagagaaaattcctgaggaaggtagtcggaagaggaagcgcaaaacagcacttttggagaaagcaagacaggcaatgatggatgagtactataaattagattatgaggacacaattggggacctgaagacaagattcaagtatgccaaaacaaaaccaagtagatttggcttgagtgcctcagagatactattgatggatgacaaggaattgaatcagtatgtttccttgaaaaagcttgctccttaccaggaggaggaatggaaactaagcaaacagaaaagatacatgctgaagatgagggctaaggagctccttcgcacatcaagtttggataagaagaaaaggaagaagtcaaaggttgattctggcaagataacttcatcaaaaagtgttgtggagaacgaaaaaccaagcacagaagaatcaaatattaatagggataatctatcaaggaaagccaagagaaggcggcaagtggctaatttgaaattatcacaatcgaggcttaaagcatatgggaagattccctcaaaatctaagcatggaggaaagcactga

SEQ ID NO: 52310 - DNA, 824 bp, Glycine max
  Peptide Sequence Number=SeqID_143995
atgcctcccaaatctgccaaatccaaggaagctccagctgagcgacccatcctcggtcgattctcttctcacctcaaaattggcattgttggcttgccaaatgttggaaaatctactctctttaatactctcaccaagttggcaatacctgctgagaacttccccttttgcaccattgagcctaatgaggcgcgggtcaatgtacccgatgaacggtttgagtggctttgccaattattcaagccaaaaagtgaggtctcggctttcttagaaatccatgacatagctggattggtccgaggtgctcatcaggggcaaggattggggaatagttttttatctcacatccgtgctgtggatggcattttccatgttctacttattaacctagagccttgctgcttgttaggtgcatttgaggatccggacattattcatgttgatgatactgttgatccagtcagggatttagaggtcattactgaagaattgcggctgaaggatattgaattcatggaaagaaagatagaagatattgagaaaagcatgaagaggagcaatgacaagcagctaaaaatcgagctcgaatgttgtcaaagggtgaaggcattgcttgaggaaggaaaagatatacgtctaggggattggaaggctgctgatattgagattttgaattcctttcagttgctaactgccaagcctgttgtatacttggagcacgggggtgagactattattcctttcagctgtgccttggaaaggaatcttgcagatatgccaccagatgaagcggctaagtattgtgaggagaacaaaactcaaag

SEQ ID NO: 52311 - DNA, 129 bp, Glycine max
  Peptide Sequence Number=SeqID_143996
atggataagagctttaaggtagaaaaagaagagtggagggagagggatagaaggagcatgaaatttagtgcctcaaatgagcccactaatccaagatcaagtccaagattctccactaagtgtgcttag

SEQ ID NO: 52312 - DNA, 630 bp, Glycine max
  Peptide Sequence Number=SeqID_143997
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcatctgttgggaagggcgatcggtgcgggcctcttcgctattacgccagctggcgaaagggggatgtgctgcaaggcgattaagttgggtaacgccaggggatcgaattcctgcagcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 52313 - DNA, 382 bp, Glycine max
  Peptide Sequence Number=SeqID_143998
gcaggcgcagggcgaaacaccacagcagcctggggatggccggcagcgagcaacagatgcaccgccagcacctctagagttcacctctgctcatccacaaaaaggtttgagtattgcttacaccacatggccgaccaataggcgaccaagtccaaagccaaagggtgagaatgtcaatccttaccctcggaagcaaaaaaagaaaaggaaaattccaatcaaagagaaagcaaaacgaaaagaaaggaaattcccaaccaaagaatgggagaaagtaaaaaaggaaggaaagaaagttcctgatcaaagaaactggaagaaatgtgcagaaaggtcttttgaccagacaatatttgaacaatacagaattgtcaccaaatga

SEQ ID NO: 52314 - DNA, 336 bp, Glycine max
  Peptide Sequence Number=SeqID_143999
atggatactagcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 52315 - DNA, 465 bp, Glycine max
  Peptide Sequence Number=SeqID_144000
atgccgctggcgattcaggttcatcatgccgtttgtgatggcttccatgtcggcagaatgcttaatgaattacaacagtactgcgatgagtggcagggcggggccccgggggatccactaattctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 52316 - DNA, 426 bp, Glycine max
  Peptide Sequence Number=SeqID_144001
atggacgaagatcaatggatctataacagtataatgtctaaagaagttgatatgaatgaacaaaatgaagatgaagctgctataaaatcaaaacatgttgattgttctgatgcgtttaatacttttcaggctcgagttgttgcttatgaaattgattttgtggcagtcattatgaggtcaggcacaaacacaagtatgagaggaatgacttcatttatcttaattggttgtgaaatgagtggtcaatataggtccaggaagaaagattttataagaagaaatactagcagtaggaaacgtgggtatccctttaagctgcgtgaaaaaccagtggttggagaccaaggatggatggtgaagttaatgtgccaaagtcacaatcatgaaatgacaaagacattagttggacatccatgcactgattga

SEQ ID NO: 52317 - DNA, 297 bp, Glycine max
  Peptide Sequence Number=SeqID_144002
atgtcatctctaacggttcctaaaattcctctagtttttcctctgactgctttgatagagttcccaaacgtcagaaaaacggagaaaggattaaagcctccatttggactatcttcatgtgattcctttttctccctccgcgaacattatctcgcaactcccaacggtcaaaacgatcgtagttttaccaagacagctctgggtttctgcgggaaagaaaaatgctacagtgcgaggggtatttctcttagctcagacgtgatatcgaaattcccaacggtgagaatccaacggtga

SEQ ID NO: 52318 - DNA, 195 bp, Glycine max
  Peptide Sequence Number=SeqID_144003
atgaagaaacaacaatggaagagaagcggaagacaaaggagaacaggtgagaggaggcgccatccactagggaataagccatggaagaaggagcttcaccaccaagatgagccttggatacgaagcttggagaggatgcttcaatggaggaaaagaaagagggagagaaagagagaggggggagcacgaaattga

SEQ ID NO: 52319 - DNA, 258 bp, Glycine max
  Peptide Sequence Number=SeqID_144004
atggcgtcagcaatcacctgggccacgtggacgctcatccgtgtggtcatgctggtgcgcatgatccgcacccgcctccctgcagcggtctgggcgaaatcctgccccggtgtgcataacaactgggcaatggcctcctcgtcgaacccattggccctgttcctcctctggctgaactcgcactacttgccttcctccaacactagcgggtcacccaggaactggctgagggcatctacgtcaaagggaatccactga

SEQ ID NO: 52320 - DNA, 501 bp, Glycine max
  Peptide Sequence Number=SeqID_144005
atggtgttatttcgaggtgctccagtggcgtatcatgtttctatcagctgtcccttcctgttcagtactgaacggggtggttatccgcgtaattcggcaaaagcataccgaccggaacatcagcgggcaagtgtagccggggtgcgacgctgcagcgtaccaccacacccgccgcgcttaatgcgtccgctacagggcgcgtccgcattcgccattcaggaaactgcggcaactgcttatgacggaaccgggcgatcgagtgcgggcctcttcgcgtattacccagcggcgaaagggcggatggtgtcagtcacgaagtgcgttcatgtggcagagaaaaaagctgcaccggtgcgtcagcatgaatatgtagatacgactcactatatcgggcgaattccgctcatgagctcctaccgctggtcgtcatgcggcgagcggaaaggctctagaactagggatcccccggagctgcaggaattcgatccaggcaacgattag

SEQ ID NO: 52321 - DNA, 893 bp, Glycine max
  Peptide Sequence Number=SeqID_144006
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggacgtgaaccttgatgggaaaattttcattactctcatccttggcttgacagatgaacacattgcacttttctcagtcagcttttacacaaagggagtcggaggtcccttgcctattgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 52322 - DNA, 492 bp, Glycine max
  Peptide Sequence Number=SeqID_144007
atgaccggacgcctccttgccggttcattggcttttgaaagccgcatccttcattatcttattgtgcagattttgcttccacgatcttccaaccttgcccaggtttctgaggaagatcttgttatcatgtgggcctttcataccaggtgtcaacttgactgggcacatttgagatcctttttaattggtgctgctgtgattgcttcttttggttaccgcaaagagcatgatggctcttgggtcaaaaagggtgctcaacccgctgatgatgaaggcaacctaccagttgaagataattcctctcttcttcgaaagcttttggacaagttcgatggtcttcagacttttgttggtgacaagtttgatgctatggaattgcaagtcgacatgcggttcgatgccatggaatcaaggatcaccaaagttgaagaagatgtctccttcatccgtacttgctttgatccaccaccaccgcctccatcatcctcttag

SEQ ID NO: 52323 - DNA, 507 bp, Glycine max
  Peptide Sequence Number=SeqID_144008
gattttgcacaagtgcagaaaaatgctatgtatttactgggtgtggaaagagcagtgcagagtgagttctggatgtttgcttgtagatcccaacggtcaaaatgtaggcttatgcactatagacttccagtaaaattttggagtcgatccaacgagttctctctgccttgctctgttttgcttggctgtgatagcttgtgctgtttgtatgttgttttgcttggatgttgtggaagcttgggaggattgatgggggcccggggatggtgggtttatacgctcattgtggatgtggaaaacttgttgtgcaccatcgcccgaccgccacctagtaccacatgtgatggggtgaaacttcctgcttttattgttgaccacagagtggtacttggagatatgtcgcgggggtcaggagaccttgggggacgtcaggcgagctcctggcagtcaacagataaaaggaacaaagaccacaaagcaaggaggcttgtggtggctgggccagct

SEQ ID NO: 52324 - DNA, 462 bp, Glycine max
  Peptide Sequence Number=SeqID_144009
gttattcatgattggagtgcgagcattggttatggaccattgtatgggttccttgaacctcagtatatccacaatgcaagcaggagacatcaagagtgtgaaaattacattggaaggtggttgaaggaagcaggaaaacaaatttacatagcaccttatttaaaccaggcccattggcagctcgttgtattgtgcccaggcgacaatgtagtggtttggttttgtgctttgaagaagaagccggatgctgccatcaagggtgcagtaaacagtgcaatgaaatcagtcaccaaaactgcagagggaaagccacctcagcatgggcctcagtggattgaagcaaagtggttttctaatcgatcaccgctaacagaagagaccatgaccacactccggcataaatgggcggcatattttatccaaatgaagaaatgtgaaccaagaaaaaatttgataacttag

SEQ ID NO: 52325 - DNA, 49 bp, Glycine max
  Peptide Sequence Number=SeqID_144010
ggtgaatgctgtgaaaattttcccggacgcccaaaatggactcgaatga

SEQ ID NO: 52326 - DNA, 270 bp, Glycine max
  Peptide Sequence Number=SeqID_144011
atggctcaacctccacctcgtgagaggactctaagggaaatggctacacctgatttcacttatgaaagcttgtgcattcaatacccagatgaggatgtcccatatgttcttaaaactggactgatccacttgttgcccaagtttcatggtcttgcaggactcagtaacatggagagaagtatgatagatgctgccagtggtggagcccttggagacatgacccctgctgaagccagaaatttaattgagaagatggcttccaactcctaa

SEQ ID NO: 52327 - DNA, 465 bp, Glycine max
  Peptide Sequence Number=SeqID_144012
tccatgatgattggatgtggaattacctggattttgtggaagcttgggaggatttatggggacccgacgttgagaggaacgaggataagggctacgtgggagtgcgtgagctcagttggaggtgggcaacaggggatggtgggttatacgtgatttgtggatgtggagaatcgttttgcaccatcgcccgaccgccacctaagtggtacctggagatatgtcgcgggggtcaggagaccttgggggatgtcaggcgagttcttggcagtcaacagataaaaggaacaaagaccacaaagcaaggaggcttgtggtggctggccagctgtgaattttgtgtgatatatgggttgtggcctctggtaatcgattaccaagggcttgaaaacgaggcctctggtaatcgattaccagcctgtgtaatcgattacacagagggatgggtcactggtaatcgattaccag

SEQ ID NO: 52328 - DNA, 181 bp, Glycine max
  Peptide Sequence Number=SeqID_144013
atgtcatttctagcactgttcatgtgtcccccgctatccattatcaagcgtgatacctcaggtagttcgctttgtgctgatgaccaattaaggattaaagacaagagttgtcattttttaaagaggccagacggaggaaatcagtgtcctctctttgctttcctcgtatctccgatgagag

SEQ ID NO: 52329 - DNA, 645 bp, Glycine max
  Peptide Sequence Number=SeqID_144014
atggttaacaagccgagacacatcaaaccattaccgacgcgagacaggataaacatcgtgagcagcattaaactgattgtggggctggccaatcccggggctgaatacgcggcaacgcgccataacgctggcgcctggtatgtggatttactttgctcgcgccataatcagtccctcaaagaggagccgaagtttttcggctacaccgcgcgcctgtcgctggccggcgaggatgtgcgcctgctggtgcccactacctttatgaacctgagcggcaaagcggtggcggcgatggcgacgttctatcgcattacgccggaagagattctggtggcacacgatgaaatggacctgccgccaggcgtggcgaaattcaaacagggcggcggccatggcggtcataatggcctgaaagacatcatcagcaagctcggtaataacaacaattttcatcgcctgcgcgtcggtatcggccatccgggcgatcgaaacaaggtcaccggatttgtactcggcaaggcgccggccaacgagcagaagctgattgacgaggcggtcgacgaagcggtgcgctgcaccgagctgtggctaaaagaagacaagattaaggcgatgaaccgcctgcacgccttcaaagccagctaa

SEQ ID NO: 52330 - DNA, 906 bp, Glycine max
  Peptide Sequence Number=SeqID_144015
atggctgaagaaaaaagaattattacggtgtttggcgcaaccggtcatcagggaaagggcgtggtgcaggcattaaagcgtgccagccagttcagggttcgggcattaacccgtaacccgcaaacctataccggagaggctgatgaagttcagtatgcggatcttgaaaagcctgaaacgctccacgacgcgctgaagggggtacagggcgtatttctggtgactgattactggcaacagggtacagacgagagaaagcaggcggcattcgccatcgaagccgcaaaatcggctggggtaagccattttatctggtccacgcttcccgacgttgaatctgtcagtcagggtgaattcagactcccgcagtttacgaataaagccagaatagacagtctggtcaaagctgcgggcttcacttattacacctttgtcgtgccaccggcatattatcagaacttcgcaggtccttttggtccacaaaagcaacaggacgggagttatggctgggttctgccgattaaccccgacgttcgctgcattcatatgggcgacataaacgagcttgggaaaattgtggtcggcgcgtttgcacatcctgataacgcaggaaaaggcgcttacctgccgcttgtcggtgatttccttagtttcagggaaattgttggcacacttaatcagcttgggcaccccgtaacctttaaacaggttccacgcgaagtctatgcaggttttttcccgggcgctgaagcgttggcggatacgctggcctattacgaaaaatatacctaccttggtccgggttcgcacgaagcagccatagcacaggcagacaaaatcgctgaatttcagccagccacttttaaatcatgggccagagaccatttttcactgaacagcaaatag

SEQ ID NO: 52331 - DNA, 828 bp, Glycine max
  Peptide Sequence Number=SeqID_144016
atgcaggtttttataagggtggctgaggccggaagcttcgtccgggccgcggaaacactttccctgccttcttctactgttaccagcaccatcaaaaacctggagaaatatctgcaggtgcgtctgctgaaccggaccacaagacgtgtcagccttactccggaaggtctgcagtatctggcgcagtgccgggaaattctggccttagttgaacatacggaagccagtctggccgatttgaacaggcgcccccgtggccgtctacgcgttgatatgcctggcggtatagcgcacttcatcgttatgccaaacctgaaagagttctacagccgttatcctgacatttacctgatgatcggcgtcagcgaccggcaggttgacctggttcaggagggcgtagactgcgtgatcagaaccggagagttacttaactccacgcttgtagcacgtcccctcggagaatttcgctggataacctgcgcctctcccgactatctcagggagtacggtattccgcagtcacctgaagatttgtctcatcaccgggctattcattatttttccggacaaagccggcgtacagacgaattgcgttttgtaaagggaacagaaacgctgtccgtatccgtcagcgggcatgcagccgtcaacgagacggggctttatataaaaatgtgccttgaagggttcggactggcgcagcttgctgaaaatgttgtaacagaacacctggagaaaggaacgttggttgaagttctggccgactggcaaccgccgtctgttcctgtcacgctactttatcctcatcaacgttttctttcccctgct

SEQ ID NO: 52332 - DNA, 1410 bp, Glycine max
  Peptide Sequence Number=SeqID_144017
atgtggcgtaaacctgagcaggatttgttcaaagtctgcgatgaacttgatattggctttatggcctacagcccgctgggtaatggattcctgagtggtcaggttaccgctgatacaacttacggggaaggcgattaccggggcatgatggggcgcttcaaacctgaagtaatggaaaataaccaggcgctactggatttgattgctcaaatcgcggaaagaaacaacgcaacttcagcacagattgttcttgcctgggagctggctcagaagccttacatcgtaccgatcccgggaacaacgaaattacaccggctcgaagagaattttcacgccgcaaatgttcagctcaccctggcaaaaggtgcagcatcactgaccgacttggaagtgcgttatctgtatgacctgtatccggatggcaaaatcgacgtggccgctgaacaggctgcactggaaaagacggatcgtatcgtgctgcagtttcctatgcagtggtacagcacgccgccactccttaaacagtggcttgacgatgtactgacgtacggctggtcacatggtggagaaacacaggcgctgcgcgacaagcaactcatgctggccgtttcgctgggtggtgcagagtctgcctatcagcctgatggcgctgccggacatacggtaggcgagtacctgctgtcttttgaaaccatctccgggtatctaggtatgaactacatcaagccgtttattacaggcggaagcgcgacgataactgacgaagaaatcgcagctcaggcttacacccgtggattggtggaagaaagtggtctgtttgccgtacagatacccgtagtcagccagatggaaaccgttttgtacgcaggtgagcacagctaccgtgacaggcctgacaagaatcataaaataccgatgttctacatgaaagagttcgatattccgctggtacagggctgtgctggctggcttgtatgtaaagtaatgccaaacgcggaatacgagctggaacataatctgttcatgggagaaattgccggggcgtggagtgacgatcgggtttttcgcaatgggcactggatatttgatgaagcaccagacgaattacgaaccatacactatgtcgccggggggcagttttatgccatcggcaaaggaacccgctttgaccatgcggcaggcgatgttgcctctgagccagaaggggaagccgcttttcgacgcctgcagcctgccttcctatatgctcctaaagtgacagttttgttctacccaccggttgagttcatttgctgcctgccagagggacgttcccagctccgtgagtgcatattcgactttgggcggtacttcacgaaagacagtgcgcgtaacaagatgcctgctttcgagttccttaagattctgtga

SEQ ID NO: 52333 - DNA, 234 bp, Glycine max
  Peptide Sequence Number=SeqID_144018
atgggggtgcaaatagcaaccaggcctacttgggccctccagaaggctgttgcttctggaggaagcaacctggcttgcctgggcgagctgggcggcaaccatctcccctattttgctataaataggggaggaaccgaggcgcttctgaaacgtttccgtgaggaatttcgcgaaggtttcgaccgttcttcgacgttcttcattcgttcttcatcgttcttcgatcttcaacgg

SEQ ID NO: 52334 - DNA, 156 bp, Glycine max
  Peptide Sequence Number=SeqID_144019
atggaccttccagcttcctatgacaaaagacgagaccaacatacaacgcatgcgttacgacatgatgtagatgtgcgaaagcgcaacaaggggatgtacatagcatggcaaatatcctcagataatcatacagcaaaggcgtacatgaaaattcag

SEQ ID NO: 52335 - DNA, 620 bp, Glycine max
  Peptide Sequence Number=SeqID_144020
agggctacacgtcctcgccttcagaggactacaggtcctcgcttccagaggactgcacgtcctcgccttcagaggactgcatgtcctcgccttcagagggctacacacccttgccttgcctttagagggctacacgccctcgccttcagaggactacacgtcctcgccttcagagagctacacgcccttgccttcagaggactacacgtcctcgccttcgaaggactacacgtcctccccttcagagggctacacgccatcgcctttagaggactacatgccatcgcctttagaggattaaatgtccttgcctttagagggctacatgccctcgccttcagaggactacaggtccacacctttagagggctacacgtcctcgccttcagaggactacaggtcctcgcttccagaggactgcatgtcctcgccttcagaggactgcttgtcctcgccttcagagggctacacacccttgccttgcctttagagggctacccgccctcgccttcagagggctacatgccctcgccttcagaggactacacgtcctcaccttcagagggctgcacgcccttgccttcagaggactacacgtcctcgccttcggaggactacac

SEQ ID NO: 52336 - DNA, 942 bp, Glycine max
  Peptide Sequence Number=SeqID_144021
atggcgagcaggtcgataatgcgcgccagcacgggcatgttgagatggctgccgggatcgacaaacgtggcgaacgataaccccatctgcaggccaatcagctctcccgcggtacgcacggcggcaaacgcgagctgcatggtaaagccgacagcaacgccaatcatcacctgctgcagagccacccacaccgcgttcgccgagaaaatcgggatctccaccgggggaagggacggggcgacgataatcgagatgataatgcccagccccactttgacacgcttggggatcgatttctcactgaggatcggggcggttgcgcatatagtccagcaacaggttcagcatccacggcccggccacgataatcgccacgaacacggcgatgattttcgggatgaacgacagcgtcatttcgttaatctgcgtggcggcctgcaggatactgataatcagaccggtaaccagcgcgacaagcagcagcggcgcggcaacggcaatcgcgattttcatcgcttccgtgcccatcatcatgaccgattcgggtgtcattgccgttccttaactgtagaaactctgcgccagcgaactgaccagcagctgccagccgtcgaccagtacaaagagcatgatcttaaagggcagggcaatggtcgcgggcggcaccatcatcatcccgagcgccatcaggacgctggcgatcaccaggtcgataatcaggaacggaataaagatggtaaagccaatctggaacgcggttttcagctcgctggtgacataggcaggcagaagaatacgcattggcaccgcttccggtccctgcatctcgccggtgttggacaggcgggcaaagagggccaggtcggcttcgcgcgtctgacgcagcataaactctcgcagcggctgagcgcctttatccagcgcctcctgcatggagatttt

SEQ ID NO: 52337 - DNA, 618 bp, Glycine max
  Peptide Sequence Number=SeqID_144022
atgtttgttgacaaaagtagcaaacgggtgcatttgaaatatttgcagtttctgagagaccttagagaatgcaacagttatgcatggggagttgctgttttgggtaacctttatagagagatgtgcatcacaacagactataatactaaatcaataggcagtttcactctctttcaattatgggcatgcgaacgatgcccaacgttagccccctcagttattcctccacaacaacaaaacgcgccacttggttacagatggttgggaggtgaattacatcacataggcaatgacaatttaattgagtttcgtcgtaaattagatgtcatgaaacgcgacgagtttgtatgggttccttatgccggacatgtggaaatgaatttgagtcaaccggatagagtcatgagacaatttggaatgcagcaacctattctgggaccagtaatgcaacccaacaacatacatgacttgacattaaagggaaaggaaggaaaaaattggatgcgactaatgcaacccgtgcttaatgaatggaatagtcgctatgaaaggagagtagagcagacgccgccacaaacagggaccctcagtctgaactctgaatatatgaggtggtga

SEQ ID NO: 52338 - DNA, 381 bp, Glycine max
  Peptide Sequence Number=SeqID_144023
gtgtggatatggagcccactgaaagtgaggacgcgtagtcctctaaaggtgagggtgtgtagccctacaaaggtgaaggcacatgaccctttgacggtgaggacgtgtagtcctttggaggtgagggaatgcagccctttgatggcgaggacgtgtagtcctctcaaggtgagggcgtgcagccctctgttggcgaggacgtgcattcctctaaaggtgaaggcgaggacttatagtcctctggaggtgagggcgtgcagccctctggtggtgaggacgtgtagtcctctcaaggcgaggacgtgtagtcctctagaggtgagggcgtgcagccctctcaaggcgaggacatgtagtcctctagagggtgagggtaactag

SEQ ID NO: 52339 - DNA, 474 bp, Glycine max
  Peptide Sequence Number=SeqID_144024
atgaaaagatggtgggctacgcaccctcaaagctttgctgatttggtcttcgccagtgaaaggatcgatgtgggtccgaaaagaggcaaatttgatcatcctactaggacgactgagaaaactggggcaaatgaagagggtgagaaagagggagaaacccatgctgtgactgccattcctatacggccaagtttcccaccaaccctacaatgtctttactcagccaataacaaaccttctccttacccaccgcccagttatccacaaaggccatccctaaatcaaccacaaacgagaaagcctgtagaattcaccccaattccagtgtcctatgctgacttgatcccatatctacttgataattcaatggtagtcataaccctagccaaggttcatcaacctccatttctccgagaatacgactcgaaacgcaacgtgtgcttgtcacggagaagccccggggcgttccattga

SEQ ID NO: 52340 - DNA, 381 bp, Glycine max
  Peptide Sequence Number=SeqID_144025
atgatgcaccaaatccctatgataggtggtatgatgaatgtgttgagtggtgcaaccctcttttgtaaaatcactcatgcacccaacatcttcatgatttgtgtacatagggactcattaggtaggaataatcaacacaaaaataaagaaaaaggtatgttttattccattactttccttaactttttaaatagtgatcaagggattcccatggaccctaagagaataaaggtcatttctgagtggcctactccatcaagtataagggaaatttggggcttcaatatcttaacaatcttttacaaaaaggtgttgaggaaagaatcaatgagtttcagaacctttggatttgaggtcaaatccctttcaagggggaggtaa

SEQ ID NO: 52341 - DNA, 435 bp, Glycine max
  Peptide Sequence Number=SeqID_144026
atgacccaagagctggtagcccgcggagacaccttacggttatccgcacctcgtcattcagtgaccccaagtgtgattgatgagcagaggccaatgtggtcatctgcgccctttctggagatgtcagcatcttccggtggagactttttcaagtctcacaaaggcggcgggcccgatgacatgcggagacaaaatttggtcattccgcacccctttgccattcagacacagtcgtgtccgatggtgcacagagacaaaatttggtcattctgcaccctttgtcatccagaggcggcgggcccgatgacacgcggagacaaaatttggtcattccgcacccctttgccattcagacacagtcgtgtccgatggcgcgcagagacaaaatttggtcattctgcaccctttgtcatccagaggcggcgggcccgatga

SEQ ID NO: 52342 - DNA, 342 bp, Glycine max
  Peptide Sequence Number=SeqID_144027
atgagggttgtggttgggggtgatactgagggccttccgaagtgttttcaaggggtataccaccaactgcttgcccttcagtggcatattcgagccaaggctcgaagtcggctagattgtgatggggaatttcatgtgtctcccccacggtttaagagacatgtgcatgatcagttcggggttgttggctctcaatttattgacattcttattgggagtgtacgccacattgggtggcgtatagttgagaggcaagccatatggcgggaaggcgtgatcattttgaatttgcacatcatgggggccgcccgtacttcccaaatctttgcctaccatatctga

SEQ ID NO: 52343 - DNA, 712 bp, Glycine max
  Peptide Sequence Number=SeqID_144028
aaagagtgatgagtatcagaaagtgtttgtcagaggaaaatgtgttagattctcccctgctgtaatcaacaaatacctgggcagaccaacgaaggagtggtggatattgcctgtttctgagcatcaaattgccaaggaaatcactgccaaacaagtccagcattggccaaagaaagggaagctttctgcagggaagctaagtgtgaagtatgcaatcctgcataggattggcactgcaaactgggtacccaccaatcatacttccactattgccacagaatcttttgctgtcaaattacccattgccttcccaactgtattgtgtggcattatgttgagtcaacatcccaatattttaaacaacattgactctgtgaagaagagagaatctgctctgtccctgcattacaaactgtttgaggggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaaaatggagctggaacgcctgatcaaaagactctcagacagtggcattgatgatggtgaagcagctgaggaagaagaagaagcagctgaggaagaagaagatgcagcagaggatacagaatccgatgatgatgattctgatgccaccccatga

SEQ ID NO: 52344 - DNA, 300 bp, Glycine max
  Peptide Sequence Number=SeqID_144029
atgcccttggagttatcttggtcatttgaaagctactgggcgctttcaacctatcaacttttgaaatttgtttctgcggaaaggggattcggaaattcagatgttgtgaagaaagcctcccttttggtggagagatttggcaaagaatattggaggctagggagttgtagggatgctaaattctggctggacaaccggaatggtgatacagtttttgggctttggctgacaagtatagtaggttactcacaaattcttgtaatccgaatgccgtggtggctgaaatggcatattgggtaa

SEQ ID NO: 52345 - DNA, 400 bp, Glycine max
  Peptide Sequence Number=SeqID_144030
atgaacaaaaacagagggttaacgcctctggcggtcgttctgatgctctcaggcagcttagcgctaacaggatgtgacgacaaaccggctcaacaaggagctcagcaggcgccagaagtaggcgtcgtgacgctcaaatctgaacctctacaaatcaccaccgaattacccggccgtacaaatgcttaccgcattgcggaagtgcgtcctcaggttagcggcattatcctgaaacgtaactttactgaaggcggtgatgtgcaggccggtgagtctctgtatcagattgatcctgcaacctatcaggcatcgtatgaaagcgcgaaaggcgatctggcgaaagcgcaagccgcagccataattgcccagttgacgctgaaccgttatcagaaactgctcg

SEQ ID NO: 52346 - DNA, 546 bp, Glycine max
  Peptide Sequence Number=SeqID_144031
aggactacacgtcctcgccttcagaggactgcacgtcctcaccttgataggactacacgtcctagccaacagagggctagttaccctcgccttgagaggactacacgtcctcaccttgagaggactacacgtcctcaccatcagagggctgcacgccctcaccttccagaggactacacgtcctcgccttgggtactacacgttacctcaccatcagagggctgcacgccctcacctccagaggactacatgtcctcgccttgggactacacgtcctcaccatcagagggctgcacgccctcaccatcagaggactgcacgccctctcctccagaggactacacgtcctcgccttgggtactaattaccctcaccttcaaaggactacacgtcctcgccttgagaggactacacgtcctcaccatcaaaaggttgcacgccctcaccatcagaggactgcacgtcctcgccttcgtagggctacatgtcctcacatcagaggactacacatcctcaccttcagaggactacgcgtcctcaccttag

SEQ ID NO: 52347 - DNA, 302 bp, Glycine max
  Peptide Sequence Number=SeqID_144032
gagtccagccttatccttcgggagggggtgaggcctccatagcccaagaccctgtgccagaggaggacgagcccatccctcctgagccattcatttatgagctagtcacagagattgctcaggaggaagcagcatcaccagagcttgttccacagtcatccccatcaccaactccagtccttgaagacccagagtcatctgtaccagcactagtgcctgatcagcctcttgctcaggaccctccagctgcaccagtattggatctgaatgagcatgcagaggatcatttgcaagatgattga

SEQ ID NO: 52348 - DNA, 495 bp, Glycine max
  Peptide Sequence Number=SeqID_144033
atggctacctcaccaaaagaaatttcagcttctggttcacccgctgtaccatcatctccgcaccaggaacaaccagaattcaacatccaacccatacaaataattcctggtcaagcttctgtccctgagaaactggttcccagaagaccacagggagtgaagattgctgaaaaccctagctctgcaacgagttctagggaagtagacacggagatggacaagaaaatccgcagtattgtgagtagcattctgaaagatgcttctgtgcctgatgctgagaaagatgttccaacatcgtccaacccaaatgtttctgtgcctgatgtcaagaaagatgttccaacatcctccgctccaaatgctgaagccctcccttcatccagtgaagaggaatcaacagaagaagaggataacgcctcagaggagactcctgcaccacgggcaccagaaactgctccaggtgacctcattgacctggaagaagtcgaatcttga

SEQ ID NO: 52349 - DNA, 249 bp, Glycine max
  Peptide Sequence Number=SeqID_144034
atgacatgcctttccaaagacaacccgataaggagacattcctatgggtgctttgtaggcagtccgatgtgcccagagagcatcatcaagcctgatcttccacacatctttaaagatggtgggccaataaaaaccacaatcaagcacctttgcgagctgtcctttgaacacccagatgacctcccggtgcggaagaatgacaaaactgcaggactgagtcagtctcatgatctggaatgcaccgtctaa

SEQ ID NO: 52350 - DNA, 456 bp, Glycine max
  Peptide Sequence Number=SeqID_144035
tcattcggggttcctgtcacacctagaaaggtgattcgaccgccgatcacccgggctttcataaagaagtattgcacacccagacaggcgcagggtggcgacccacaggccccagacgcaccaccgccacctcctcaagctgacccagctgggtcatttgacacagagtggtatttatggcatttggttcaccagcaggcggccaaccacaggacgcacgtgcagacccatgactacctctaccagctcagccttagcctgcagagccagggtttccctccctttccatgccctacttcggatcagttcagggcagaggtcgcatggcccggggattggcctgaggcccaggcaggggaggcacccgcagaggctcccggcgatgcagatgaggcccgcatggacgaggagatgaccaatttgcttgatttcttgggagggagcagagccacatga

SEQ ID NO: 52351 - DNA, 297 bp, Glycine max
  Peptide Sequence Number=SeqID_144036
atgaaggtcataactcaggttgtgtttcaatggaggtcttttatcgtgggaacggcagcaatcttgatattcatggggccgaaacaaaaaagtggttgggtgtcaaggtgtcgatttcgggccgaacggttccaccggaacaacataaattacattacgcggaggcaccacatcttagagaacaattgtgatacttatgccaagtgggaatcttccttgtacaccgagaagaaggcaggaccgcaacgtttcattagctttctaaatgaatcatgccggggaaattcatcgggctaa

SEQ ID NO: 52352 - DNA, 252 bp, Glycine max
  Peptide Sequence Number=SeqID_144037
atgtcaatccttaccctcggaagcaaaaaaaggaaaagaaaggaaattcccaatcaaagagtgggagaaagcaaaaagaaaagaaaggaaattctcaatcaaagagtgggagaaagcaaaaagaaaagaaagaaaattcccaaccgaagaatgggagaaagtaagaaagaaaaggaaagaaagctcctaatcaaggatcgaaagaaaacagaagaaatatgcagaaaggtctttggaccagacgatatctga

SEQ ID NO: 52353 - DNA, 603 bp, Glycine max
  Peptide Sequence Number=SeqID_144038
ggcgaattggagctccaccgcggtggcggccgctctagaactagtggatcccccgggctgcaggaattcgatagagaaaacattgactgaagcatttgaggagataagtgaatgtgaagaaaatgagagttcagattgtctccagcaactagatgctttcaaggaaattccttaccaccaatctctctttggagaattgaaagaagaaaagccaaatgagaattcagaatgtctccaacatctaaatgtttctagagaaattccttaccaccaatctctctttgaagaattaaaagaagagaagccgaatgaagccacaaaaatggagctgaaagcattacctccacatttgaaatatgtttttcttgcaggtgattcacagaaaccagtcatcattaatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 52354 - DNA, 442 bp, Glycine max
  Peptide Sequence Number=SeqID_144039
catcggctaactctgtgccagcagccgcggtaagacagaggatgcaagcgttatccggaatgattgggcgtaaagcgtctgtaggtggctttttaagttcgccgtcaaatcccagggctcaaccctggacaggcggtggaaactaccaagctggagtacgataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacac

SEQ ID NO: 52355 - DNA, 166 bp, Glycine max
  Peptide Sequence Number=SeqID_144040
atggcgtggaatcagcccggaaataacggacaggaccgcgacccgtggggaagcagcaataaccaaggcggcaactctgggggaaataaaggaggtcgcgatcagggacctcctgatctggatgatatcttccgtaagctgagtaaaaaactcggcggactgggcg

SEQ ID NO: 52356 - DNA, 306 bp, Glycine max
  Peptide Sequence Number=SeqID_144041
atgtcaggatttacacacgattctcctcaaatttcagccatcccgcatcaattagaccttgcaccttacgcttcagagccctacaatgctcaatggaacgccccggggcttttcagtgacaagcacacgttgcgttcgaatcgtattctcggagaaatggaggttgatgaaccttggctggggttatggctaccattgaattatcaagctttctcgctgcaaaattcatttcttggttggtgttcttggtttgtgctaaaggtggtgttcgtcattggaagtgcggtagacagactttgtggctga

SEQ ID NO: 52357 - DNA, 324 bp, Glycine max
  Peptide Sequence Number=SeqID_144042
atgcacacacaaagtttcacaattccacaatttcctaaaataggtctcactcacaaaaacagtccccagtggagtcgccaactgtcgcaacctacccttttgcgggcgagcgaggcgaggctcacgggtgcgttttccaaaggaggaaaatgcgcggagtcgccaccaacgtttatttgtggaaaatgtcagaaaaaccgaaggaaaactgtcatgaagaatattccaagttcgggagttgtatttacatttgaggaaggtcgacaaaagcggggctcttgctcctacgtaccctccatcgaagaggaaatcagacctacgtag

SEQ ID NO: 52358 - DNA, 393 bp, Glycine max
  Peptide Sequence Number=SeqID_144043
atggctgatgtctctggtactagttcaaattttacccctcaatttgattatagcatggaagactaccagatgggattcctcccccgtgaaaaagttatcaccccaatagacttgactttaggagataatataaaatttaaaggaaaaaggttgcccatagaaccaacattcaatatgtcgtctcttttactgaacataggaagtattgacccccaattacttccaaactacatagaacagtggacttttactgttatgagagactatagagtgaaccatggaagtcatgtatccaacagccaagacatgatagcaagagtcaaaacatatctaggagatatagctagagcctgttgggactcctttaaacaaacttttccagaacaaatctag

SEQ ID NO: 52359 - DNA, 761 bp, Glycine max
  Peptide Sequence Number=SeqID_144044
gtgccaacactaggaggatcggagcaactagggcaaagaggaaggaaggagatacccatgtcgtcacttcaatgcctgcatgggtcaagccgccgcaaatctcccacgtgggaggccccctaagctctggctccaaccccgactcgcctggccagcaatgcccactttggcatcggttccaacgtgataaggaactttcccccgaggccaactcaagaattcaccccgatcccaatgacgttcgaagacttcttgccatccctcatcgccaaccagatggctgtggtatctccctcatcgccaaccagatgggtgtaattccccgcggtgggcacaagaaggtttcctgtttgatgcatcttggcgcgccacatagcatggaagcatgtttagcagtaggaaacctgttgcaacaaatgatagaccaaggccggctggaagttgatgatgaggggggtgaagaacagcatatatgcatgcaatccacagatgaggaaggtcttagaaagcctaaacctttggtgatacatttcaccagggatgcagctccccaaacgccccgacacccctcggtagttagacctattccatttccgtacaaaaacagccacgcagttccgtggaggtacgcgcctccaagcgaaaggaaggaaggagtcaccgacatcagctcgctatcggccaaagtaactaatatcacggggctgagcggcatgactcgcagtggtcgcgtatttgcaccccctgaccagccaacatag

SEQ ID NO: 52360 - DNA, 708 bp, Glycine max
  Peptide Sequence Number=SeqID_144045
gtcgactctagaggatcccacttattccaacaagacataaggcatccatgtccgctccgaagccattgctcgtgtatcgaaaaaagaagagtagattgggaccaacacttggttgggataggaggcagaatagtcaactggtttccacgatggaaagaaggaaaggagggagttttcttctcatgtggggggtacccaaacatcccgttgataggaaagagggattgcattaactacaatcccgcacttgctataagacagttagggtaccccatgaggggagcaccgacggaagaaagcctgtctcctttccttgtgagagattttggcgcgcaaaatttcaaggttatacaaagagtccataaggcgtgggaaagcccgttaaggaaagataaagaacttaggggcattcgtaatggcatcattggtggttatcatgaatggctgaaagttcgtacacgaggcttagattggctcaccaagttaaagattatcaacgaagaggacttcgaagctccggaagaggatgaagaagtccgagctctgaaaaacgaactaggaaaagcaagacttgccaaagaaaaattcaagttggtcgctacagacgtccggaaagagtgtgccaggttacgagaagaaaatgcagctaccgcgaaagcccttgaacaagaaaccaagagggctcgcaaggaagaggcatggccgtga

SEQ ID NO: 52361 - DNA, 328 bp, Glycine max
  Peptide Sequence Number=SeqID_144046
atgcgtcattacgaaatcgtatttatggtccatcctgaccagagcgagcaggttccgggcatgatcgagcgttacactggtgctatcactggtgcacagggcacgatccaccgtctggaagactggggtcgccgtcagctggcttacccgatcaacaaactgcacaaagcacactacgttctgctgaacgtagaagcaccgcaggaagtgatcgacgagctggaaactaacttccgcttcaacgacgccgttatccgcagcatggttatgcgcgttaagcacgcggtaactgaagcttctccgatggttaaagcgaaagacgagcgtc

SEQ ID NO: 52362 - DNA, 1556 bp, Glycine max
  Peptide Sequence Number=SeqID_144047
atgagtctcggaattaagctgtctgtattgacgtctttcagtgtggcaatcgtgctgtttgccctgacgttaacgctcagccataacgccgcgcgccagctggagcagctggctgtcgacgatatgcaaaaccaggtgctcggcattaatgaaatggccacgatgtttaacgcgaccttatcggaagaagtggcgaactatacccggctgtttcagagctttttacccaagcgattcagccgtgacgacagctcacgcattcaggtgggatcgttcagcacgccgacgctgcgtgccgggctgaaaaccctcaacctcgatcagatcgccgtggacgattttctcgatcgtaccggtgcagtctccaccatttttgtgcgcgacggcgaggattacattcgcatcgcgacctcactaaagaaaaaggatggcagccgcgcggtgggcaccgagcttgatcgcagcagcgcggcgtggcgcagcgtgaataagggcgaagtgtatcgcggcctggcgacgctgttcggccatcgctacatcacccaataccagccggtgcaggacgacagcggcgcagtgatcgccattctgtttgttggcgtgcagattgataaacagtacgcgctgatgcgggagaaagtgctggcgcgacgtctcggcgacagcggcagcttcttcgtgctgaacggcacaccgggcagcgcacagggccagtatctgtttgcccgtcagtcagaaggcaagctgccggactgggatcgcagcgtacagcagcagatcctgacgcagccgcacggcctgctggagatcgcgcatcagggcgaaacccgcctgctggcatggcagcaactgccgggctggaactggattatcgccggtgaagtcagccgcgccagcctgctggcaccgatcacccacagccgcaatctgttcatactgattggcctggcgctggtgctcgcctttgcgattggctttgtgctgtatagccggcgcgccattacccggccgctgcagcaggtgatccatctggccgagcagtatgcggcgggtaatctgcaggcgcacctcgactcagcgcgccgcgacgagatcggccagctggtgaacgcgattaacggcattggcgacggtctggagaaagtggtaggccaggtacgcgccgccgcgcgtgagatcagcgacggcaccgacaccattgcggccagcagttccagcatcagcgagcagattggccgccaggcgagcagcgtcgaagagacctcggccagcatggagcagtttggcgcaaccgtggcgcaaaccgccgctaatgtgcgtcaggcgatggcgctggtcggtgaagccgccagcaccgtcagtcagggtggcagcaccgtggcgcgctcggtagagaccatggcggagattcgcattgcctcgcagagcatcgccgacattacccacgtgatcgagtcgattgccttccagaccaatattctggcgctcaacgctgcggttgaggcggcgcggcgccggtggagcacggcaaaggcttcgcggtcgtcgctgcggaa

SEQ ID NO: 52363 - DNA, 396 bp, Glycine max
  Peptide Sequence Number=SeqID_144048
atggcgacattgccgcaaggtcagcagaccaacattaccgaagtcaccgatacctacggggtatcgcgtaaccatatggttaaaatcatcaatcaactgagccgggccggctttgttgccgcgacacgcggtaaaaacggcggaattcgtttaggcatggacccggaaaaaatcgtcattggcgatgtcgtgagaaaaatggagcctttgcagctggtaaactgtaaagagtgtgcgataaatcccgcctgtcgcctgcgtagcgcgctgaataatgcagtccagctattcctgcaggaactggataaatatacgctcgccgacctggtgcaaaacaacgattcgctttaccacatcttattgtccgaaccgccggtggcaattccacataaatga

SEQ ID NO: 52364 - DNA, 1203 bp, Glycine max
  Peptide Sequence Number=SeqID_144049
atggctaaggggcaatcattacaagacccgtttttgaacgcattgcgtcgtgaacgtgtaccggtttcgatctatttggtgaatggtattaagctgcagggacaaattgaatcctttgatcagttcgtcattctgttgaaaaacacggtaagccagatggtgtataagcacgccatctctacagtggttccttctcgtccggtttcgcaccatagcaataacgcgggcggcagcggtggcagtaactaccaccatggcggaagcaaccagggcgctcagtcgcagccacaacaagacggcgataacgcagacttgtttgaccgttatgatgccggtgagcaggccgtactggtacacatctggttctcccaagacaaagagctggaagatttgcaggagtttgaaactcttgtctcttctgcgggcgtcgatgcgctgcaagtgattaccggcagccgtaaagcgccacatcccaaatattttgtcggtgaaggaaaggcagttgaaattgccgatgcggtgaaagcgagtggagcatcggtcgttttattcgatcatgccttatcccctgctcaggaacgtaatcttgagcggctgtgcgaatgtcgcgtaatcgatcgcaccggcttaattctcgatatttttgcccagcgcgcccgcacccatgaagggaaattgcaggtcgagctggcacagttacgccatcttgccacccgtctggtgcgcggatggactcaccttgagcggcagaaaggcggtatcggcctgcgtggaccgggtgaaacccagctggaaaccgaccgtcgtttactgcgcggccgcatcagccagattctgtcccgccttgaacgcgtggaaaaacagcgtgagcagggacgtcaggcgcgtgcgaaagccgatgtgccgaccgtctccctggtgggctacaccaacgccggcaaatccaccctgttcaacgccatcacttcagccaacgtatatgctgccgaccagctgttcgccacgctggacccaacgctgcgccgcctgaatgtggccgatgtcggcgaagtggtgctggcggatacggtaggctttatccgtcacctgccgcatgacttagtggcggcgtttaaagccaccctgcaggaaacccgtcaggcgtcgctgcttctgcacgtgattgacgccgcggatttgcgcgtcaatgacaacatcgacgcc

SEQ ID NO: 52365 - DNA, 915 bp, Glycine max
  Peptide Sequence Number=SeqID_144050
atgcagcacgcgctgcgcattgactggcagcacgacgatctggcgctgcgcggctgggtggccgatccggcggggtcgcgtcaggttaccgacctgcagtactgctacgttaacggtcgcatgatgcgcgacaagctgattaatcacgccatccgccaggcctatcaaacccagctcggtgaagatcagcagccagcctatgtgctgtatctggagattgacccgcaccaggtggatgtcaacgtgcatcccgcgaagcatgaggtgcgttttcatcagtcgcgtctggtgcatgactttatctggcagggcgtgatgagcgtgctgcaggccagtcgcagcgccgaattgccgctggcccatgccgaagagccgccgccgcagtggcagccagagaaccgccaggccgccggggcgaatcactttgcccagccggcaaccggtgcgcgcagcggtggcagcgcggcatccggcggcacgggcggccagtggcagcacaaagagccaggctatcgcgcgcgtgaaggggcggtttatcagcagctgataaaaacaccggcggcggagacgccacgcacaccggccgctgaacccgcacccgcacccgcgcccgcgcccgcgcccgcgccacgcccggcacccgcgcgtgaagcgccgctggccgcccacacgcaaagttttggccgggtgctcagcgtggtacgcgagcgttatgcgctgctggagcggggggagacgttgcagctgctgtcattaagcgtggcggcgcgctggctcaaacaggcccagctgcaacccggcgatgaggggctcaaaccgcagccgctgctgatcccggtacggctgaaaatcgctcacgaagagttaagcgtgattgatgcccaggcggcgctgttaagctcagatgggcattga

SEQ ID NO: 52366 - DNA, 234 bp, Glycine max
  Peptide Sequence Number=SeqID_144051
atgaaacaaaattgtggaccaccacagcaaaataggggaggagcttgccacccagctcgcccaggcgagctcagctcgcccaggcgagcaaggttgcttcctccagaaacaacaaccttctggaggaagaatttggaaggcccaactcttgaagaagttgcgaaaactcacggattgcgaaaaacaccttctttcgatttccgtcacattacggaattttcacggatcgcgtaa

SEQ ID NO: 52367 - DNA, 813 bp, Glycine max
  Peptide Sequence Number=SeqID_144052
gactgcgtgatcaacaggaagttatcatggatcaaataccagcaggggcaaatcgtcccgaccagttaagccgtaaagagaccggcgatgcgtgggagttaaaggcgcgtcgctggcttgaaggcaaaggactgcgctttatcgccgccaacgtccgcgggcgtggcggcgaaatcgacctgatcatgaaagacggtcaggtcatcgtgtttgtagaagtgcgctttcgacagtcctcccgttttggcggtgctgccgccagcgtgacgctcgccaaacaacataaattattacagactgcccacttgtggcttgcccgccataatgggagttttgatactgtggattgccgggataacgtgctcgaaagaattaaagtgtgcttcacagaaagcatccagactcagattgccgcggcggaagcccttccggatgctatctcgcgtgccgcaatgacgctggtgcaatccctgctaaacggcaacaaaatcctctgttgtggcaacggcacgtcagccgccaacgcacagcattttgctgccagcatgatcaatcgttttgaaacagaacgcccgagtttacctgccattgcacttaataccgataatgtggtcttaacggcgattgctaacgatcgtctgcatgacgaaatttacgcaaagcaggtgcgagccctgggtcatgccggagatgtgctgctggccatctccacgcgcggcaatagccgggatattgtcaaagccgttgaagccgccgtcacccgcgacatgactatcgtggccttaaccggctatgacgggggggagctggcgg

SEQ ID NO: 52368 - DNA, 1041 bp, Glycine max
  Peptide Sequence Number=SeqID_144053
gacgccgcgactgaagggaccagtgccgctcctgagtttgacagccatcgttttaggagcgttgagcaccagcaacgtttcgaggccatcaaaggatggtcgttccaccgagagagacgtgtccagcatagggacgatgagtacacagattttcaggaagagatagctcgccagcgttggacgtcgctggtcactcccatggctaagtttgacccggatatagttctagagttttacgctaatgcttggcccacggaggagggcgagggccaggagtgcgagtttagtcagagaaggaaccgggccgatggatttgacgaggaggccatcgcccagctgttatgcataccgggtcaggattttgcccagaccgctgccgggaggcgggtgcggatcatgcgcaccagcatgaccaccttgactcagatgtggatgatgttgctgctcagcaatgtcctgctcagcgatcataactctgacctccatctgccgaagtgtcagctggtgtatgccatcctgacacggatgagcgtccatgtggctcagttgatcactgacaccatttatttatttgcaggtatgtcacctactaggcaccctctagacccagataagtctaacagggccctggggtttccagcattgatcacgggtctctgccagtcattcggggttcccgtcacacctagtaaggccacagatgcaccgccgccacctcatcaggctgatccagctgggtcatttggcatggagcggtatttacagcacttggttcgccagcaggcggccaaccacagggggcaggtgcagacccatgagtgtctctaccagctcagccccagtctgcagagccagggtttcgctgcttttgcgtgccctactccagatcagttcagggctgaggttgcatggcccggggattggcctgaggcccaggcaggggaggcgcccgcagaggctcccgatgattcagaggagggccgcatggataaggagatgacagatttactcgatatcttgggagggagcggagccacatga

SEQ ID NO: 52369 - DNA, 504 bp, Glycine max
  Peptide Sequence Number=SeqID_144054
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcacggataacaatttcacacaggaaacaagctatgaccatgattacgaattcgaagctcggtaacccgggaatcctctaa

SEQ ID NO: 52370 - DNA, 128 bp, Glycine max
  Peptide Sequence Number=SeqID_144055
atggtgaaagttggaacctcttacgtgccgatcaacgtctcattttccccaaaagggggcccagggcttcccgggatcaacagggacaccaggatttatttattaggcgaagtgatctacagtcacag

SEQ ID NO: 52371 - DNA, 219 bp, Glycine max
  Peptide Sequence Number=SeqID_144056
atgtggagccctctgaaagcgagaacgtgtagccctctgaaggcgaggatgtgtagtactctgaaagcaaaggcgtgtagccctctaaaggcgaggatgtctagtcctctgaaggcgagggcgtgcagccctctaaagggcatgcggccctctaaaggcgagggtgtgcagccctctgaaggcgagggcgtgcagccctctaaaggtgagggcgtgtag

SEQ ID NO: 52372 - DNA, 543 bp, Glycine max
  Peptide Sequence Number=SeqID_144057
atggcggaaccatcgaagaagcggaaaggcacttcaagtcgaagtcagcggcattccgggtcacaggaaaccccaattcctcccttcgttccctctggacctttgttctcatcagaggaacagcgtgaacagtacacaaacctcttttcctctcgttccattatagacccaaaattcatagatatggagttcttctcaaatgagaattttgaatgctttcaagcatttgaaaactccaatctcattccattcatgtctctgaaattacctgtttattctgagctagtcaatgctttctattctaatttagaaatccatgaaggtgtaccttttgagggtgcactgattgatgaatggaaatttgatttttctgtgcatgatgcctgccagttggtttgcaccaaccaagcggatatgaccggaaggcttcttgccggttcattggcttttgaaagctgcatcctccattaccttattgtttgcattgtagatgcaattggctttgatgttttgatgatgatcatgataatgtgttgcaattga

SEQ ID NO: 52373 - DNA, 408 bp, Glycine max
  Peptide Sequence Number=SeqID_144058
atgggtaaagcagaggaggtgcaagagaaggtgaaggccaacatggaggccatgaaagagaaaatggccacaatgatggaggccatgatgagcatgaggaagataatggaagccaatgcggttacaattgccgctaccagcactgttgctaaagtgaacccgatgcccccatctggcctcaaccaaatgaatcatccaaccttagatagggtaggcaaagatttgggaagtagggacggcccccatgatgtgcaaaatcaaaacaagcacgccttcccgccatatggcttgcctctcaactatacgccatccaatgtggcgtacactcctaataagaatgtcaataattccactcctatacccattgagagccaacaaccccaaactgatcatgcacatgtctcttaa

SEQ ID NO: 52374 - DNA, 297 bp, Glycine max
  Peptide Sequence Number=SeqID_144059
atgggaggagctacttgtgccgccaaatccctccatcgctgcgcatattctttaaaggtttcaccctctttcttgaacatatttgtcgcaacctacccttcggcgggagggcgacgcgtgactcgcgggatgcgtgctccacgaaaggaatacgcgcggagtcgccaccaacgtttatttgaggaaaacgtcggaaaaaccggaaaagatgcgagctacgaacttttaagtgaaagggtgtttccctttgctcctacgtattcctcaatttgcgatgaggaaatcagacctacgtag

SEQ ID NO: 52375 - DNA, 411 bp, Glycine max
  Peptide Sequence Number=SeqID_144060
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccttttaggagtttgcggtccagatttaaggtaa

SEQ ID NO: 52376 - DNA, 486 bp, Glycine max
  Peptide Sequence Number=SeqID_144061
atgaagcacttcactgacaccctcatcagtgccaacatactacttgggaggctgaggcaggagaaaggcttgaacccaggaggcaaaggttacatcagtgagccaagattatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 52377 - DNA, 231 bp, Glycine max
  Peptide Sequence Number=SeqID_144062
atggcacctttgatcccttgtggtactcatctggctgcccctttttggaatgggatttctcgcttggggaaggatgcagccgcagcggtggactgcgccaaagagaaaagaccagttcctttcccattcaacattcattcaaagtattctccccttgccatgcttcaaccagcagctgctttgcggactgctcttgctcttactgctgcttcctatgcttcctgcttctga

SEQ ID NO: 52378 - DNA, 270 bp, Glycine max
  Peptide Sequence Number=SeqID_144063
atgaaaagatggtgggttgcgcaccctcaaagctttgcggatttggtcttcgctagtgaaaggatcgatgtgggtccgaaaagaggcaaatttgatcatcctactaggacgactgagaaaactggggcaaatgaagagggtgagaaagagggagaaacccatgctgtgactgccattcctgtacgaccaagtttcccaccaacccaacaatgtcattactcaacccttctccttacctaccgcccatttatccacaaaggccatccctaa

SEQ ID NO: 52379 - DNA, 855 bp, Glycine max
  Peptide Sequence Number=SeqID_144064
ttggaacctcttacgtgccgatcaacgtctcatttcgccaaaagttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgggatatgtcagaatacccaaaatacacagggctcagtcaataaagaagagccacatcacccaggtgctgggtctagacatatgtcacatctcttttatggggaaagctcagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 52380 - DNA, 741 bp, Glycine max
  Peptide Sequence Number=SeqID_144065
atggccagaacacgaggtttaggtcgtgccataggtagagttgtaggcagagatatagctgctgacgaggatgctggcgatgttcccgagaggcgtaggcctactgcctcagcccgtaggctacgcgttcatcagatgactacggagggacgtgatatggctgaggacgtcgctgacatgactgatgatgtccctgagcagcctacggaggcacctgagatgcgtgcggacgcacagggtgctgatagtggtgaggggtcagatggtgatgatgctgcagaggaattccctggtggtccacgtgacccgtcagtgctcacatcatttgccgagcatgttgcacatgccgtgtggagtggacaggaacgtcctgatttgaagttagtgtcacatgggaggaagctgacactgattgggaggctagtgcctgagattgaaggcctggtggctgccacaggattaagtccactgatagattgttcagttattactggcgatcctggacttatatccgcatttgtggagaggtggcacagtgagactagcaccttccaccttccagtaggagagctgacgatcacattggatgatgtgtcgtccattctacatttgcccatcactggcgccttgcacagtttccacgctctttctacggaggaggccagattcttgctcacggagttgctggaagtgtctgcggaggaggccagagccgagacagcgctcacacgtggagcatat

SEQ ID NO: 52381 - DNA, 877 bp, Glycine max
  misc_feature (304)..(304): n is a, c, g, or t
  Peptide Sequence Number=SeqID_144066
atgcacgaccagtgcacgtccggcgatatcggtgacggcgcctccgccaagggtaacgcccttgaggtggatatcgacgttggcgcggccctgggcatcggcacgcaggttgtccatgtcgcccaggtggtgcttgccggtgccggcgcgaccatgcgcggcgccaccggggttgaagtggttgccggcgctgctggcatccaccgcgctgcaatcgccacgctcgtggatgtggaaaccggcctgctgcatcggctgcaggccaccgatcagcccggtgatgtggatgccaccaggctccacnatcagcgcgatgcggccactgacgatgctggccgaggccggcgacaggttggcctccgcctgcttggcggcactgaccacggtcggcggcggcggggtgggctcggccttcttcggtgcgctgccacaggcagacagcagcacggcgacggacaacggcaggatggcaaaggacagacgcatcgaagactccttgcaggtgacactacggacggcatcgtccatgaacgatcaacggttcggcaagcgggcgcgaggatcgcgtgcagggaccgttcaatggcccccgcggcggcgccaggcgcccagcttgcgggtaagggtattgcggccgagtcccaggcgggcagcggcttcggcgcggcggccatgggtgatctgcagcgcggcctccagcagggcatggtcgacccgctcgcgcacctgcgcgtgcaacccttccacgccttcggccagctgacggcgcgcccattcggccagcagcgcttcccactggccgggatcggcaccgctggtgctgccgcgacggccgcgcgtgcggttcagcgcggtatcgacgtctgccacgccgatg

SEQ ID NO: 52382 - DNA, 453 bp, Glycine max
  Peptide Sequence Number=SeqID_144067
atgacattgctacttagcaacattctgcccagtgaccgcaatgccaatctccccctacaaaagtatcagttggtctgtgtcgtcccgacatggggatcgcacccacaagacacccagtggacccggaaaagtccaacagggccctggggtttccagctctggttacgggcctctatcagtcctacagggtgcccgtaccccccagcaaggtcatgccatcccgacatagggatcgcgcccgcaggacacccggtggacccaaagaagtccaacagggtcctggggtttccagctctgattacgggcctctgtcagttctacggagtgcccgtcgccccaacaagatcattaggccccgcattaatcgggctttcatcaagaagtactgcgcccccagacgggcgcagggcgagacaccacagtagcattgggatggccggtagcgggcaatag

SEQ ID NO: 52383 - DNA, 45 bp, Glycine max
  Peptide Sequence Number=SeqID_144068
aggaaaatgcaaggatcatcactgaaagataataatattgcggcg

SEQ ID NO: 52384 - DNA, 143 bp, Glycine max
  Peptide Sequence Number=SeqID_144069
atgaccaagagcaagggcaaggatccacttgaaggacttggaggacaagggctagagcaaggaaagccaaggaagctattcaacaagtgctgtccatactatttgaatacaagcccaagtttcaaggagaaaagtccaaggtt

SEQ ID NO: 52385 - DNA, 881 bp, Glycine max
  Peptide Sequence Number=SeqID_144070
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgattcgccattctgttcttcgcgctggtagtgctgggaattgtggcgcgcctgtgcgggttaagcgtctggatcctgattcgtattctgaaagatgagctgaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 52386 - DNA, 629 bp, Glycine max
  Peptide Sequence Number=SeqID_144071
atggataatgaagagggcgtgcaggaacagatgaaggtcggtctattggccttaaaagatcaaatggcttccatctcggaggtcatgttaaaactccagaaaaccatagaggataaagccacgacaaccgcctccagtacagttagggaagcggagccagtgctgcagcccaccttaaatctgggcctagacagaaacacggccgtgtttggtcgaaggtatagtccacaagcttatccttacggcctgcctccggacttcaccccccgtgccaccccgaaagatttaagccaagcccctactttcgaggggcaactcccaccttatgaagactatcccgggcaagacgatggggaaggagatacccatcttggccccctgctccacctcaaagatccgtccccccatgaactaccccaaccgaacatagtccgccatatcccggcctctcccacacccgtaaaagaatctgttcccttcgcggaagataaggggaagatggaggcgcttgaagggaggttaagagcagtcgagggccttggcaattacccattctcggatttagcggatttatgtctcgtgcccaatatcatcattcctcccaagttcaaagtgtcggactttgataa

SEQ ID NO: 52387 - DNA, 261 bp, Glycine max
  Peptide Sequence Number=SeqID_144072
atggcgagcgaaagcagcagcatcaggcgcagaatgttggtgagtatgcgtatcaagggtcaggcgcagatagcccagcggaccattcttcccctgaatgggttcgacaatctgctggttgaaatagccgccggcttttttaccgtccagcgccagcctgtcgcgtacgtcgacatgttcgcccgcgcgggcaatcaggtcgccttgctcatcatagacaccggcatccaggatacggctgttttccgtcagcagacgtaa

SEQ ID NO: 52388 - DNA, 420 bp, Glycine max
  Peptide Sequence Number=SeqID_144073
atgccagatgcagaggatgagcttgctcctcctgagccatttgtctttgagactgatctagtcgctcaggaggaagcagcagctcaggagcctactgctcagccattagaagaaaaagaacatgtgattagaagtatgactgaaaatgttagtcagtttgtcagattgattgtgaaggaatgcattgactgtatcacggagagcatcatccacagaaagcttggttcaaagcaaatttgtctcaaatttgggggagtaattatcaagaagtatgtacattgggagagaaatacgcagggccttattctgagctttttgatatatatattgcctactttcgaaaacgggccccgacgggtgcagagaaacgcaaggaactggaaccagagaggcggcatgcaaaccgaggcaggattttag

SEQ ID NO: 52389 - DNA, 204 bp, Glycine max
  Peptide Sequence Number=SeqID_144074
atgatggcatcaaagaagagaaaggcgactgccacaccttccaaggtccgatatgaccgatccaagttcacttatcctgaagcctgggaaaggtacactgacattaatgttcctaggaagctgctgccagagagaaatgtggtaatctaccacactgaatttgatgaattcaaggaagaattggagaggaagaagatgggatga

SEQ ID NO: 52390 - DNA, 66 bp, Glycine max
  Peptide Sequence Number=SeqID_144075
atggaagagaagggagatgcagcggaagacaaaggagaagaggtgagaggaggcgccatccattag

SEQ ID NO: 52391 - DNA, 399 bp, Glycine max
  Peptide Sequence Number=SeqID_144076
atgacacaaagatttgggaagtacggacgaccccatgatgtgcaaattcaaaatgagcacgccttcctgccatatggcttgcctcccaactatacaccacccaatgtggcatacactcccagtgagattgtcaataactccactcccatactcattgaaagccaacaacctcaaactgatcatgcacatgtctctcaaaccatgggggagacacatgaaatttcccaccacaatctagccgacttcgagccttgtctcggatatgccactgaagggcaagtagttggtggtatgcccttgcaaaacactttggaggaccctcagtatcacccacaaccacaccccttggattccacagcgggtaaaaacctcatgctatggcagaaattggaaagttga

SEQ ID NO: 52392 - DNA, 462 bp, Glycine max
  Peptide Sequence Number=SeqID_144077
atgggctctaaacaaatcacttccaaagaggcaccctctcttaaccgaccaccattgtttgagggagaacattttttgttttggcaaaaaggaacagaaatctttattcagtcaatcgatcctggtgcatggaatgctattattaaaggaccatttatagcaactaaagaagtgaaagctttccaaatgaagaatggagaaaccatttcagaacatcaaacaagattcacccatattgtgaaccaccttcttagtcttggaaaaatgtttgaagatgatgagctaaacatcaaaatcctcaactgtcttacaagaactagggaaccaatgatcacaatgatcaaggaattcaaggacttgggcatcattgtcgatggaagctttcttcggaaaattgctcggtgtatgaacatggaggctaattcaacaatatcatgtagaataaatagaaaagaaaattaa

SEQ ID NO: 52393 - DNA, 271 bp, Glycine max
  Peptide Sequence Number=SeqID_144078
atgagggcgtgtagccctacgaaggcgaggacttatgcagtcctctggatggtaagggcgtgtcagccctctgaagggcggtgcagcctctcaaggcgaggacatgtagctcctctggaggtgagggcgtgcagccctctgatggtgagggcgtgtagccctctcaaggcgaggacttatagtcctctggaggtgagggcgtgcagccctctggtgctgaggacgcgtagtcctctcaaggcgaggacgtgtagtcctctcaacggtgagg

SEQ ID NO: 52394 - DNA, 273 bp, Glycine max
  Peptide Sequence Number=SeqID_144079
atgcagaattcaaaatgcaatgtctacctaggagcctacctgaatggcgcacactggcaaatggttgtcattttgcctaaggaaaatcttgttgtctggttttgttccttgcataacaggccagacaactaccttaaaggaataattaatagtgctttaaaaggacttgatgatactccacaacctaaatccaaggctggtgttaggtggattgttgttaaatgtaatagacaaaaagaaagcactgagtgtgactattacgtgatacactag

SEQ ID NO: 52395 - DNA, 819 bp, Glycine max
  Peptide Sequence Number=SeqID_144080
atgtccttgccttttagagggcttcatgtcctcgtcttcagaggactacatgtcgtcgccttcagagggatacacgccctcgccttcagaggactacacgttcacacctttagagggctacacgcctttgccttaagaggactgcacgtcctcgccttcaaaggactacacctcctcaccttcagagggctacacgccctcacctttagaggagtgcacgtcctcgccatcagaaggcttcacgtcctcacttttagagtactgcacgtcctcaccttcagaggaatcctcatcctcgcctttaaagggcttcacgtcctcgccttcagaggattgcatgtcctcaccttcaacggagtgcacgtcctcgccttcagagcgctgcacgtcctcatcttcagtgggctacacgttctagccatcagagggctacacaccctcaacttcagagggctacacgtcctcaccttcagagggctacacgccctcaccatcagaggaatgcacatcctcatcatcagagggcttcacgtcctcacctttagaggactgcacaggactacacgtccttgccttctgagggttatacgccgcaccttaaaaggagtgcacgtcctcgccttcagagggctacacgccctcaccttcacaggactgcacgtcctcgccatcagagggattcccgtcctcacctttagaggactgcacgtcctcgcgttcataggattacacgtcctcgacttcaaaggactacacatcctcgccatcaaaggacaacacatcctcaccttcagaaggttacacgccttcgccttgtga

SEQ ID NO: 52396 - DNA, 411 bp, Glycine max
  Peptide Sequence Number=SeqID_144081
atggtgaaagttggaacctcttacgtgccgatcaacgtctcattttcgccaaaagttggcccagggcttcccggtatcaacaggggacaccaggatttatttattttgcgaagtgatcttccgtcacaggtgctccagtggcttctgtttctatcagctgtccctcctgttcagctaatgacggggtggtgcgtaacggcaaaagcaccgccggacatcagcggtgccaagtgtagcggtcacgctgcgcgtaaccaccacacccgccaaacaaactgtgaaatttccgcgccaattactttagacatttgttcattagctgcaaatatccttccctcctcaagggcaagcttcttgcgtagcgctcttggtgctcaaaaaatcccaaaaacaaatccctcttattactag

SEQ ID NO: 52397 - DNA, 757 bp, Glycine max
  Peptide Sequence Number=SeqID_144082
atggcgaaagtcgccgaagaagcaggtgtctataaagcgacgaaacatccgctgaagacgttttatctggcgattaccgccggtgtcttcatctccatcgcttttgtgttttatatcacggcgaccaccggtactgccgcaatgccattcgggattgccaaacttatcggcggggtatgcttctcactaggtctgattctttgcgttatctgcggtgctgacctcttcacctctaccgtactgatcgtcgtggcgaaagccagcgggcgtattacctggggtcagctggcaaaaaactggcttaacgtctatgttggaaacctcatcggcgcactgctattcgtattattaatgtggttatccggcgagtatatgacggccaacggcggctggggcttaaatgttctgcaaactgcagaccacaaaatgcaccatacgtttattgaagccgtctgcctgggtatcctggcgaacctgatggtttgtctggctgtctggatgagttactccggccgcagcctgatggacaaagcgatgatcatggtgttgccggttgcgatgtttgtcgccagcggctttgaacacagcatcgctaatatgtttatgatcccgatgggtatcgtaattcgcaactttgcaagcccggaattctggaccgctatcggttcaactccggagagtttttctcacttaaccgttatgaacttcatcactgataacctgattccagtcactatcggaaacatcatcggcggtg

SEQ ID NO: 52398 - DNA, 345 bp, Glycine max
  Peptide Sequence Number=SeqID_144083
atggaagatcctatggcctacaagctccaatggagcttgcatcacccgggtcataccacttggggtagggtggctgggaagccttcccggatacgccccattgggaatacggagagaatgtccctttcgggggacatgggtgtccctgttgcatacttatcaaaggtggcgccggtgggctggttgaatttgggcggaggaactggactgtgcgatattgggcgctactttctgctgatccgaggatggcttgtaattgccgaggccctcgactgctctcaacctctcttcaagcgcctcaatcttcccttatcattccacgaattgggcgattctttggtatga

SEQ ID NO: 52399 - DNA, 598 bp, Glycine max
  Peptide Sequence Number=SeqID_144084
cattttcccactgttcatgagagcgtgattgatccagagtatgatgagatgtcaccacgtgcctgctggtggcttactacgaaggcttattcgaagggattcccagcttcgacgtaccagacacgtatagatgcactgatgatccttgatgtatgttggatgccttatggtgagcatcgaggagttagggcgtttgacctcatttcatgctttcagggtgagcttagatgggaccctgttgtggtcacacatcgaccagagaggatgtatgtaccagattacatggattggttcttcaggatctctcattcgttcatcacaccgacacaggcagttgatccgcccagacatccacctatcccacaccatgacacatatgtggagccagatatccctgtggtccctgcgacaccagaagctggaccttcacatgcaccttctgatgtggagcaacctagacatgcagtggatgcgtgccaagtgattgcagaaaggttggagcgtttactcaacctaaggatagtcactgtaggcacagagatacatgaggttatggaagactgcatcaggatcgctaggggtgtcacaacagatggaa

SEQ ID NO: 52400 - DNA, 102 bp, Glycine max
  Peptide Sequence Number=SeqID_144085
atggcaaggagcagaatcgtctcaggccacggtcagaagtccagacaagtcagtggcagaaatctaccaaggtacttagggatggaggcaaatggaggatag

SEQ ID NO: 52401 - DNA, 174 bp, Glycine max
  Peptide Sequence Number=SeqID_144086
atgtcattgcctagcgctattcatgtgttctccattatcaagtgcgaagcttctggtgactgggaacacaagaaaaaagaagaagtagagatgagagtcgtcatcacggaaagggcaggacggacgaaatcagtgtcctatctttgctttcctcttatctccgatgagaggtaa

SEQ ID NO: 52402 - DNA, 174 bp, Glycine max
  Peptide Sequence Number=SeqID_144087
atgtcgcagcctacccttcggcgggagggcgacgagggactcacgggtgcgttttccaagaaaggaaaatgcgcggactcgccaccaacgtttattcgaggaagacatcggaaaaatcggaaagggaaggcattagcaccccacgcgtctgtcacaagggacaacaacctttaa

SEQ ID NO: 52403 - DNA, 441 bp, Glycine max
  Peptide Sequence Number=SeqID_144088
atgagactccatcaacatgaagagaatgacaaaaagaataaaggaattacacttagagcctcatcatcttctattcaagaagaaagtgacaaagagtacttgaatgaaatagaagaagatcatgatttcatattttttgtgaagagattcaataaatttcttagaaacaaaggaaatcaaaggatatcaaatatcaatccaaagaagaaaggagaaaattcctccttagccccaaaatgctatgaatgcgatcaacctgagaacttgagattcgattgtcctgtttttaaaagaagaatggaaaaatttgacaagagaaatttcaaagaaaagaaagcatacatcatttgggaagataatgacatgaattcttcaagtgattcagaaaatgaagtcattaatctgggtctcatggccaaagactatgaaagcgaagaaaag

SEQ ID NO: 52404 - DNA, 432 bp, Glycine max
  Peptide Sequence Number=SeqID_144089
atggctagaacacgaggtttaggtcgtgctataggtagacttataggcagagatagacatgatgaccatgatgcagttgatgttcccgagagacgtaggcctactgcctcagcccgtaggcaacgggttcatcaaatgactgcggatgcacgtgatatggttgaggatgttgctgacatggttgaggatgtccctgatctggctaaggaggcacctgagatgcgtgcagacgtacagggtgctgatggtgttgaggggtcaaatgctgatgatgctgagggattccctggtgggccacgtgacccgtcagtgttgacatcatttgcggaccatgttgcacacgctgtttggagtggacaagaacgtcctgatttgaagttgggtgtcacatggggggggagaggtgacattgactgggaggccagtgcctga

SEQ ID NO: 52405 - DNA, 393 bp, Glycine max
  Peptide Sequence Number=SeqID_144090
atgaattttgcagcgaaaaagcctatagaattcaccccaattccggtgtcctatgctgacttgctcccatatctacttgatactgcaatggtagccataacccctgttaggtttcctcaacctccatttttccgagggtacgactcgaacacaatgtgtggttatcatggaggagccccagggcactccattgagcgttgtatgaccctgaagcgtaaggattttcaagttaatgccattattgtaagccatagttacaatgctaaaatggatgaattggacatccttgtctctctcatcctttcacaaacacatctttgcttattcaacttccaccggaatgtgagtgtaagccattgtggtttgtttgttcaaagcaacctgcgctcctga

SEQ ID NO: 52406 - DNA, 1725 bp, Glycine max
  Peptide Sequence Number=SeqID_144091
atggcaagttcctcatgttcacggcgtggtggaacggtagcgaacgaagtagggcagcgccgggggctccccgtcatcgccatagtggctttccggttcgatcacggtttggcgtgcgtcgtcgcgcccgttgtagcgatactccaacggctggcgcttgtcgttgcctgcccacagctgatacagcgatttatcgccggtctccagcagtaccttcaactgcccgtcggattgataacgcaggagctgatacagccctctttccagcgtctgtgcgatcaggtagatgccgccatccggggcctgcgcgctttccgtcacgcgcaccgtgagccaatgcggttcggccacctcgccggttttgccgttaacggcgatgtgcaaggcgccggagccgagcaccggattcatccagaacagcacgcgatcgccgtcaacggcggtaaagatctcgggtatggatttgcgcttgccggaggcatcgagcgtttgccgccaatgggcgccaaagtccgggctgtagaatacgccttcggtgctgatgagatacagcgcgcgtttacccggcagcgccaccagtttgccgccgataaaggaaggccggttgtcgtcgccctccggccaggggatcagtgccccgatggtgccctgtttcacatcgaccagccggcgccccttggacagaaaaagcacgcactcttgcccgccgcaaaccgcatcgtggatagactcgtcgagttcccccagcatctgcaatccctgcgggccgctgaacaacacctggctgagatagttggccgcccagccgtaaaagctattgtaggccccgcgctcactccttttgctgatgagcagcagagcgccgtcctgcgccgggtagctgtggatgagatcgtaacgggctatcgtcggcaaggcctcgtcgctctgggtccattgccactgcgcatagccgctaacgtcatcatttcagctccgtcacctgatcctgccgccatagcctgcggcgcagattgcgcagtaaaggcggcagatctgggcgaagccctcgatcagcagcgccaggccgctgatcatcagcatcatcagcaacagaatcggcggcaattcgctaccaaggcgcttcagggtccaggcatccaggtaaaagcccgccggggtatcggcgttatccgccaccgccaggccgagcacaaagcacgtcacgatcgcgccgagaatgaagacaacgcgcgcgcacaggttaaggccggattcggtgaagtagcggcggccgccgatgaggtaagtctggcgatcgcggtggttgatgatcccacgcaccgtaggcaactcggggacggtgtcgttctcgcaatacagcacctgcagcggatcgcctttggcgatgaaaagcggatgttgccgacgaaataccggatgcagtttggtattggggacgttgagcgcgcgggtcgtcaacgcgaagtgcgtctccttctggcgccacgcataggtgtccaaatactgcacctggcgcgggatctcatagtggaggagttcgtagctcagggcgttgaccgtctcgatgccggaggcctcgacgccgtcggggagggggacgctgagcgatccgggcggcgtgacgtcttgcccctgcagcacgcgatccagcgcattgagcaggcgcctgcggccgcgatgcccgatcagcagcagctccgaatttacgaaggatggctctag

SEQ ID NO: 52407 - DNA, 216 bp, Glycine max
  Peptide Sequence Number=SeqID_144092
atgaaagtgctcaagcgcgccgaaggcgacggtgaaggtttcatcgtggtggatgatttggtggataccggcggcaccgcgaaagcgatccgcgatatgtacccgaaagcgcatttcgtcaccatcttcgccaaaccggcgggccgtccgctggtggacgactacgtggtcgacatcccgcaggacacctggatcgaacagccgtgggatatgggc

SEQ ID NO: 52408 - DNA, 378 bp, Glycine max
  Peptide Sequence Number=SeqID_144093
atgacaacgctggaaaatgccgctgcggtattaaaactcttttctcaacaacgcgtgatgcatggccaaccgggcattgcattcagcgacgtggtagatcaattggcgctgccgaaaagcacggtatcgcgcctgctgcagagcatggaaaatcagggcatgctggagcgcgatcccgatagccggcgttaccgcatcggcgcgctgttgctggcggcatccagccactatctgtcgatgccgctggtggacaacctggcggccagcatggcgcagctgtgccgccagacggcgtgtaccggctacctctcggtgctggaggggcaggagatcatggtgatgcgcatgttccccggccgccactgtgggatcctctag

SEQ ID NO: 52409 - DNA, 2349 bp, Glycine max
  Peptide Sequence Number=SeqID_144094
gttgacggagcagcatgcgcggcagatagccgaggcctgccgctatatcgaacgggcggagaaagcgccgtcgctgcagacgctggcgcgtcacgtcgggttgagccaataccatttccaccggctgttcaaagcgatcaccggcctgacgccgaaaggctatgccgacgcgcagcgcagccaacggctgcgcaccggtcttacgcagcaggagacggtgaccgatgctatcttcgacgccggctatggcgccaatggccgcttctatcagcaagccaacgccgcgctaggcatgacgccgaaggcctaccgggcgggcggcaaaggcatgcgcatccatttcgccgtcgggcgctgttcgctgggcgagatcctggcggcgcaaagcgaggtgggcatctgcgccattctgctgggggacgatgcgcagcggttggtgcaggatctgcaggacaaatttcccaatgccgagctgatcggcggcgacgcgcagtatgaagcgctgatggcgcagctatgccgatattgcccggcgcatcggcgcgcccaaagcggtgcgcgcggtggctggcgcctgcgccgccaacgtgctggcggtggcgatcccctgtcaccgggtggtgcgcaacgacggcgccttgtccggctatcgctggggcgtcgagcgcaagcaagccttgctggaaaaagaggcgcagcgatgagcggcctgctggcggcgcggctggccgaattggactgggcgacaatcgaacgcgaactcgatgcgcagggctgcgcgcggttgcctggcgtgctcagccaagacctgtgccgcgagctggcggcgctctacccgcacgatgcgcacttccgcagccgtgtcgtgatggcgcagcacggttttggccgcggcgagtaccgctatttcgcctatccgctgccgctgccggtggccgaggcgcgcagcctgatgtatgcgcggctggcgccggtggccaaccgctggaataccttattgggcctggcggcgcgctatcccgccgaacacgaagcctacctggccgaatgccaccgggccggccaacggcggccgacgccgctgctgttgcgttacgaagcgggggattacaactgcctgcatcaggatctgtacggcgagcgggtgtttccgctgcaagtggcgtttttgctctccgcacccgaacgggacttcaccggcggcgaattcgtgttgaccgaacagcggccgcggatgcagagccggccggaggtggtgccgctacagcagggcgacgcggtggtgttcgccgtgcatcatcgcccgatggcgggggctaaaggctattatcgggtcaatctgcgccacggcgtcagccggcttgcgcgccagcagggtggcgaagcgcagcgagatacggttgccggcggcgtcggtcttgtgcaactggccgacgtcctcgttgtatttgaggatctcccagtcgcgataataatgctgcagttcacccgggctaaaagtgaacggaaacggcagcgggcagggataatcctcgctatccatcgccgccacgatcaggttatggccgccgcgtacggtgctgccctgcatgttttgcacgatatgcggaatttgctggcgttcgagaaacatcatcaccactgtggacaggatgaagtcgtattcgccgctgaagcggtgggtattgagatcctgcaccccggcgctcaggcgggtcagctgctcggcgtcgatgatctgattgaggcggtctatcgacggcgcgtgcttgtcccaggcggtgacgtcgaaacccttcagattgagatagagcgaattgcggccgccgccgcagcccagatccagcgccttgcccggcgcgatgcgcgccgccgcctcgatcacttcggagtgggtgcgcgtcagttcgtatttcttgtggtagtaatcttccgccgtgcagtaaaacgccagccggcaagtcatatcgtccgagaaggaaacgatgcggtgccactgctgcggtgcgataaacggcggctggctttcggggctgaactgccaggtctcggtggtggcgccgtcctcggtcatcatggcgaacgtcaggctgccgctcagtacggtgagcttcgcccaggtgccgctctgggtgttgtggcgctggcggaaggcctccggcagcgtgtcgctggaaaagatgccgatacctcgtttattccacccgatatccttccgtttgctgagcctggccgcgctgctggcgctggcgggctgtaccagcaaaaccaccaccacggcgccaacggcgcgccccgccgatgtcaaagcccggctgctgacgctgatcccggccaacgccggcgatc

SEQ ID NO: 52410 - DNA, 1796 bp, Glycine max
  Peptide Sequence Number=SeqID_144095
atggacctatttggccggggtggtcttcattatcattctgccggggccgaatacgctgtacgtactgaaaaccggcgtatcgcgcggcgtgcgcgccggctacaccgcggcgctcggcgtgttcatcggcgatgcgatcctgatcttctgcgcctatatcggcgtggcttcgctgatccgcaccacgccgttcctgtttaccctggtgcgttttctcggcgcgatttacctgctgcgcaacagcagcagattgaaggcggccacagcattctgcgcaaatcgctgacgctgagcctgaccaacccgaaagctatcttgttttacgtgtcgttcttcgtgcagttcatcgacttcaactacgcgcacaccgggctgtcgttcaccattctggcgctgatcctcgaagccgtcagctttatctacatgagtacgctgatcttctccggcgcgatgctggcgcatttcttcaatcacaagaaaggcctggcgaagctcggcaacggcctcatcggcctgctgttcctcggcttcgctacccgtctggcgaccctgagctcggttaacgataacctgatgagcctgatcggaggatgtatgtctgacaataccgtagccgtgctggatagcgtgtcgcgttttctcgatcgtcagcatgggctgtatatcgacggccagtggcgcgcgtccgccgcggaaggccgcctggcggtgtataaccccgccaatgggcagcagatcgccaccaccgccgacgccaacgagcaagacgtcgcgctggcggtgcagtccgcccacaaagccttcagcgaaggcgtctgggcgcagcgtctgccggtagaacgagaacgcatcctgctgcgcttcgccgatctggtggagcagcacgccgaggagctggcgcagctggaaaccctggagcagggcaagtccatcaacatcgcccgcgccttcgaagtcggcagcaccctgaactggatgcgttacaccgccgggctggcgaccaaaatcaccggccagacgctggacgtctccattccgatgccgccgggcgccaaatatcaggtttatacccgtaaagagccgattggcgtggtcgccggcatcgtgccctggaacttcccactgatgataggcatgtggaaagtgatgccggcgctggccgcaggctgctccatcgtcatcaagccgtcggaaaccaccccgctcaccctgctgcgcatcgccgaactggcgagcgaagccggcgtgccgccgggcgtgttcaacgtggtcaccggccgcggcaccgtgtgcggcaaggcgctgaccgaacatccgctgatcgccaaagtcagctttaccggctccacgccggtgggcaaaagcatcgcgcgcgcggcggcggatcgcctgacccgcgtgacgctggaactgggcggtaaaaacccggccatcgtgctgaaagatgccgatccgcagcaggtgatcgaaggcctgatgctcggcagcttcctcaatcaggggcaggtgtgcgccgccagctcgcgaatttatattgaagcgccgatttatgaccagctggtggcaggtttcgaacaggcggtgaaatcgctgtcggtcgggccggggatggataccggcgcgcaaatcaacccgctggtgtcgctcgcgcaccgcgacaaggtggcggcctacctggacgacgcccgggcgaaaaacgccgagcttatcggcggcgcggccgggccggatgccaacggcttctacattccgccaacgctggtgatcaactccggacgatcggctgaacctgacgc

SEQ ID NO: 52411 - DNA, 1333 bp, Glycine max
  misc_feature (1)..(1): n is a, c, g, or t
  Peptide Sequence Number=SeqID_144096
ntgccgataaagttcggcccggagctggcgagctgcgggttgaacgattccggcgaggcgacggtgcagtacaccagcgcatcggaagcggccagcgcgccgcctgccgacaacaggccgcagccagccagcaccaatccggcgatagggcaaaccgctttaatcggccgagcgcttgcggtctgcatcatagcgctcgcgggcggcgtccaactcggggaaatggtattccgcccatcggtcgagcgccgtcagcgtctcgaccagcgagcaggcgacggcgctgagccgttcgccgttgcgcatcggccgctgcgccagcgcgggcaggatcagcatcacccacttgccggaaatcagcgccagcgcatcgcgcgcggagcacttgctcgaatagacgtcgccgggataggccattggggcatagcagcaccaccttacaacgggagaaacaggatgaacgtgctgattgtgctggctcaccccgagccgcattctttcaatgcccatttggccgaacaggcgcggcaggcctggctggcgcaggggcatcaggtgaaaacggtcgatctgtatcaggaggggtttgatccgcgcgagggtgccggtcattaccccagcagaaagcaggcggacagatttgatgcgatgcaggagcagcgccatcactggacgactcaggcgctgccggcggagatccggcggcatatcgagctgctgcgctgggcggacacgctggtgctgcagttccctttctggtggttcggcgcgccggccatcctcaagggctggatggatcgggtgttcgtttacggcgggatctacgacagccgccaccgccatgaaaacggcgtgatgcgcggcaaacgggcgctgctgaccgtcaccgccggcgcctctgctcaggcctgcgcaccgaacgggcgcgacggcgatatgcggctgatgctgtggccgatcatgcatgcgctgcactatatcggctttagcgtgctggagccgttcctggtctatggcgtgcgcggcgggttggcgtgcgaggagcggcaggcgcagaacgccgctttggcgcaggtgacgcaggcgtatcgggaaggcttaagcgatcttgccgcctggccggcggtgtggttcaaccgcaatgaagattttgacgccgatctggcgctgaagcccggtgcgccggtcgtcgataatcgccggttcgatgtcggggaactgctgctggatatcggcgatggcttcggccacgctcgggccggcgaaggtgccggagaagggcagcagcggcagattggcgtcgctgtccggcagttcgccgcggatagtgccg

SEQ ID NO: 52412 - DNA, 762 bp, Glycine max
  Peptide Sequence Number=SeqID_144097
atgccagctaactttgccgacctcgtcttcgccggagaaagaatcgagtccagactgagaaaaggcaagtttgaatatgcctccaacgtggcccccaacaacaacagaagagccccagtggtgggcacgaggaaaaaggaaggagatacccatgttgtcaccaccgccccaacatggatgaaagcgccccaaaatgtccaaaactcataccagcacaaccccccgaacttctcaatccgagccgggagttccctcccaactcaagtgaaaggacctcccgcaacagaaagaacgcctgcccaacacacaactccagccactccccggccaaccaataatacaactcctggcacgagctataataatgcatggcgcccacccccgagagatgatttctctcctattcccatggcatactccgagttgtggccttcattattggaaaatcatttggtggtggccatacccgggaaggaaggccccaacgttaaaaccaacccactagccagtcatggaggggctagtgtaaacgccatcgaagagcattggccgtcaggggcaaagagattagaagatgtggctacatctagacgcttcatctaccagtcgctacaagcggcatgcatggtctctcgtggcggagacaaaagggatgaatgtttgtatcatctcggggagtcacacgacatggaaacctatcccgcggtggaagaattgcttcaacgactcatggactgggggcagctcgaagtatccaaatga

SEQ ID NO: 52413 - DNA, 230 bp, Glycine max
  Peptide Sequence Number=SeqID_144098
gagggaatgtgcctcttccaaagagcactcttaagatcattccaaaactttattggaggatccccatgaatccttcgttcccttacaagggaagtccaccaatagagggcatacccttgaaagctaagggcctcaacattgtctttttcatggaaatatgggaggctaatgttaacctcttgaggccttctatccttttctcttctttgggagtgatgtttagtatgtga

SEQ ID NO: 52414 - DNA, 552 bp, Glycine max
  Peptide Sequence Number=SeqID_144099
aagataatgctacggcggtcgcttccaatacaactagggaagcggaaccggtgctacaacccgcaataaacttgggccaagacagaaacgcgacgggttttaatcgaaggtatagtcctcaagcctacccttatggtttgcctccagacttcactccccgtaccgctccagacgatttgagccaagcccttaccttcgaggggcagctccttcctcacgtcgactatcctctgcaagaagatgatgaaggagatgcccatttaggccctctacttcccctcaaggaaccagccccccatgagttgccccaaccaaacatagtctgccacgtcccatctccatccgcactcgttaaggaactcgttccctttgcaaaagatcaagaggaaaagattgatctacttgaagaactagtcggagcagcagtggcgtataggtacaccaaatggaagcttctcaaatccggtcatggaaagacttggcaactgccttcattaggcataagccaatacaacacggaagtgtgttcagctcctgatcggacaacttcag

SEQ ID NO: 52415 - DNA, 393 bp, Glycine max
  Peptide Sequence Number=SeqID_144100
atggataaagttgatatctttgtccctcatcctctcacaaacacatctttgcttattcaacttccatcggaatgtgagtgtaagccattggtctgtttgctcaagcaacctgcgctcctgagtgttgacttccaagaccgttcaatcagagattactcatcttgcacgttggtgggggtgtctttaagggaagagaggaatgcaagctcgatttatactggttcggccacttcccgcgcctacgtccagtcctcaagcaacccacttgagattttccactctctttgtaaaacttcttttacaaagtctgaaccacacagggacaacccttcccttgtgttcaagaatccttacaacttaagagaccctcggtcccttaatcaatctctttga

SEQ ID NO: 52416 - DNA, 135 bp, Glycine max
  Peptide Sequence Number=SeqID_144101
atggggtttgctggtggtagtggtagcaaaccctctactttctcaactcggatcacttgttacaagtgtgacaaaaggggcatattcaaagagattgcccatatcccaagaaggagcagaatggtgggggcctga

SEQ ID NO: 52417 - DNA, 219 bp, Glycine max
  Peptide Sequence Number=SeqID_144102
atggatcctgtcaagtacatcttcgaaaagcccgctctcactgggaggatagcttggtggcagcctatgcatccagaattccctgatgaggatataatggccttgtttgaggaggaagttgaagatgaggacagggataagtgggttgtgtggtttgatggtgcgtctaatgcactaggacatgggactggggcaattttggtttcgtcggacaagtaa

SEQ ID NO: 52418 - DNA, 57 bp, Glycine max
  Peptide Sequence Number=SeqID_144103
atgagtgtgaggtcgtggtattgtgttgtagaagcaaagcttcatggtgaatcaaag

SEQ ID NO: 52419 - DNA, 201 bp, Glycine max
  misc_feature (153)..(153): n is a, c, g, or t
  Peptide Sequence Number=SeqID_144104
atgggagaaagtaacaaaaggaagaaagctcctgatcaaagatcgaaagaaaccagaagaaatgtgcagaaaggtctttggaccagacaatatctgaacaatacagaattgtcaccaaatgaacaaaaagaaggaaaggaaaccatgacctanagtggtcttctccctttgattaccagccaaaatcatgtgcgtcagtga

SEQ ID NO: 52420 - DNA, 699 bp, Glycine max
  Peptide Sequence Number=SeqID_144105
atggcagagccatcgaagaagagaaagggatcatcctccaccgccgctgctgctgcccatcgccgccacggaccatctgaagcatccacagcacctattcatccatctttatcatctccaagatcatccacattgttttattctgatgatcagcgtctatggtacctctctcaattttcttctaggatcatcttagaccctaagtacctagatgtagagttctttattgatgaaacgtttgattgctatcaagtatttcaaaattctggtcttgttgatttcatgtcattaaaactgccacattatcctgaacttgtaaaagtcttctactgcaatttgaaaattcaggatgacattatttcctctgaggtgcatggtattcctatgatcattgatcagtccttattcttttctttaactcatttacccagtcaaggtgcaccttttgagggcaccattgttgatgactggaaatttgattattctagtcatgatgctcgtcgaatggtctgcaatgaccaggttgaaatgaccggtagattgctggccggatcattaacttttgataatcgcatcatgcactatataattgttagaattttgcttccccggtcttcaaatttagcacaagcctctgaggaggatttgattctgatgtgggcttttctcaccggtcgtcagatcgactgggcccatttg

SEQ ID NO: 52421 - DNA, 561 bp, Glycine max
  Peptide Sequence Number=SeqID_144106
atggaactttatcattttgagtttgacgagtttaaaacaaaattggagaggcgaaacctttacaaacacctcgccaaccttcaggaggggagcatagatgtggcaatggttaaagaattttacgccaatttctattgtccagtagatcaagctcccaaatgtgctagaataaaaggccatttaatcaagatagacgtagacagcctaaacgagtttctccagactttagtgttattagaggagggggagtctttacctgcttattctagattttgcatattaaggtctgatcccagagagataaaggctagtctatgcatcctgggcaagggttttattctaaacacggagggccaaccatggaagctccttagaaaagatcttactaccttggctcagacatggagtgtcttctcttactcaaacctagctcctacctcccgcacttcagatttgaacacagacagagctaggttggtctatggcttaatcacaaggatggacatgaacattggcggtttgatctctagacaaatgcttagtctaactcttctctcttag

SEQ ID NO: 52422 - DNA, 345 bp, Glycine max
  Peptide Sequence Number=SeqID_144107
atgacagatatgacagttcaggtgaacaacgtctggggccttttgctagatattgttattgaatctcccactcaagataatttggtcgttcatgaagaacaaactcaagatcctcaagaacctatgcttcatgagctagtacctttgcggagatctataagagaaaggagaaatgctattccagatgattatgtggtattttgccaggaacgtgaggaaaataatggtatgattaaagcaatgaatgaaaagcataagtccatgcaagacaacaagaccaagcgggattccaatggtaatgtggagaggtataaagctcgtcttgtggcaaatggctatacctaa

SEQ ID NO: 52423 - DNA, 417 bp, Glycine max
  Peptide Sequence Number=SeqID_144108
atggcgcctaccaggcaccctctggacccggataagtccaacagggccctgggatttcccgccttgatcacaggactctgccagtcattcggcgtccccgtcgcacctagcaaggtgattcggccgcccattacccgagcttttattgagaagtactgcacgcagagacaggtccagggtgatgcaccacaggccacggacgcgccgccacctcatcaggctggtccagccggatcgttggatacggagcagtatttgcggcatttggttcgccagcaggcggccaaccaccgggcacatcctgaggcccaggtaggagaggcaccagcagaggctcccgacgaggcagatgaggcccgcgaggacgaggagatgaccgatttacttgatttcttaggagggagcagggccacatga

SEQ ID NO: 52424 - DNA, 489 bp, Glycine max
  Peptide Sequence Number=SeqID_144109
gtggaatttgatatcccagaggcttatgatagtaggacgaaaaggaagttactgcagaccgtgggggagagatggaggcagtttaaatcagacctcacaaggaaattggcccttgcagccgatcaggacggtgtcgaggacactgtctgtgagaaatacggcatcagcaaggaaaagtgggcccagttttgccagactcgcaaagacccttcttgggaggatgtgcgcaagaaggcacaggccatccagaagcagaatactgccccccacattttgtctcgtgggggttatgattatttggagcaaaagctcctggttgagaagatgaagaagaagctggaggaagctgcacagttaggaactgttgatggcatcatcgaccctccatccccggtcagaagccacgtgaagtggaagatgtcccgcacgaagaaaacacgggagatgacgactgaggccgcaaaggaaaacacgggagatgacgactga

SEQ ID NO: 52425 - DNA, 105 bp, Glycine max
  Peptide Sequence Number=SeqID_144110
gcatacatcacatgggatgaaaatgatatgaaatcttctgaagattcagaaaatgaagagataaatctttgccttatggctaaaagttacaaaagcgatgaagag

SEQ ID NO: 52426 - DNA, 285 bp, Glycine max
  Peptide Sequence Number=SeqID_144111
atggcttcttcacctgcctcccctcctcctcctcctcctccttcacctcctcctcctccttccgacgcatcggcttcaccaccagtggtccacgtggaccctactaccagcaaggtcgacggtccccgcaggaagaaattaagaacatatttgggaatagtggcacgcgataaggtggacgtcacgtacgagaactggaaggaggtccctactgctcagaagggctttatttgggaggatattcaggtggaatttgaaatcccagaggcttctgacagtaggtga

SEQ ID NO: 52427 - DNA, 303 bp, Glycine max
  Peptide Sequence Number=SeqID_144112
atgatgaaggtggagaagaaattgatacatagaataggacaacaacaatctccaaggagtaaaaagagtggggacaacaacaatctccaaggagtaaaaagagtgggtgggagtgaaattgagcatgaaacatcccttgcaacttgcttggcaatgattggcttctctcctagtggcttgcctaggctgattaccaatgaagaacctatgctatttaggtggaacaagcttaatcaattgaaaattgacggtgtgagattttcccaggactctactaggggcaattttccttggcacccttaa

SEQ ID NO: 52428 - DNA, 399 bp, Glycine max
  Peptide Sequence Number=SeqID_144113
atgtcgatctccccctgcggaagtatcagttggttgtgctgtcccgacataggcaaggatcacgcccacaagacacccagtggacctggaggagcccaacagggccctggggtttccagctctggttacgggcctctgtcagtcctacaaggtgcccgtcccccccagcaagggattgcgcccgcaagacacctagtggacccggagaagtccaacagggtcttggggtttccacctatgattacaggcctctgtcagttctacggagtgtctgtcaccccctgcaaggtcatcagggcccctattaaccggactttcatcgaaaagtactgcgccccaggtaggcgcagggcgaggcatcacagtagtgggcaacaggcgcaccgccaccacctctag

SEQ ID NO: 52429 - DNA, 849 bp, Glycine max
  Peptide Sequence Number=SeqID_144114
atgaaaagagaaaaacatgcctcctatagtagtcataactcttgcaaaagcctaagtgaagtactttgtgactattacgaaggaaggcataggtcacatcttagacctcactcccatagaagagaaaaggaaagaaagcctcaagaggctaacattaaactctcatacttccatgggaaggacaatgtagaggctaacttagattgggaaataagggtagagcaacaacttaaggggaagacaatagaaaagcaagcccctaaggctagtttgcaagagaaaactagctctataaagtgctttaaatgtcttggaagaggacacattacttctcaatgccccaccacaaaaaccatgattatgaggggccaagacatttatagtagccaagatgaggctactaattcaccttcctctagtgaaagtgaaaaagcaaaaggggaagaatctagtgaagaaatctacccccaagaagaaggacaaccattagtggttaaagagaagtgtaaggaggtaagtgtctcctccaagagtttagctaagaaagaaactcattttacaataaagacaaacattaaagaaactttccctcttagacaacctccacattttctcttttgtaaaaaggcacttgctagcattgccacacctcttgggcttgagtttattcctcaagtaaagaagtcgttggatgaaggtttggttcgcaagagcttaaatccttgtgctttgttggtgcccaaaataggtattattaggtaccaagtccctaaaataggtggtatgatgaatgtcttgagtggtgcaaccctcttttgtcaaatcactcgtacacctaacatcttcatg

SEQ ID NO: 52430 - DNA, 192 bp, Glycine max
  Peptide Sequence Number=SeqID_144115
atgcaacaaggacaggcagatatcctcatagctaggttccctgaccctaactatggtgttaaaacgctaatagtggctatgggtgatggagaaagtgcatgggactttagaaatggctttgcaagaaagcaagaagaagaaatgacgtttttcctaagctacacgaaagcaaagactgaagtgcttaaataa

SEQ ID NO: 52431 - DNA, 155 bp, Glycine max
  Peptide Sequence Number=SeqID_144116
atcagttcagggcggaggtcgcatggcccggagattggcctgaggcccaggcaggggaggcgcctacagaggctcacggcgatgcagaggaggcccgcatagatgaggagatgaaaaatttacttggtttcttaggagggagtggagccacatga

SEQ ID NO: 52432 - DNA, 418 bp, Glycine max
  Peptide Sequence Number=SeqID_144117
gactgcatctggagacgttgtccctatcaacttagaaattgaagatacttgtcggcgtagcaacgctgcaagaagaagaagggaacaagacacagaaggaagcagttacacctcgcctcctctttctccgcatcacgctaaaatggacggggaaccggcacgaagagtcacccttgaggacttctccaataccgccactcctcatttcttcacgagcattgcaaaaccggaggtacaagccgccaatatttgctacccacactcccttattcagctaatccaagggaacctcttccatggtcttccaagcgaagatccatatgctcacctcgcctcgagaggcaaaacgatggttgcactctttcgaaggaaacaacttaagaacctaggaagaagtagtggaaaagttcttaaagaa

SEQ ID NO: 52433 - DNA, 195 bp, Glycine max
  Peptide Sequence Number=SeqID_144118
atggttgcctttctgcttcggggtatgatagccttgcattcttcttttggattcttcttagtgtttgctccaaaagtgctagaagaattgtcaactatctgttttgccaattggcccagtggaatggagaaggaagagagagaggagatgccacttcaaggagaagatgagtctagaagaagctcaccaccatag

SEQ ID NO: 52434 - DNA, 468 bp, Glycine max
  Peptide Sequence Number=SeqID_144119
atgtcaaaccataaaagcattgagtcagcactgaagaaccttaaggtccaggtgggacaactggccaagcagatagctaacaagtcatccaacagttttgtggcaaatacaaaacataatcccaaggaggaatgcaaagctgtgatgacaaggagaaaaaggtttgtggaggctgaggatgaggatggtgttgtgcataagaagaaaattgctgacaagaaaggcactgatggcaagaaaaatgaggtgagaggtgaaaatgatgacaaaggtgatgacaaaaagctcaaaggtcaatcaaagaatgagttcaagatattcaagatagaatcaagaacacttcaagactcaagaggaaagttgatttcaagaattaagaatcaagattcaagagatcaagaatcaagaatcaagattcaagagatcaagattcaagactcaagattcaagaatcaagagaaggcttaa

SEQ ID NO: 52435 - DNA, 335 bp, Glycine max
  Peptide Sequence Number=SeqID_144120
gtgggcaactggggatggtgtacttatgtctgggcttgtagaaatgggatatttgttttgcgccatcgcccgatcgccacctagtaccacatatgacggagtggtacctgaagatatgtcgcgggggtcaagagaccttggggacgtcaggtggggtgctattgcccaaaaccaagctaggccaatcccgacccaactcgggcatagtcagctagtgagaacctgtgacgtacctaagcaggcgagctcttggcagtcaaccaataaagggacaaaagtccacgaagtagggaggcttggtttaaaaattgaaactgaacgttcagtagctattg

SEQ ID NO: 52436 - DNA, 1128 bp, Glycine max
  Peptide Sequence Number=SeqID_144121
atgtgggatatttctcatgcagaagaatttggcattcatgttccccaatccggtaaagttgatatgaaaaaaataaaggaacggaaagaagccattattgaggaagaccgcaacagtatagaaaaaggtattcttgataatgaaaatatcactttatacaaaggcgaagcacattttgttagcaattatgaagtcatagtaaacagtgaattattgacctccaaaaatattttcatcaatgtaggaagcagaccttatatatcagaagaatataaacatatcccttattttacaaatgagaatttgttaaaaacaattgatctgccggaacatttaatcattattggcggtagttttatcggtgttgagtttgcccaaatgtttaagcgctttggtagtagagtaacaatcgtaaaccggggatcaaggattattcaaacggaagataatgaagtaagctcggaggttgctaagattttagaatctgaaaaagtggatattattttaaatgcagattatatacaggttacagaaaatgaaaatagctctattacggtagttttaaataaagagaaaaccgtctctgttaccgggtcacatattttactggccattggccgtatacctaataccgatactttgcaactgtataataccgacataaaaataaaccacagaggttttattgaagtaaatgactattgccaaaccaatgtgccaggtattttcgctatgggtgattgtaatggaaaaggcgcatttactcatacttcataccatgattatcaagtagtggaaagcttcctatttggaacaaaattaagaaaagtaagcgatcgcatcgttacctatagtttatttaccgatcctccactgggcagggtaggaatgacaaaacaccaagctcttgaaaaaggatataatgttttaatagcacaccgaccgatgaacagaataaagagggctaaagtaaaaggagaagtaaaaggttttattcagattattatagatgccgataccaacctttttttgggagccagtatattgggagtaggtggcgatgaaattataagtgttttgactaacctaatgtatgcaaagcaaccttataccgttctcagggataca

SEQ ID NO: 52437 - DNA, 624 bp, Glycine max
  Peptide Sequence Number=SeqID_144122
gcagctgtgtctccggcaaaaccacctcaaaagtcgtatccgaagatcgatgatccgctttatctgatgacattgaccatcctagagcttttcttgaggccttaccagataaagcacgaagacctctctgaaatcgcacacggtggtcaatgtctcaacatattagtgttacagttgtggattatgcatttgactaaaacaagtatgcgagcggggaattatgatctgtatggattccttgagccacaatccattcagaggtctaggcaatcgcagtttaaggctgaaagttacataaagagttggatgcagagttcaaaacgcgatgtctaccttggagcctacctgaatggcggacactggcagatggtggtcatcatgcccaaggaacacctagttgtctggttttgttcattgcataacaggacagacaactaccttaaggggataattaatagtgctttaaaaggtcttaatgatgctccacagcctaaatcaaaggcttatgctaggtggattgtcgtcaagtattttaacgatcctagaccattggagccagagagattaaaggcgcttcaaatccagtgggcacaatattatctccgagttagagcagagagctag

SEQ ID NO: 52438 - DNA, 279 bp, Glycine max
  Peptide Sequence Number=SeqID_144123
atggtgcttagagcagcaccagccagaatggtcagtgaatacagccctaacctcgacggtgctacagacgacgcgccgtttggtctggctggcgtcgtttcgttcgacgcccccgacgacgacgacgacgacggtgagggagttgttgctgccggagaaatggtgggagtggtggctgacgtcgacggggatggtggcgatgttgccggagccagagtgtttggaggtgtcgcaatagaaggaggttgggaaatgggagaaggaggtgtggggatgtaa

SEQ ID NO: 52439 - DNA, 612 bp, Glycine max
  Peptide Sequence Number=SeqID_144124
atggagaggagtatgattgatgctgccagtggtggagctcttggtgatatgactcctgttgaggctaggaatttgattgagaagatggcttccaactcccaacaattcagtgctagaaatgatgctattgtccttagaggagtccatgaggtggccacagattcatcttcatctactgaaaataaaaagcttgatggaaaacttgatgccttggtcaacctagtaactcaactttgcatgaatcagaaatctgcacctgttgccagagtctatggtctatgttcttctgcagatcaccatatagatctatgtccttctttgcagcaatctggagtcaatgagcaacctgaagcttatgctgtaaacatttataatagacttcctcagcagaaaaaccaacaacagcagaataattatgatctttcaagcaacagatacaatccagcccaagagaatgatttcaagattgagtcaagaacaattcaagaatcaagagaaagattcaagagaaagtttcatcaagaagattcaagattcaagaataatcaagatcaagattcaagactcaaagattcaagaatcaagagaagacttaatcaagataagtattaa

SEQ ID NO: 52440 - DNA, 492 bp, Glycine max
  Peptide Sequence Number=SeqID_144125
atgagaaagcgccacgcttcccgaagggagaaaggcggacaaggtatccgggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcatattacaggaaaggctaatttggagaagtcagatttggagccagctttgaaagctccaaaggacaggctcatgaccaagaatgtgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 52441 - DNA, 711 bp, Glycine max
  Peptide Sequence Number=SeqID_144126
atgaccaccctgactcagatatggatgactttgctactcagcaacatcctgcccaccgatcataattccgacctccccctgccgaagtgtcagctggtgtacgccatcctgacgcggatgagcgtccatgtggctcagttgatcgctgatgccatctatatttttgcaggtatggcgcctactaggcaccctttggacctagataagtccaacagggccctgggatttcccgcactgatcacaggactctgccagtcgtttggagtccccgtggcacctaccaaggtgattcggccgcccatcacccgggcttttattgagaagtactgcacccagagacaggctcagggggatgctccacaggccgcgggcgcgccaccaccacctcatcaggctggcccggctgggtcatttgacatggagcagtatttacgacatttggttcgccagcaggcagccaatcaccgggcacatgtgcagacccatgattgtctataccagatgagcctcagcatgcagagccagggcttcgcttctttttcatgccctactccagaccagttcagggcagaggtcgcatggtccggggattggcccgaggcccaagcaggagaggtgcccccggaagttcccggcgatggagaggaggcccacgaggacgaggagatggccgatttgcttgacttcttgggagggagtggagctacatga

SEQ ID NO: 52442 - DNA, 308 bp, Glycine max
  Peptide Sequence Number=SeqID_144127
atgtaaccttctttgaagacacacctttcttcttagcctctgtagatcattcttcttctctccaggaagtactgccaattccttgtcctctaggtaactctgaccaaaatgtcaatgaagtcccatcttctctaccaaattcaattgaagttgtctctccacctctgcttacatatcatcacaggacacggccagctgattctacagtacctgaagcctcccctcgtgattctcatccttctccaactagtcctccaaccatggatcctgcttcctcacctgtctctcatcactctgagtcagactga

SEQ ID NO: 52443 - DNA, 787 bp, Glycine max
  Peptide Sequence Number=SeqID_144128
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatccccctaattacacaggccaaatcaacaagtcttccaactgcatggctgtagatattgatgatgatgattctctctttaagaacattgatgttgaccaaattgttgaggactattgcactcccaaaccatcaatatccaagcttcctcctataacaccaactgccgataaagataattttgctagacagggggatgatgttttgccaccggaactgtgtttagattgcgtgcatgggtacatgttagggttttgccctgaagcagctagccatttgcaggatatgaaggataatctaattgcaatctttaatgagctgcttgacaatggtgaaaacctcaattctacacagatagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 52444 - DNA, 210 bp, Glycine max
  Peptide Sequence Number=SeqID_144129
atggcacatcaaatatcaaaggaattaattcaaggtaggctcatttgggtagaggcttataagaacaaaatgcctaaatcatctcccaacatgcatgtgaagcaagaagtatcaacaagagtcaagccaaggctattgtgtaagcaatcaatggggcaaaacacacaaaataaaatagatgatgatgactcaaattctcaccaagggtaa

SEQ ID NO: 52445 - DNA, 609 bp, Glycine max
  misc_feature (422)..(422): n is a, c, g, or t
  Peptide Sequence Number=SeqID_144130
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagagngatcccctcacggcctgcagcgacaggtcgtacacctcgatgttgcgggcgatgtcgcgctgcaggatcagcgagaggttggggtaccgagctcgaattcgtaatcatggtcatagctgtttcctgtgtgaaattgttatccgctcacaattccacacaacatacgagccggaagcataaagtgtaa

SEQ ID NO: 52446 - DNA, 201 bp, Glycine max
  Peptide Sequence Number=SeqID_144131
atggcagcgcagttgatccatgatcgtgttgtgatggagtgcctaaagggtgtttgggagaccctcaaaggcaatgagagtacatccggaggaacctgcacacacacttcagcagcctgtggagtggatactacctacacctactccatatcgactagtggagccagttcaagtcatagaggttgtggcgtccctaaataa

SEQ ID NO: 52447 - DNA, 426 bp, Glycine max
  Peptide Sequence Number=SeqID_144132
atgcataaggcattacgggccaatgcacctctcccttatccatatttgattactctgtttctgcatcattttcaaattccgcttgatgatgaaccatttcttcaagtcaagcgttcctttgcaattggtgctggtgccgtgacttcctttgggtaccgtaaagatcggaatggtcaatggctgaagaaggatgcactccctcctcaagatgaacgtactccttcacctcctcctcattgcgatgattcagcactcatgaatgaagtcctctccgaattacgaggtcttcgttcttatgtttgtgaccacttcgactcgttagatacacgctttgccggcatggacattcgcctcacacagcttgaagaggatgtaggttacatttgtcagagtttcgatcttccaccaccacctccgtcttcttag

SEQ ID NO: 52448 - DNA, 300 bp, Glycine max
  Peptide Sequence Number=SeqID_144133
atgtggacaaccacgggggagaagcttgccgcccagctcgcccaagcgagcaaggttgcttcctccagaagcaacagccttctggagggcccaagtgggcctgctttcgaagaagttacggaaacccacggattgcccaaagacacctcttttcgacttctgccacattacggaatttcacggatcgcgcaaacctacttccttttgatttctgagacgtctcgggacttcatttactgtgcaacaaaggatgccaagtatctcaaagcggctaaccaaaggttgcatgtcatcaagtaa

SEQ ID NO: 52449 - DNA, 577 bp, Glycine max
  Peptide Sequence Number=SeqID_144134
gatgttctcaccgctgctattggacatccagagcaccctggacgtgtacgtgctgctggagccggtgtcaccatcaagcaatactttggatcggctccacagacaaaaagtgacgcggcagctcatggtatcattcagccagatgcagtcccagatttagtcccagatgcaatctcagggacttgcactgcctcccgagcctctggttggtccctcagatcctgcccgctggttgccatggggagagtttatgagggatccattgttgttcataacactccgttgttgcctggccaagtaaaggtgggtgtggaggaggttacagatgcagatgctccagttcctatacccacttatgaggtttccttagtggggcaggcagttgtgtctctggaaaaaccaccacaaaagccctattcggaggtcgatgacccgctttatctgatgacattgaccatcccagagcttttcttgaggccttatcaggttacatgggatgccaccgtgtttggggtctttaatccatatttcccgctttacataaagcacgaagacctctacgaaatcacacacggtg

SEQ ID NO: 52450 - DNA, 270 bp, Glycine max
  Peptide Sequence Number=SeqID_144135
atggcttacaccctacattccgggatttacacacgcaattctcctcaaatttcagccagcccgcatcaattagaccttgcaccttacgcttcagagccctaccatgctcaatggaatgccccggggcttctccgtgacaagcacacgttgcgttcgagtcgtattctcggagaaatggaggttgatgaaccttggctagggttatggctaccattgaattatcaagtagatatgggagcaagtcagcataggacactagaattggggtga

SEQ ID NO: 52451 - DNA, 498 bp, Glycine max
  Peptide Sequence Number=SeqID_144136
atgagaccacaaaccaatgaactgctagatgcttctgctgggggaaaaataaagctgaagaccccggaagaagcaactaaattgattgagaatatgttagccagtgatcatgccattctgcgcgacaaaacccatcaacccacaaagaaaagcttgttagaattatcatcacatgatgctttcttggcacagaataagttgctgtctaagcaacttgagagtttagtagaagcactcggttgtaccatctgtggtgaggcttatgagacaggccaatgtaatcccattgaagaaaacactcaagaaattcattatatgggaaatcaacagcggcaagggtatactccaggaggattttcaggcttccaacagggtccttatagtcaacaaggacagtggaggtcacaccctgcaatcagttcaacaaagatcagggtggaccttcgaataggccaatccaacaagggcctaacatctttcaaaggactactaagctag

SEQ ID NO: 52452 - DNA, 357 bp, Glycine max
  Peptide Sequence Number=SeqID_144137
atgaaaggacgtacctcaatcgataagtggcagagacgaactcagcaaagacgaactccacaatgtgcttacagtgatggcagggcagggcagtttgcggcaaagacgaaattaggcgaaaggagaaagaagaagaacaatagggttcaagcgcggggggtgtgcagtttcagctccattggagcttgtaggcctaggatcttcttcattaatggattcatttgcttcttggaagatgaatggcagtggaatggagaaggaagagagagagaggagacgccacttcaaggagaagatgagtctagaagaagctcaccaccatatgaggagagagagaggagacgccacattttttaa

SEQ ID NO: 52453 - DNA, 366 bp, Glycine max
  Peptide Sequence Number=SeqID_144138
atgggtgatcaagaggagacacaagaacagatgaaagacgacatgtcggctttgaaagagcaaatggcttccatgatggaggccatgttgggaatgagacaactcatggagaaaaacgtggccacggctgccgctgttagttcggctgccaaagcagacccaactcttctagctatcgcgcaccatcctcccccaaatgcggtaggacaagaaaggagcacactggggcacagcaacaacccccatttgggatacaaccaggtggcttacccttatggattaccacctaattacacactgccagtcatacatgatgacgcaggtcatgtcccctccctcatccttgaaggggagcctcctcgataa

SEQ ID NO: 52454 - DNA, 574 bp, Glycine max
  Peptide Sequence Number=SeqID_144139
atacaaccctggatggaggaatcaccctaacctcagatggtccaaccctcagcaacaacaacagcagcctgctccttccttccaaaatgctgctggcccaagcagaccatacattcctccaccaatccaacaacagcaacaacctcagaaacaaccaacagttgaggcccctccacaaccttccctcgaagaacttgtgaggcaaatgactatgcagaacatgcagtttcagcaagagaccagagcctccattcagagcttaaccaatcagatgggacaattggctacccagaattctgacaagttgccttctcaagctgtccaaaatcccaaaaatgtcagtgccatttcattgaggttgggaaagcagtgtcaaggacctcaacccgtagcaccttcctcatctgcaaatgaacctgccaaacttcactctactccagaaaaaggtgatgacaaaaatttacctaacaatttctgtgcagaagcagcacattccccctcttccattccctccaagagcagtttccaacaaaaaaatggaagaggcagagaaagagatattggaaacgtttag

SEQ ID NO: 52455 - DNA, 375 bp, Glycine max
  Peptide Sequence Number=SeqID_144140
atgtcaaatcataaaagcactgagtcagcattgaaaaaccttgaggtccaggtgggacaactggccaagcagatagctgacaagtcatccaatagttttgtggcaaatacagaaaaaaatcccaaggagaaatgcaaagctgtgatgacaaggagtaagaggtttgtggaggcggaggatgaggaaagtgttgtgcccaagaagaaagctgctgaaaagaaaggcactgatgaaaagaaagattatgtgatatgtgaaagtaatcaagaaaaagaaaaacaaataatgaatgacgagaggagtagaagtgaacaggctagagagaagaaaaaagaaaaagctgtgaatgacggtgtggaagtaccatatcctgtg

SEQ ID NO: 52456 - DNA, 454 bp, Glycine max
  Peptide Sequence Number=SeqID_144141
atgaagaatggatccattcttggattcaacagccttcccaatagcacagaaattaagtgcattgagactgagagacaagtactcctcaacttcacacatggcctcatagatgactttgacattctctctacatggagggacgatcacagtaacagagactgttgcaaatggaaaggcattcaatgcaacaatcaaactggtcatgttgagatgcttcatctccgtggtaatggtacacaatttttgagtggtgcaatcaatatctcttcattgattgcccttgaaaatattgaacacttggatctcagctctaatgattttgaagtgagtcatatcccagaactcatgggctcgttcaccaacttgagatatctcaatctctctgattctttatttggtgggagtattccttctgatattggaaagcttacacatttactgtctcttgatctag

SEQ ID NO: 52457 - DNA, 858 bp, Glycine max
  misc_feature (113)..(113): n is a, c, g, or t
  Peptide Sequence Number=SeqID_144142
atgagaaagcgccacgcttcccgaagggagaaaggcggacaggtatccggtaagcggcagggtcggaacaggagagcgcacgagggagcttccagggggaaacgcctgggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccatcctcctcttgtacatttgggtcatataaccattgatcaccaatatcatggttctactccaacacaaccacctagtgaccttctcttctcagctccctcgctgctactagccctgatggtccagctccaattacacatacattcttcgaccgctttgtctcggaaatcatggtttgatagggatggatggatgaatcatatacgtggtggtagaagacagagattgcaatcgtgtatgggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 52458 - DNA, 876 bp, Glycine max
  Peptide Sequence Number=SeqID_144143
atggccgaatcatccaggaagtgcaaggaatcatccacctccgttgcggcaactcgaacaccacgccctagagccaccggagcatccccgacgccaattccaccttccttgtcatcctctacactgttttcatttgatgaacagcgtatccatcagggtgcaccttttgagggcaccattattgacaactggaagtttgattactccagtcttgatgcccgccgtatggcctgtaatgatcaggtggatatgaccggcagattgcttgccggttcattgacattcgattgtcgcatcatgcactacatcattgttcgcattctattacccaaaccatcaaacttagctcaagcctctgaagaggatttaatcttgatgtgggcttttctcatcggtcgttcgatcgactgggcctatttgatcagataccggatgcataaggcattgcggtcaaatgcacctctacctaatccacatcttgttactttatttcttcatcattttcaaattcccttggataatgagccctttgtgaaagtcaaacgctcctttgcaattggtgtcagtgcggtaacctccttcggctattgtaaggacatggatgggcaatggttgaagaaggatgcacaacctccacaagacgaacatactccctctcctccgcctcaacgagatgactcctcagccctaatgcatgaagttctttcagatttatgcggcctccgcacctatgttggtgagcgctttgattccttggatggtcgtatcgatgccattgatgctcgctttgcaggcatggatacccacatcactcaacttgaggaggatataagttatgttcgtcagtgcttcgatcttcctccaccatcttcatag

SEQ ID NO: 52459 - DNA, 213 bp, Glycine max
  Peptide Sequence Number=SeqID_144144
atgggggaatgggagctttataccttaaagttgcagaggcaagttccagccgaggtaggagatctatcatatccatacgaagataggaccttcaaagcagcacaggtagcagtggttgattttcatgagcgtgatttagctagaagtttaatagtctttgcccacaatcacggagattctgctttcgcagagatggaaacgccgttctgttaa

SEQ ID NO: 52460 - DNA, 195 bp, Glycine max
  Peptide Sequence Number=SeqID_144145
atgtatttccccctcaccggaggctccgtacttgataacggaggacgcatgaacaacgctagactcgatggtggaggatgcatgaatgacaatcaattcatggggctctggataagatttgatggtggaggatgcatgaacaacactaggcaatcaattcatggggttccagactcgatggtggaggatgcatga

SEQ ID NO: 52461 - DNA, 576 bp, Glycine max
  Peptide Sequence Number=SeqID_144146
ggccatcctggaaagattcttaagaaggatcggactacactagctcaggtttggagtgtcctcttatactccaacttggcccccacatcacacacttttgacttgacagtggataaagctaggttgatctttggcctagtctctcgcttggatatgaacatagggacgctgatctttggccagatgacctctatagcccagtctaatacttctagacttaggttacctgctctaatcaccacattatgtagagccagaggggatgtctctgatagcctcacttttgagcgcctgagcccggatgagtcatctgaggccaccatcccagatccatttgttataagagaagaggcaggggagacacaggctacttcagagccttctacacaaggggaggatataccctcacctcagcatgcaacagacccctccactcctcttctagagatgctagaggacccgactacattagtcctggctatggacacttctcctccagctactccagtattacatctgacagatgaggaggatgttcagactcgggacccccaggaccagtcacaagaatcttga

SEQ ID NO: 52462 - DNA, 624 bp, Glycine max
  Peptide Sequence Number=SeqID_144147
atggcttcgtctggtccagttctctccttctccggaactccaaccatcacaacagctaaactcaactggaaaaattatctatcttggtccgcttcagtggagctgtggtttctcggccaaggtcaccatgatcacttggagaaagctgctgaggaggttccaatcgataaaagacctgaatgggagaagctggattatcagctttgtgcagttttatggcaatcagttgagccagacgttttggagatccttagatcattcaaaacatgttgttctttctggaagaaggctcgagaaatctttgccaatgatattcagagtctgtttgatgcaaccatgaaggttacagctctcaagcaaaccaaccacgatatgattgcacacataggtaaagctcgggctgcagtggaagagttgaagaggttccttgtggctgactcgctggaggaagtgaacaggaagctggataagtactatatggttcttatcttgaggagtctacattcagactttgatcatgtgcgtgatcaagtcctagctggagaccaagttccatcgatggactctctcatcactaggctgcttcgtgtgcctcatgcactgaaagaagacaatccagctgag

SEQ ID NO: 52463 - DNA, 360 bp, Glycine max
  Peptide Sequence Number=SeqID_144148
atggactctagagatggtggctattgtagagctgttgttggtgtgtctgtggccggttgctactactggtcttgccccagctcctttgtctgccttggcatgcagtatttctcaatgaacgacctattaatgggagataagttaggctacacaaacactgatctaggtcaaaatagcataaaccagctagcatttaggcagccggagatcagagttatggttgttgggaaggatgttgctgaggagaagcatcattcagatctgtgtctaggtggtcatgctagtgcgcatgatccacacccgccttggatcttcttcatcaacggagtcctttgcttcttgaagtttaatggcaattga

SEQ ID NO: 52464 - DNA, 321 bp, Glycine max
  Peptide Sequence Number=SeqID_144149
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcaaacgacggccagtgccaagcttgcatgcctgcaggtcgactctag

SEQ ID NO: 52465 - DNA, 363 bp, Glycine max
  Peptide Sequence Number=SeqID_144150
atgccgggagcagacaagcccgtcagggcgcgtcagcgggtgttggcgggtgtcggggctggcttaactatgcggcatcagagcagatttgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccctga

SEQ ID NO: 52466 - DNA, 228 bp, Glycine max
  Peptide Sequence Number=SeqID_144151
atgaaacgcgagacactcgacggtaaccagcacacaccctttgctatccagcgacccgagagtccggtagcatgcggagacaccttacagttatctgctcctcgtcatttggagaccccaagtcggattgacaagcagagaccaatgtggtcatctgcaccctttccggagatgtcggcatcttccgatagagactattttagtctcacagaggcaagaactacgtag

SEQ ID NO: 52467 - DNA, 222 bp, Glycine max
  Peptide Sequence Number=SeqID_144152
atgtctatcaggtgtgatagtcaggcaactttggctaaggcatatagtcaagtgtataatgggaagtctagacacttgggtgttagacacaacatggttcgggagttaatcatgcatggtgcaagaaagaaaaggactacctatataagcatgaagtttagccgcttcaagaagctgggacttggctttgatatgcttatgaaggatagggacacaggctag

SEQ ID NO: 52468 - DNA, 468 bp, Glycine max
  Peptide Sequence Number=SeqID_144153
atgagatcccaatcaaagagtgggagaaagaaaaaagaaaagaaagaaaatcccaaccaaagtaatgggagaaagtggaaaaagagaatggaagtcctgtcaccatttacaagccttgagccaaaatctctgactcaccataaaccttccctcggaagcattgtttgtcactcaaaaaagaaggaaagggaatttccaatcaaagagaaagcaaaaaaggaaggaaaggaaattcccaatcaaagagaaagcaaaaataggaggaaaggaaccaccgagactttttcaagtctcacaagttatccagaactacgtaggtctgagttcctcattggaggatacgtaggagcaaaagcctcgcttttgtcgaaccgcgccgctttctgttaccatgacccaagagctggtagcccgcggagacaccttacggttatccgaacctcgtcattcagtgaaccccaagtgtga

SEQ ID NO: 52469 - DNA, 300 bp, Glycine max
  Peptide Sequence Number=SeqID_144154
atgtctcttgctacattatttggaaagttgcaggaacatgagatggaattgcaaagacttaatcaaaatgagaaagagcaagcatacgtatgcttaatgaccaagaatcatgaaagtgatgaggaggattccttaaagaaaaagtggtacatagacagtggattctctaaacacatgacgggagatgtctcaaagttcacaactatctctcctaagaaaagcgggcatgtaacctatggcgacaacaacagagcaaagacaacgatccttaactatggcataaaaggatcgctcacataa

SEQ ID NO: 52470 - DNA, 315 bp, Glycine max
  Peptide Sequence Number=SeqID_144155
atgcggcatcagagcagatttgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgctctgtctcatgggtggaaataa

SEQ ID NO: 52471 - DNA, 135 bp, Glycine max
  Peptide Sequence Number=SeqID_144156
atgggagggtacatcccttgtggatctttgcttgttgtgatgcaatcctaccccgcaagggcattggataaaaaactccaagttgattgggccagagatgcaagagaaggccctagggttcttatgagccttagg

SEQ ID NO: 52472 - DNA, 538 bp, Glycine max
  Peptide Sequence Number=SeqID_144157
atggcctcctatggtggtgagcttcttctagactcatcttctcctggaaatggcgtctcctctctctcttcattctccattttgctgccattcatcttccaagaagcaaaggaatccattgatgaagaagttcctaggcctacaagctccaatggagcttacatcaagtacaaccaaagcaacaatgaagatccaacccatgagtgttgttttggttggtgtctccaatcttctttcttccatctccattctgctgccattgatcttcaagaagaaaaggactccattgatgaagaatatccaaggcctacaagctccacatggagctacatcaagaagttggttgcttcccaagaactagggtggttctatggtgagctatcttcccttctaggaactgaattgctctatgggtcaagctcatatgaagagttgaagaatacttggcttgtctctcccatgaccaaaccaggtgtggtgttgtggagaggagatgttgaaagtctagtaggtggttggcaaggaaagtctagcaagg

SEQ ID NO: 52473 - DNA, 254 bp, Glycine max
  misc_feature (250)..(250): n is a, c, g, or t
  Peptide Sequence Number=SeqID_144158
atgacgaatgaagaacaccaaacggagaatgatgtagaggatgattacagtcgcgattcggcagcgcctcgaccttattttctcttctttcttcttctccttccttctttctctcaaaatctctcaatgttgaatgctggaaccctttactcaacctccctcatgcctatttatagtaaaaaatggcccttggaacaaatggcagctcgcccaagcgagctaatgcttcatcttgaagtaactggctcanccag

SEQ ID NO: 52474 - DNA, 201 bp, Glycine max
  Peptide Sequence Number=SeqID_144159
atggagttttgtagtttactatggtatctagtacaaaatgttgagcagctgtcaatcatacaagcagctccctttggagcttgtaggccttggatcttcttcatcaatggagtcccttgcttcttgaaaatgaatggctgtggaatggagaaggaagagagagatgattggagacgccacttcaaggagaagatgagttaa

SEQ ID NO: 52475 - DNA, 535 bp, Glycine max
  Peptide Sequence Number=SeqID_144160
atgactagaggcaatccatctgacttacaaccctttgatcctgtgatagataggacatttcacagattagttaggcatcattttataccttttgatcattctgagcattccattactggtgaatctgtgcattctgttattggtgattttgaacatcctgatcttgagcattataattttgagcattctgattctgagcattctgattttgcacattttgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggtgaagacccgcacaaacatttgaaagaatttcacattgtctgctccaccatgaaacccccagatgtccaagaggatcacatatttctgaaggcttttccttcattcattagagggagtggcaaaggactgggctgtattaccttgctccaag

SEQ ID NO: 52476 - DNA, 687 bp, Glycine max
  Peptide Sequence Number=SeqID_144161
atgtcggtgcaaaaagcggtggccgagaagtgggagaaaaccaccggcaaacacctgctggaaggctatggcctgacggagtgcgcgccgctggtggccggcaacccttacgatctgaaacactacagcggcagcatcggcttaccggtgccgtcgacggatattcggctgttggacgacaatggccaggatgtgccgccgggagaaccgggcgaactgtgggtcaaaggcccgcaagttatgttaggctattggcaacgcccggaagctaccgacgaagtgctgaaagatggctggttggcgaccggtgatgtggtgaccgtggacgagcaggggtttgtgcgcatcgtcgaccgtaagaaagatatgatcctggtctctggtttcaacgtttacccgaacgagatcgaggacgtggtcagccagcatccgaaggtgctggaatgtgcggcgatcggggtgcccagcgaggtctccggcgagacggtgaagatctgcgtggtgaagaaagacgcctcgctgaccaaggaagagctgttgacccattgccgtcggcacctgaccgggtataaagtgcctaaaattgttgagttccgcgatgaattgccgaagtcgaacgtcggcaagattttgcggcgagaactgcgcgatgagctaaaaacgccgaaaccggccgatgccgcctag

SEQ ID NO: 52477 - DNA, 261 bp, Glycine max
  Peptide Sequence Number=SeqID_144162
atgggtgaagtagaggaggtacaagagaaggtgaaggccgacatggaggccatgaaagggcaaatggccatgatgatggagaccatgatgatcatgaagaagataatggaagccagtgcagttgcagttgccgctaccagcactgttgctaaggtgaatctgatgccccaatctggcctcaaccaaatgaatcatccaacctcaactatggtaggcaaagacttgggaagtatgggcggcccccatgatgtgcaaatttaa

SEQ ID NO: 52478 - DNA, 369 bp, Glycine max
  Peptide Sequence Number=SeqID_144163
atgtcgaaaaatggtcgaaaaccttcgcgtaattactcacggaaacgttatggaagcgcctcggcttggattttcttcacggaaacaattttcctcggcaatttcgagagaataagaagtgccaagaaggttgaaccccttcccccttcattcctccccctatataatagcaaaataggggaggagcttgccacccagctcgcccaggcgagcaaggttgcttcctccagaagcaaccgccttctggaggaagaaactggaaggcccaactttcgaagaagttacggcacggattgcgcaaaaacacctcttttcaatttccgccacattacggaatttcacggatcgcgtaagcctgcttccctttga

SEQ ID NO: 52479 - DNA, 179 bp, Glycine max
  Peptide Sequence Number=SeqID_144164
tatctgaagcttctcctcctgattctcatccttcttcaatcaatcctcaagccatggatcctgctacttctcatccctctgattcagactggcccattgtcatccgcaaagttaaagttgggcctaatggtgagattgatcgacttaaggctcgcttagtggctaaaggttatacttag

SEQ ID NO: 52480 - DNA, 1212 bp, Glycine max
  Peptide Sequence Number=SeqID_144165
atgcctaagaagcaaaagaaagtgaagcagttcgagcctgaaccttcggtgactgtcgagggtggcgagccaggcaggaagaaaaagataaaaaccaagtcttcaaaagaacaaggtgagaatcaacctgttgacgtccaaccaccttcgactgatgttgacggcactgaagcagaaaatactccctctattgctgagatgggcaaccctgtcgagcaaccggacttaccacaagaacaacctaccgtcgaggtacaacaaaatgcttcagtagaagaaataccctcatgtgctcgaacctctcctgctcctgagacggatgcagtgaatgttgaggaacagggtgaaggtcaagaggccatacaagaggctgaagctggaggttcggacatttacccggcgtcttcaacctctaagctttccgccagcgtagggatcgcagaagaaacgttcattaaaatgcaagacgaagacccagctgcagcccttcgactcctgctgaacaccagtcaagccaacacctcaagtgaaaagattcctggtgcttcgtcctcctctgatgctgacataacctcttcagtacgccaagattgcctgctcttgaagttatcaatggaatacgcacgggaagacgtacttaaatccattgaagagaacccctctgccgcttttggacacctgaattttttgaagaaattgcataacccccttacctctgatgagattctaggcaaagttatccaaatcgaggccatcatcgaccagtttgcaagtaccgtgcagaaaaaacgcgaaaatgacgccagactagatgcccagaaacaggcacatatccttctgctcgagaaagcccaaactgctcaacatgaagtcgaacgtctcaccaaagaggcgaaagaaggatcttctgagatcaaagcctgtgatgataacatctcttcctgggaggcaactattatggatttgctgtctcaggttgatgatttaaggcagaaaattgtgacagagcaggccaaacgcaaggaactccaggagaaggccgctcactcgattcagaaactgattgctgaaaaagggagggaaggcctgaaggcctttagtgcatctcaagcggtagcagatgaggcgagagctatggagagtgctgaccaggtcttgagcaaagagatggccaccctgaagaaactatatgaggacttagtcatgcattag

SEQ ID NO: 52481 - DNA, 445 bp, Glycine max
  Peptide Sequence Number=SeqID_144166
cggacacgcaaagcctcatgtctacgatcgttgtcctactagaccacctggtgctgagagactagtggtgcatgttgatcctgctaccgggaaggccgacgatccccacaagaagaaattaagaacatatttggggattgtggtgcgtgataaggtggacgtcacctacgagaactggaaaaaggtccctactactcagaaggacttgatttgggaggatattccggtggaatttgatatcttagaggcttctgatagtaggacgaaaaggaagttacttcagaccatgggagagagatcgagccagtttaaatcagacctcacgaggaaatgggcccttgtagccgatcaggacgaagtcgaggacactgtctgtgagaaatacgacatcagcaaggaaaagtgggcccagttttgccagactcgtagagacccttcttgggag

SEQ ID NO: 52482 - DNA, 213 bp, Glycine max
  Peptide Sequence Number=SeqID_144167
atgcagagccaaggcttcgcttctgtgtcaggccctactccagaccagttcagggcagaggttgcatggcccggagattggcccgaggcccaagcgggagaggcgcccctagaagctcccggcgatggagaagaggcccacgaggacgaggagatggccgatttgcttgacttcttgggagggagtggagataccgcatacatttttgtttag

SEQ ID NO: 52483 - DNA, 252 bp, Glycine max
  Peptide Sequence Number=SeqID_144168
atgtggctctgctccctcccaagaaatcaagcaaatcggtcatctcctcgtccatgcgggtgcctctactgcctgggcctcaagacaatctccgggccatgcgacctctgccttgaactgatccggagtagggcatggaaaagcggaaaaaccctggctctgcaggctgaggctgagctggtagaggcagtcatgggtctgcacgtgtgccctgtggttggccgcctgctggtgaaccgtgggatcctctag

SEQ ID NO: 52484 - DNA, 204 bp, Glycine max
  Peptide Sequence Number=SeqID_144169
atggcgcttgtactgtcacattttatgggaatatggatttgtgcacaacaactaccagcagagatgtactctgcttcggctgtggataatgctaacactattttgcttcttgctattccaagagacaagagcagaccctatgaactaacatgtgccactagtgctcttcctatctgttttagatccggcaaaatccgaatctga

SEQ ID NO: 52485 - DNA, 312 bp, Glycine max
  Peptide Sequence Number=SeqID_144170
atggtatgtcacattgttggtcaatgctttgtaatgtgttttttcatgtttcttgttatacctattgatgtttttgaaggaattactgatgaaggtgttgccaaagttgttgatggtttggctctcaaagttgttgatgaaggtgttgccaaagttgttgatgaagctctttcctctgagtctgccctttttcttggtaatagtatgcccattcgagatgcaaatatatatggatctgctaacaagggggctagtggtattgatgggttacttagcacaaccattggttttgctataggatgcaacaaaaag

SEQ ID NO: 52486 - DNA, 402 bp, Glycine max
  Peptide Sequence Number=SeqID_144171
atgacacaaggttcgtttgtcccccagggtcgtgacaacatacttaacacgaccatagggagaccagatcatggaggtcatgttcgtgctgcggggtctggggtgggaggacatcacgtgcctccaatggctgagataataggaagcattagggaacaagtaaaaaatgagattgaagaagaaaagaggcgaagtctagagacatggaaaaaaaagttgaaggatgccaatattattgagatgtcgcaaaagggatcgcaggttgcaacacctactcacgtggatataaatgtgttaggtgcacgcgttagcactaaggagagcaatgctaaaattggtgtcaacccatctggggaagaacaagttggtcatgtcacaccgactatggggttgtatgtctga

SEQ ID NO: 52487 - DNA, 381 bp, Glycine max
  Peptide Sequence Number=SeqID_144172
atgtttcctataaattttgacacagctgacctcaggctcactaagcttggtggtgggaactttaacttatatggtggaggccaacagtgcagaatgttaggaacatctcagggtttgaaagaattggatgaagctatagagttgtttgaagaactcgacagcaacaacaatgttccattggggaattttaatgaagcatgcaacttacttgagaggcaaaacagaaagggatgtatacctaatctaattgcatataattgcatcctgacttgccttggaagaaagggaaaagttgaggaagcattcacaatccttgaagcaatgaaaatggatgcagctaccaatcttacatcctacaatattttaattcacaggctatag

SEQ ID NO: 52488 - DNA, 240 bp, Glycine max
  Peptide Sequence Number=SeqID_144173
atgagggttcactgttatcaagctagtcggagacccaacatgaccacagattcacctccactccttatgttcccatggacccggcggagtcgccaactgtcgcaacctacccttcggcgggatggcgacgcgggactcacgggcgcgtcttccaagaaaggaaaatgcgcggagtcgccaccaacgtttattcgaggaaaacatcggaaaaaccagaaaggtgtggtctacaaactttaa

SEQ ID NO: 52489 - DNA, 174 bp, Glycine max
  Peptide Sequence Number=SeqID_144174
atggatattttgactctcgttagctcaattgagctgttcgacactgatactaaaagggaggggcaaaagggtcttttcagggttttttctggaccccagctcgcccaagctagcctctggcttgcctgggcccttaaatggcttagggttgaagtaaccagctcacttgggtga

SEQ ID NO: 52490 - DNA, 495 bp, Glycine max
  Peptide Sequence Number=SeqID_144175
atgttttcacggtgtccttaccgaacccgtgatagaggtagagtaatgggtaaagtagaggaggtgcaagagcagatgaaggtcgacatggaggccatgaaagagcaaatggccacaatgatgaaggccatgatgagcatgaagaagataatggaggccaatgcggttgtagttgccgctaccagggctgttgctatggtgaacccgatgcccccatctgatctcaaccaaatgaatcatccaacctcagatatggtgggcaaagatttgggaagtacggatgaccccatgatgtgcaaattcaaaacgagcacgccttcccgccacatggcttgcctcccaactatacgccacccaatgtggcgtacactcccaatgagaagaatgtcaataactccattcctatacccattgagagccaacaaccccaaactgatcatgcacatgtctcttaaaccgtgggggagacacatgaaattccccaccacaatctag

SEQ ID NO: 52491 - DNA, 346 bp, Glycine max
  Peptide Sequence Number=SeqID_144176
atggtgcccgaaatcggcacctcgttttgccttcgagggtctcccaagctccctctaggcactccatctccactcgatcatggattagctgtgccgccatcacgatctacaagaaagaaaagaaaggggctggtaatcgattaccagaggctccctaagtttcctgacttcgttttcaagcctggtaatcgattacaccccttggagctcgcctgcttaggtacatcacaggttctcactgaccgactatgcccgggttgggtcgggattggtcaagcttggttttgggcaatagcaccccacctgacgtccccaaggtctcctgacccccgcgacatatctccag

SEQ ID NO: 52492 - DNA, 189 bp, Glycine max
  Peptide Sequence Number=SeqID_144177
atggagaattggcgaaaagcgctacgcaataacttcgcggggctttccagactcgaagagctaggcaatgacattcgtgggtctccgaataaaagtggagaatggagaattggcggacagcgctacgcaataacttcgcacggctctagactcgaaggtggggaatgcatgaacagcgctaggcaatga

SEQ ID NO: 52493 - DNA, 336 bp, Glycine max
  Peptide Sequence Number=SeqID_144178
atggtggggatgtctcctccacctctaggacctctcaatcactcacaaactcagctcacgctctcaggacggcttccttttccagctctggtctctgtagatcttcgcaccacaaaatctctcaaactctctggaatttggacctctctctctctctctagaattgaagacatgcaaaagctcctcaagaaaaatggccaaactccacctctaaatctgatttcaggcttaaataggtggctttgttcgtgctcattcttcctcgcgcttagccgaggagggttgcactcagaggatggctcgttaagccagcagattagcttagcgagaaggtga

SEQ ID NO: 52494 - DNA, 384 bp, Glycine max
  Peptide Sequence Number=SeqID_144179
atggacgaagatcagtggatgtatgaacgtataatgcctgaagaagtggatatggatgatgaaaatgaagaagaatgtggtgtgaatgaaccacatgttgattgttcggatgcattcaatacttctcaggtgtttgatagtcaagagtatgttttgcggtgggctcgatctgttgcttatgaaaatggatttgtggcgatgattgtaaggtctgacacaaatacaggtagtagaggaaggacttcgtttgtgttaattggatgtgaaagaagtggcgagtataggtgtaggaagaaaggatttgttagaagagacactgagactaggaaatgtaggtgtcccttcaagcttcatggcaagcctgtggttggaggacaagggtga

SEQ ID NO: 52495 - DNA, 81 bp, Glycine max
  Peptide Sequence Number=SeqID_144180
atggataagagcttgaaggtaggagaagatgactggaggcaaagggagagaaggggacacaaaatttatgcctcaaatgag

SEQ ID NO: 52496 - DNA, 765 bp, Glycine max
  Peptide Sequence Number=SeqID_144181
atgggtcaacttcaacggcaagccttccgcaaagtctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaagtaccaaggaagtgcttggaggaaagggcaaaggccttggaaaatcaaggcaaatgggctttcttttattgacatcttggcgcttttgatctttggagttgtcctctttccgaatatggaagggttagtggacctagcagtgattgacgcttccctcgcctttcatcatggcaaggaaagcccggtcgtcgccattttggccatgtatgacacgttagaccggagatgtgaaaagagcgacgcaagaattgttgtgtacaccggctctctatgtgtgactggtttcgcaccttttttccaagaagtgaccacaacgcgagggtactccaaggagttcgcaaggcatgggatgcggcgtgaagaaaggacagagagcttaggggaagcaactgtgagggacgatgaggttaaagcttcggaagaaagtgatgaggtacaagccctaaaggcagagcttgaaagagcctgggtagtcgaagagaagttcaagtccatagccatcaaagtctga

SEQ ID NO: 52497 - DNA, 201 bp, Glycine max
  Peptide Sequence Number=SeqID_144182
atggaggaggtgctaataccttcctcaaacgtaaatacaactcctgaatctagaatattcttcatgaccggtttccttcgatttttccgacgttttccacaaataaacgttggtggcgactccgtgctttttcctcctttggaagacgcacccgtgagcctcgcctcgctcgctcgcaaaagggtaggttgcgacagttag

SEQ ID NO: 52498 - DNA, 942 bp, Glycine max
  Peptide Sequence Number=SeqID_144183
atgatttgtacttcaattcaggagcgtcctgagctgaagttggtgtcgcacggaaggaaggtggcgttaattgggaggccagtgcctgcgattgaagggttggttgtcgccacgggattaagtccattgatcgagtgttcagttgtaaccgacgatcctggacttatatccgcatttgtggagaggtggcacagggagaccaacaccttccaccttccagtaggagacttggcgatcacactagatgatgtttcgtcactcctccatctccctatcagtggcgccttccacagctttgaggctctttccgtggacgaggtggtatttttgttgatggagtttctcgaggtgtctggtgaagaggctagagctgagacagcttttcgcgacctgggtcaaagtgggggctatgcttggggagctgtggccctggttcatatgtatgaccagttagatgaagcttcttggaccacgacacgacagattggggggtaccttactttattacagtgctggatctatgagcattttctgagtgtgcatcagtgtgtcaccgatgatgcgtatgaggagacgtcccctcatgcctcccggtggctaacgacgaaggctcatatgaagggaattacaggagctccgtaccgggcacattgtgatgctttcacggtcacagacgtgtgctggtttccttacagtgaccatcgaggggttagggggtttgagttgatttcatcgttccagggtcagctgagatggggtcctacggtggtcgcagttcgaccgaagagggtactatgccagtttgggtacattcagagcatccctccgtcgcctgttagtgtttccttgtcatatgatgatatagatgacaggtggatgcatttcatgcatttttcggaccacgtagtagctgtgggtgacctttgtgtagtgcttgggcag

SEQ ID NO: 52499 - DNA, 327 bp, Glycine max
  Peptide Sequence Number=SeqID_144184
atgcactctatgaggttcttgctttgccagtatctcctggctaaggtgtgcgatatatatccacgcattgaattggctaacggccaaaccaaatacgccaaatacagtgattcaaaaagcattcaaatgcctaagctacgccgtattacaatgacgagagtgacgagcaaaatgacggcgacagcgacgaagtctatttccttgaagcctttgggaagagatggcaccgtgaggcaccatttggcggaggagattccgattgtggtgcctaggtacgccgtcaagcctatggcgagggtgacattggaaagcacggaccaaaggtga

SEQ ID NO: 52500 - DNA, 926 bp, Glycine max
  Peptide Sequence Number=SeqID_144185
atgttagaacaaccaaaggaactcagagttgataagttctatagcttgcagcagtcatccgaagctggaaatacagaaggtttaggccaaggcaagaggattatcttaccttcaacctttgttggcagcccacgttacatggatcaactttattttgatggcatagctatatgcagtcacgtaggcttcccaaatctttttattacttttacctgcaatccaaattggcttgaaattcataggctgctgacacctttgaatttgacaccaatagataggccagaaataatctcccgcattttcaagcttaaatatgagcagatgttattagaccttacaaagaatcacctgctaggcaaagtcgtcgcattggaattccaaaaacgagggcttcctcatgtccatttattgttatttttacacgccaacaacaaatatccatctccaaatgatattgataatattatatcagcagaaataccttcacagaaagatgatccagaactctataaattagtccaaaatcacatgattcatggtccatgcgaaattttgaggcctgcatctccatgcaggaaggaaggcaaatgcagtcgattttatccaaaaaagtttcagcccacaactcttatagatggagatggttatcctgtatatcgtagaagaaatactggtcagacaataaccaagaatggtattataattgataatagatgtattgtaccctacaatccaagattgttgaaaaaataccaagcacatataaatattgaatggtgcaaccaaagcacttctatcaaatatttattcaagtacatcaataaaggatatgatagagttacggctgtgatggtacatgatgacaatgaaacagtttcgcatgcaaacactccaaatgatgaaatcaaggaatatctggattgcag

SEQ ID NO: 52501 - DNA, 474 bp, Glycine max
  Peptide Sequence Number=SeqID_144186
atgacccaagagctggtagcccgcggagacaccttacggttatccgcacctcgtcattcagtgaccccaagtgtgattgatgagcagaggccaatgtggtcatctgcgccctttccggagatgtcagcatcttccgacacagtcgtgtccgatggcacgcagagacaaaatttggtcattctgcaccctttgtcatccagaggcggcgggcccgatgacatgcggagacaaaatttggtcattccgcacccctttgccattcagacacagtcgtgtccgatggcacgcagagacaaaatttggtcattctgcaccctttgtcatccagaggcggtgggcccgatgacatgcggagacaaaatttggtcattccgcacccctttgtcattcagacacagccgtgtccgatggcgcgcagagacaaaaattggtcattctgcaccctttgtcatccagaggcggcgggcccgatga

SEQ ID NO: 52502 - DNA, 297 bp, Glycine max
  Peptide Sequence Number=SeqID_144187
atggaatttggtgatattgttgttcattttaacattcttgatgccatgaaacatccatctgaggatcattctatttttcgtgttgagatacttgatcagattgttgatgattatatgtttgattttgattctcttcatggtgttgtacctcttgatgttgattttttagagtcaaaatgcactaaccatgttgcaggaagtacatatacttctgacttgttttatgaggtacaggctgaggaccttcttcttctcctaccctggttcctcccactattcagccaccacccacactag

SEQ ID NO: 52503 - DNA, 312 bp, Glycine max
  Peptide Sequence Number=SeqID_144188
atgactaggggtaatccaggtgatttacaaccctttgatcctgaaatagatagaacctttcttagattagttaggaatagtgtgcatcctgatcattctgtgcattttgagcattctgagtattttgttgctggtgattatgaatattctgattttgagcattcaactactaatttcatactgagaacatggttcaacctccacctcgtgagaagactcttagggagatggctgcacctgatttcacttatgaaagtttgtgcattcaatatactgatgaggatgttccatatgttctcaagactggactaa

SEQ ID NO: 52504 - DNA, 531 bp, Glycine max
  Peptide Sequence Number=SeqID_144189
atgaagattgtttcagttgcagttaggtcaatcagtgctaatttgccaaaccagtttcatcagagccacttgctcagaagtctttccacttggaaatttacagataatgcaactggtaatcggcagtttaacaattcagaatctcctgaggagtctgagcagtttggtggaaatcgtgggaaatatgcccaacttgattccatatttgaaaagtttaatcaacagggaatggcaagacaaagacctggttcagtaaatggtgctagttctgagaggatgcacgatctagaagaaacttatgacacattaactgatggaatggatggaaaactgatgaatgctgccacatactttgaatttgatgaggatgaaattgaaaaagaagattatgcatttcgatatgatgccaattttccacttggttcaaaatatgatgtaaagggcaacacctactacaccaagagctgcgctcagtattcagagaatagagaattctctgacctcaccaaaatggttcactcacaacaatga

SEQ ID NO: 52505 - DNA, 863 bp, Glycine max
  Peptide Sequence Number=SeqID_144190
ggtcagatccaacaaagcaatcaccggcaaccggttttccggtgagctatagcaattcaacaacgtattcgaccaacgaggcttcctacgctccagtcccacctccccagcccaaacctcttgtcaattggtccaccggcctctgtgactgcttctccgaatgtggaaactgttgcatgacgtgttggtgtccatgtgttacctttggccgagttgcagaaattgttgacaagggatccacatcatgtggtgctagtggggctctgtatacgctgatttgctgtgtcattggctgtggctgcctatactcttgcttctaccgccccaagatgagacgacagtatggtctaaagggaaatggttgttcggattgcttgattcattgcttctgcgagccctgcgccctctgtcaagaatatcgtgagcttcaacaccgtggatttgacatgattattgcaacgaagtcggggagtagccatgactgctacaacagctccatcagtcgaaaatggcatgagccgttgaatagtatgcagttctccagctcagatccaagaaagccatcggcaccggccaccggtttcccggtgagctacagcaccagcaccacggaggctgaggtgtattcgtattcatacggtccagttgtagtaccagtaccacctccccaccctaaacctattgtggaatggtcaaccggcctctgtgattgcttttccgattggggaaactcttgcatgacgttctggtgtccatgtgttacctttggtcgagttgcagaaattgttgacaggggatctccatgtggtggtgtggctggggctggggctgggtatactcttgcttctaccgctcctatatga

SEQ ID NO: 52506 - DNA, 180 bp, Glycine max
  Peptide Sequence Number=SeqID_144191
atgaataatgaagacagttttttaaatttgtcaatgttgggatgggaatgtgcaaatgcgtacacgtggcgtgacatcagctccggcagtggaaggtggcatgacccgttagatcgagcagtgtcgtggagtggatcttcttcgttcacgtatgtctatggactatggggtttgcagtga

SEQ ID NO: 52507 - DNA, 519 bp, Glycine max
  Peptide Sequence Number=SeqID_144192
atggcgtcgccgttggacggaggaggagtggcggtgctcccgaattccgtcaacaaggttgactcctcctcggttctcaatggcggcttgaagtgctccaaaccggagtcgccaattttgattttcttgttctttcacaaagcgattcggaatgagcttgacgcgctgcaccgattggccgtcgcattcgccaccggcaaccgctccgacattaagccgctctccggccgctaccatttcctcagctccatgtacaggcaccactgcaatgctgaagacgaggtgatttttccagctctagatatacgtgtgaagaatgtagcacagacatattctctcgagcacaagggtgaaagcaacctttttgatcatctatttgagcttttaaattcttccatcaataatgttgaaagttttccaaaagagttggcatcctgcacaggagctttgcagacgtcagttagtcaacacatggcgaaggaagaggagcagaaattcataaagacgaagagaatataa

SEQ ID NO: 52508 - DNA, 1668 bp, Glycine max
  Peptide Sequence Number=SeqID_144193
atgggtttgaaatcgctcttcaaccgcaacaaggacgcgatctcctccgacacggcgtcccgatcgacgtctttatccgtgcgttcacgcacgcgtatggcggatgagctggagcaggtgttcaacaagttcgacgtgaacggcgacggcaagatctcggcgtcggagctggggtcgatcatggggagcctggggcagccggcgacggagctggagctggacaacatgatccgcgaggttgacggcgacggcgatggctgcatcagcctcccggagttcatcgagctcaacacaaagggcgtcgactccgacgaggtcctggagaacctcaaggacgccttcgccgtcttcgacatcgacggcaacggctccatcaccgccgaggagctcaacaccgtcatgcgcagcctcggcgaggactgctccctcgccgagtgccgcaggatgatcagcggcgtcgatggcgacggcgacggcaccatcgacttcgaggagttcagggccataggaagaggaagggggatatttcgggaagacggtaatgtgttcgctgacccagttgcgtccgctaacatgcgccgcttccgcaccggacctcatcaagaactatgggcaatgaaactgggtttgaagcttctgcaagagagggcaaaagttggatctttctggtggccatatattaccaatctccccgaaacatacactgtgccgattttctttcctggggaggacataaagaacttgcactatgcttctcttcttcatcagagagaagtcaagcgtgctttggtaagtcttacaccagataagcatccttttggtggtcaagaagtagatgcatcttctcttggatgggcaatgtcagcagtatcatctagagcatttcgattgtatggtgaaaaggatcccaatgggatacgcattgacgtaccgatgatgctccccctaattgatatgtgcaatcatagtttcaatccaaatgctagaattgttcaagaacaagataccagtgactcgaagatgaaagttgtggccgagacagcaattaaagaagatgatcccctgttactctgctatggctgtttaaacaatgatcttttccttcttgattatggatttgtgatgcactcaaacccttatgattgtattgagctcaaatatgatggtgctcttttggatgctgcaagcacagcagctggagtttcttcgccaaatttctcaacacctgctccatggcaggaactgatcttatctcagctgaatctagctggagaaactccagatctcaaggtgagcttaggtggtcaagaaacagtagagggccgcttgttggctgcattgagggtaattctttcaactaatgtggaaactatgcagaagtatgacctcagcatactccagtctttagatgctgaggctcctcttggtgttgcaaatgagatagctgtatttcgcaccctaattgctttgtgtgtcattgcactgggacactttcccaccaaaataatggatgatgaatcactgttgaagcagggtgcttcaggttcaaccgagttagccattcagtacagaatccaaaagaaatctgtgattatagacgtaatgaaaaatctctcaaggaggctaaagcttgtatcatcaaaggaaacaacaaccgcagaaggctaa

SEQ ID NO: 52509 - DNA, 2004 bp, Glycine max
  Peptide Sequence Number=SeqID_144194
atggcggaggtttccggcgagggagtagcggaggcgacggtgtccacgccggcgccgccgttggcggtgtctggatctttcaaggaagggaagagctcttcgcggaggcgcgcgcattcgatgaggccgagcctcgacgcggacgagttcatgaacctgttgcacggttcggatccggtgaaggtggagcttaatcgcttggagaatgaagtgagagataaggacagagaattatcagaagcgcaggcagagatcaaagccttgaggctctccgaacgactcagagaaaaggccgttgaagagcttactgaagaattgtcaagggttgaggggaagctgaaattaacagaatctcttctagaaagcaaaaatcttgaaataaagaaaatcaatgatgaaaaaaaagcatcgatggcagctcagtttgcagctgaagccactcttcgaagggtccatgctgctcagaaggacgatgacatgcctcctatagaggccattcttgctcctctggaggctgaacttaagcttgcacggcaagagattgctaaacttcaagatgataacaaagctttagatcgtcttaccaaatctaaagaagcagcacttattgaagctgagaagactgtacagattgccttggctaaagcctccatggtggatgatctccaaaataaaaatcaagagctaattaaacagattgagatttgccaggtatttgcaatttcgtatggtgtttccctctccaagtatgccagccttaataatgtggcagaggttgaaaagcttacccaaaccgtgagagaactagaagaggctgtccttgcaggtggtgcagctgccaatgctgtgagagattatcaacggaaagttcaagaaatgaatgaagaaagaaaaactcttgaccgagagttagctcgtgccaaggtaacagcaaacagagtagctgtagtggttgcaaatgaatggaaagatgctaatgacaaagtgatgcctgtgaaacaatggcttgaagaacgacgatttttgcagggagagatgcaacaacttcgggacaagcttgctataactgagcgcactgcaaagtctgaagcacagttaaaagaaaaatatcaattaaggcttaaagtgctacaggatagtttgagagaaacttctaacagtattaatcgcggcacctcagagggaagatgtgttagcaatgggccttctcgacgtcaatccctagggggatctgataacatctcaaaactagcatctaatgggtttttgaagagatcaccgtccactcaaattaggtcttctgtgtcttcaagcacagttttgaagcatgccaaaggcacatctaaatcatttgatggtggcacaaggtcattagaaaggagtaaaattcttctaaatggaaagcctccaagttactcattcaatcagtcttctgaaggaaccaaagacggggaggaaaatgataaatggaaaggaaattccgatgataaaccaaatgacttacctacagttgatacagaggatagtgttccgggagttttgtatgatttgctgcagaaagaggtcttagccttgaggaaagctggtcatgagaaagatcaaagcctaaaagataaagatgatgccattgaaatgctggcaaagaaagtagatacattgaccaaagccatggaagttgaggcaaagaagatgagaagagaagtagcttccatggagaaggaggtagctgcgatgcgtgtggaaaaagaacaagagagcagagcaaagcgtttcagcaatgtaaagggcactgtgaacagtgctcagcatcagcttaaccttcctccggagaagttaccggaagaacttccggatgaacaatttgttctactggaagaaccttcttctggaagaagttctttcggtagtttctccggaagaaggttcttccggaagaacaaagttaaaattcttccggtagcttcttcggaagaacaaagctaccggaagaagttctttcggtag

SEQ ID NO: 52510 - DNA, 1935 bp, Glycine max
  Peptide Sequence Number=SeqID_144195
atggcgacgatgacaagcttgatcggtctcatcaataagatccaacgagcctgcaccgttttgggcgatcacggtggcgagggcttgtcgctttgggaggctcttccctccgtcgccgtcgtcggtggacagagctcagggaaatcgtcggtgctagaaagtgtggtcggaagagattttctgcctcgtggatctggtattgttacacggaggccactagtgctgcaacttcacaagacggaagatgggacacaggagtatgctgagtttcttcacataccaagaaggagattcaccgactttgctgctgtgaggaaggaaatatcggatgaaacagatcgtataactgggaagacaaagcaaatttctaatattccaattcacctcagcatttattctccaaatgttgtgaacttaaccctcatagatcttcctgggttaacaaaggttgcagtagagggacaacaggagagtattgttcaagatattgaaaatatggtccgttcttatgttgagaagattaccttcttgatgtttcttctgaatgatctaactgagttctctttgattgtgaagccaaactgcattatcttagctatctctcctgcaaatcaagatattgctacttctgatgccataaaaatcgcaagagaagttgacccttcaggtatggctgtttatattggaaggaattccaagggtgaaagaacatttggtgttgttaccaaacttgatcttatggataaaggaactaatgcagttgacgttctcgagggaaggcaatacaggctgcagcatccatgggttggaattgtgaaccgttcacaagctgatattaatagaaatgtagacatgattgctgctcgtaggaaggagcgtgaatattttgagacaagtcctgaatatggacatttggcacataaaatgggctcagaatatcttgctaagcttctatcccagcatttggagcaagttatcaggcagaagatacctagtatcattgccttaataaataagactattgacgagcttaatgcagagttggaccgtattggcaggccaattgctgtggactcaggggcccaactttacactattttagagatgtgtcgtgcatttgacaaagtgtttagagaacacctggacggaggacgtcctggtggggaccggatatatggagtttttgatcaccaattaccggctgctttaaaaaagctccctttcgatcgccatctttccttaaaaaatgtccagagagttgtcactgaagctgatgggtatcagccccatctgattgctccagagcagggttatagaagactcattgaagggtctattggctatttcaaaggcccagctgaagcctctgtggatgctgaactaaaaagatttccgacactttcaaatgatatagctactgctgcaaatgaagctctggaaaaattccgagaagaaagcaggaaaacagttttacggttggtcgatatggagtctagctatttaacagtggaatttttcaggaagattcattttgaaccagaaaagaatccaaacggaccaccaaatccaaatcggaatggtccccccaatatggatagttatactgacaatcacctgcgcaaaattgatctaccaggttatacattcattattctgttcgttgttacaggatcaaatgtaaattcctatatcggtatggtttgtgatacacttaagaatactataccaaaggccgtggttcattgtcaagttagagaggctaagagatcattgctaaaccacttttatgttcatgttgggaggaaggagaaggagaaattgggtgctatgttggacgaagacccggcccttatggaaaggagaaatcaaatagctaaaaggcttgaattatacaagcaagctagggatgatattgactccgtggcttggaaataa

SEQ ID NO: 52511 - DNA, 642 bp, Glycine max
  Peptide Sequence Number=SeqID_144196
atgggtggtgctcacaaggatgttggtgacaggttagccatacacgtgcaacatctattaaaccctccaataatgctgaacaacaaaatagaggacacaccaatatggtcagaagaaatcaatgatgaccgtttctttgaagcaatcaatgggaagaaattttcccatgtatgtacagcaccagtgaaatacaaccctagatggagctctgacaaagatgtggcctttattgtcacaggagcccagcttgatgtgaagaaacatgactcaaggagtgtccttcatttgaggctgttgttctctaaggtgtctaattgtgcagttgtaaaatcaagttggacacagggctcctccgggttatcccagaggtctggcattttctcagtaataagcacatcaatttctggtaaagaccagaaccagaaaaaaccagttgtggttttggattcaagtgtgtttccaacaggacctccagtgcctgtgcaaacacaaaagctgttgaaatttgtagaaacgtcacagttgtgtaaaggtccacaagatagtcctggccattggttggtcactggggcaagcttggtcttggataagggtaagatatgtttatgggctaagttctcattgttacatgctggttcatga

SEQ ID NO: 52512 - DNA, 876 bp, Glycine max
  Peptide Sequence Number=SeqID_144197
atggcccaagtttcttccttcgagaaggttcagtatcaattccctgaaaagattagggtccttgtcgttgataataaccccacagatcttgacttcatcaagcaaatatgcaatctatgcaattatgaggttagcacatgcactgaatctacacaagcattgaatcttgtgctggaaagaaaagattgtattgatttgatactcatcgaggttcatatgccaaccatgaatggctatgaattcctttaccgtgccagcaaggaaattgatgttccagttattgtgatgtctcttgatcacagcaactatactgtgacgcgggctgttcaacttggggcttgtgatttttgggttaaacctttgcgttattatcaattcaagaatatgtggacacatgttttaaggaaaagcctgaaggaaaataacatacaaacaaaagattatgttggcagcttggaagatggtgagcgaagcagaaaacggggcaaggataattctgaatttggttcttcttctgttgttagagaccaaagcaatagcagttccaaggaagctgaagaatcaaagcatcgtgtttcctcaatgaagaagccccgtgtagtatggatagcggaactgcatagtaaattcgtcaatgctgtcaaaaaacttggccttcatcaggctgtgccaaagaggattgttgaagagatgaatgtccctggtttgactagagagaatgttgctagtcatttacagaaatatagagattatttgaagagaaaatctgaaatgaaagagacacagacacaggaacacaccgagatgcaattgcctaacatggttccagggactacagaatccagggtaggtgcatcatctataaaaacacaataa

SEQ ID NO: 52513 - DNA, 1551 bp, Glycine max
  Peptide Sequence Number=SeqID_144198
atgcctgtgagggatgttgtttcgtggaacactgttattgctgggaatgcacagaatgggatgtacgaagaggcattgaacatggttaaggaaatggggaaggaaaacttgagacctgattccttcactttgtccagcattcttcctatttttacggagcacgctaatgttaccaaaggaaaggaaattcatggctacgccattagacacgggtttgataaggatgttttcattggaagtagcttgattgacatgtatgccaaatgtactcaagtggagctttcggtttgtgcctttcacctcttgtcaaatcgagacgccatttcgtggaactccatcattgctggctgtgtgcagaatgggagattcgatcaagggctcggcttctttcgtcgaatgttgaaggaaaaagtgaagccaatgcaggtctcgttctcgagtgttataccagcttgtgctcacttgacggccttgaatttggggaagcagcttcatgcatacataattaggcttgggtttgatgataacaagtttatagccagctctctgttggacatgtatgccaaatgtgggaacattaagatggctaggtatattttcaacaaaatcgagatgtgtgaccgtgacatggtttcttggactgccatcattatgggatgtgcaatgcacgggcatgcccttgatgcagtttccttgtttgaggagatgttagttgatggagtgaagccctgctatgtggcatttatggctgttttaactgcctgtagtcatgctgggttggtagatgaaggttggaagtattttaacagtatgcaacgggattttggtgttgctcctggcctggagcactatgctgctgtggcggacctgcttggtagagctggaagattggaggaagcatatgactttatttctaacatgggagaggaaccaacaggaagtgtgtggtcaaccttgttggctgcttgtagggctcataagaatattgaattggctgaaaaggttgtgaacaagatacttttggttgaccctggaaacatgggtgcacatgttataatgtcaaacatctactcagccgcccaaagatggagagatgctgcaaaattgagagtccgcatgaggaaaacgggcttgaagaagactccagcatgcagctggattgaggttggaaacaaagtacatacttttctggctggagataaatcacatccatattatgacaaaataaacgaggcgttgaatattttgttggaacagatggagaaagaaggttatgtccttgacacaaatgaggtgctccatgatgttgatgaggaacataaacgcgacttattacgcacccacagtgagagacttgccatagcatttggcatcattagcactacatctggcacaaccatccgtgtaataaagaacattcgggtgtgtgtggactgccacactgcaattaaatttatggcaaagattgttggcagggaaatcattgtgagggataatagccgatttcaccattttaagaatgggtcttgttcctgtggagattactggtga

SEQ ID NO: 52514 - DNA, 192 bp, Glycine max
  Peptide Sequence Number=SeqID_144199
atgtcactgcatctccaggcgccgatgtcctcctccacttcgccttccactatactgggaactgtgcgtgaagttgctggcaaagggttcggaggagatgacgaaaggattttcaatttgttttttccaagttatttcttcgacttgttggtgacctctccggtggaccaattacaaactgctctacgctag

SEQ ID NO: 52515 - DNA, 854 bp, Glycine max
  Peptide Sequence Number=SeqID_144200
atgggtgggaggcagctagcgactttatttggggtttccacccttttctccttcttgggtcccacctcacattcactctcaaccaatctccaccgtccgatcacattccaatccaacggcacaaccgcgctccgcttcccgccgattggggggcagaatctttccccaaaggaaaggagtagagattggattggagttcttatgaacagcagctttggttattgtacttatcaccatgatcttcgatctaatgagatgaatgtgttctgcgtggactgtgcacttaggatgtgtaggcactgtaaggaagctcattccctacatagaaggtttcagatttacaaatattcctaccaggatgtcttccgccatgccgagctgcagaagtattttgattgctccaaaattcagacttacatatccaataatgaaaggattgtgcatctcaaacctcggccttcaatcaccaaatctaagtctgctgatctaagtcccgactctaaatacaaagagaccggcatagcaacaagaccaaagtcagggggcacgtgtgaagaatgtggaaaacacttacaagatgagcgtaatcgcttctgctccattacatgcaagatctcagtgcatccagtggagacccaataccaaggtcaaaatcaatgttcaccaaaccaccaaagtgctagaggcatcatcaatccaaaacctgaaggcattgactttacaatgaatgataaccataattcagaaccggagtcatctatctctgaagctgagccatatgggtgggttgaagttgtgaatttcagaaagcgtccaaggaaaagtatccctcagaggcctgtctttgttttcac

SEQ ID NO: 52516 - DNA, 1851 bp, Glycine max
  Peptide Sequence Number=SeqID_144201
atggtgtgcatgtcgtgcgagagcttgagtttcttggcggtgccgtttcagtgggtggtgttgtcgttttctgtcagcggtgaccttccagataaagttttcgccagagtttgtgatgaaggcgttgccgcggtggtcgacggtgacgtcattggcagcatcgatctcttcggaggagagggaggaaaggaagagacggtggtgggagcggaggtcgtaggcgacgagggtgttgaacggagggatccaaggaggaagcgctacggtgatgatggtgtgggtgatgttatggaatcgatggaattatgcatatttgatttgcggagaggccaacacgaaggccaagagctcgataagattctcttcttcttccccgccggtttgcccttttcaaagcaactctccgtcattggcctcagcgaaggactcatcactttcactagaatcttctcgccagaggctgcctgcgacgtcatcgaagcagaaagacattctcatgttttctacgaggccgaacccgatatctggatagtcatggttccttctcccgttgccgacaaaagcaatgattcagaacctatatggagagttgatgcattaagaaaagttctcaaggaaattcactcactttttgtcatgtttcatggatctattagagcaatgctggagaaagaacccggcggaggactaacaagacggcatttgtatacctttatcatggattatctgagggcatgtaaaaagcggtctccgtgggatacttgctgctgtggtaatggtgaagttgctgtatcaaatgattttcttgcggggaaaaagctccttttaccttcattccgtgattgcttaaaggaacgtggaactgttcagatgctgacaataggtcgcgaggctgcaattgaggttcagtcccttgtcagggtgcttgaatcttcttctggaaacactccctgctactctttggttttatttcaagacctgctagtgtccacaagtctatctcctgatgacaccataaatttattcacatatgctgtgctaaggttgactccccatgctctatcttctggaacaagttcctggtcctacttacggaaaggaagttctgcatccaatgttgccactgagtctaacatggcccatccaagctctttgtctgaaagtttttatggctcatctgatatatcctctggtgaagataaccactatcatgttgtgaggcccttacagagtgacaaatggtctaaaggaaaagatggttatcttgtcactgatttatggggtgcagaagttggtacgtgggtgtttgcctctccaacagtttggcttcaacatacaggagagaaaatgtatctttgtgtttatcagcatagaagccttactttgatgcttctgattcctgtatcatccattcctaacggggagcaaggtgtgtcggcagtgaggcagcaagttgttgaaaatgcatcacttaaaatattgaaagttgaagagaaactatcgaaaggatggggtggagataatgcttatcacgttagtgggtaccgctacttacttgtagatggtgatagaaatgtatccagggcttctccagcaacaaaagttacaactttaacaaaggagtccttacttgctatgaataagcttaggcaagaggtggagttagagaagagtagagcaaaactggatagccgtaattgtgaaaaagacttagaggagctttacatggttctagagaaagctaatgaaacccttctatatgcttcagatgctgttgagaagtttagcgacagcttaaactgttatccttcttgtcgcaagaatgatgcagagaattggggtggagggtga

SEQ ID NO: 52517 - DNA, 996 bp, Glycine max
  Peptide Sequence Number=SeqID_144202
atggcgacccccattcctccccctcctgccgccgccgccgccgccgccgccgacaccaaggtcgattacttgaaccttccatgtccgattcccttcgaagagctccatcgcgaagctatgatgtctttgaagccagatctttttgagggcatgcgttttgatttcaccaagatgctcaatcagaagttctccctcaatcacagcgtgttgatgggacctactgaggttccttctcagtccacggagacaattaagattccaactgctcactatgagtttggctcaaccttcattgatcaccctaggttgttgctctggggcagaattttgactgatgggaggctcaatgccagagtcaagtgtgatttgtccgaaaatctcacttttaaagccaatgctcagctcacaaatgagccgcatatgtctcatgcgatgatcaactttgattacaagggaaaagactataggacacaatttcaacttggtaatggagccttgctaggagcaagttatattcagtccctggctgctataggggcagccgtagtggagaagttgatttttgcggatgcttttgcagttggaatagcaggaattgcacttgatagcactgcctgcatgagtgctgcacctcttcccttttgctattttgtagccacagccccttctccatctgcggtattttgggctggtcagcatcggaagtctggtattggttatgctgctcgctacaacactgataagtcggttgctacagggcaagttgctagcactggaatggttcttctaagctatgttcagaaggtatctgagaaggtttctctagcatctgagtttatgtgcaactacttgtcaagagatgtcacagctagctttggttatgactacatccttagacagtgccgccttaggggaaagattgattccaatggctgtgtcgctgcttttttggaggagcggttaaatatgggtctgaattttattctttctgcagag

SEQ ID NO: 52518 - DNA, 1233 bp, Glycine max
  Peptide Sequence Number=SeqID_144203
atgcctgtcacaaacacaacaacacctacagtggcagaacacatcaaatggagaaggcccagaaaccaattcaaccaccaccatcatcaccatcaccaccccatttcagaaacagatccaaaccctcaaatcccttccataatccaatccactaggtgcaagtccaccatttcctccctgctcctctccactttctccaacaacacctccaataatgccactgcccacagcaagaaaaaaagcaacttttctgcatcaaccttcagagggttgggctgcactgctggctcgtcgcagcaggtgtcggtgccggcggtgattcgctcctccgccgattggcaagggaagaaaacaagaaaaaagaagcacaagagaagcaacagaagcagcaagaacaagactttccatggtggggttctggaaggttccaatccagggtgtgtggattttcaagatgtttggtgtggccctggaattgggttctcaacagatgctgctgcctctgttgattgtgttgtggccaggaagaatgtctcttctgcaagagggaaaattgatgtggataagatcactcacagggagcgatcatcgtatgtgggaaggcgcacagagaccttcacttttctggacagtactgatcctgacattttcacaccacgctctgcgtctgacacttatggaactgctacatactatcgtcatgttagagatccttcctctgatggctttgctgaggttgcctctaatatacatatacccttttctctatctttgtcgtcactaatgttaagtgcacgcgtaattcctatggatgtgtcttttggattcaagcacttattttccaagagtcatataatgatgcttcaagggagtctactaatgggtggacaactaaattcacatgatcatttcagagactggagactggatgttgataacatgtcctatgagcaattgctagagcttggtgagagaattggtcatgtgaacactggactcaaggaagatgagatgggacggaacataaggaagactaggattcaattttgggatgatacatcaaagcttcaagtagataaagagtgcagcatttgtcaggaggagtatgaagcgggtgatgagttggggaggctaaattgtgagcacagttatcactttcagtgtataaaacaatgggttgcacaaaaaaatttctgcccagtatgtaagcaacaagttgcggctcgacactga

SEQ ID NO: 52519 - DNA, 1332 bp, Glycine max
  Peptide Sequence Number=SeqID_144204
atgcagaggaggttccggcgagtttgcacttgtctaaaagagcgcagctgcatgagctatgcaaagattgcttcagcgagtggcttctctgacatcaaccttatcatcataaaagcaacagccccagatgacttgcctctgcatgaaaaatacatacaacacctcttgaaactcttctccatctctccatctacgtgccactcctttgccatcagcttcactcgccgatttgggaccacgcgttgctggcgtgttgcactcaagtgtctcattcttctgcaccgcttgcttcgttctgtccctggaaacagctctctctggactgaactcttatggacacgttccaatgccttgatttctctctacccttgccatttcaaggatgactcctcctcgtgtccggtttcctacaccaactttgtcatatcctacgcacgccttctggatgaagcccttaactgtgttgctctggattgcaccaatttggaagaccaagatttggagcaaaatgaagaagccatggatgaaacttttcgagagaaaatgaaggaaatgggtcaagtgcttgaaatgttaccgcaactgcagagccttatagatagggtgatggagtgttaccctgtgggagtggcagcgcgaagtttcattgtgcaggttgccatgaaactcataattcgtgacagcttcgtttgctacacaaagttcagaagagaaatagtgacggttttggacaatctacttgagatgccgtacaggaactgcatagctgctttcaatatatacaagaaagcagcagcgcaaacaaatgagctttatgagttctatgagtggtgcaaggcaaagggtctgtgtggtatgtacgagtaccctttggtggagccaattccatacatacaaatcaaggctttggaaagttttctgagtggcatgtggcagttaacggagtcttcaacgtcgccaactaccagtaccagcccttcatcttctggggattctccttcaaatttctctcaaggacaaatagtgatgagaagagacgttgttaacatcaagggtgaagaggagaagcctttgattgaactagaattggaagaagataatggggatgttagttgggaaacactgttggaaacctccattagttttagtcatgcttatcagagggacttgggcagcttgttcaatcatcggggatgggaaggtggatttcatatcgaacaacatggctttgatgcgaacgaagggcacgatcacgagcgtgcagatgccacatggaacatggcagtcaacaaaaatactactgctaataacccattctccgagccttattaa

SEQ ID NO: 52520 - DNA, 1997 bp, Glycine max
  Peptide Sequence Number=SeqID_144205
ctctctggcccttcaatacaggttgaaaagatcaaagaggaggtaaaaacggaaaatgaaaaggaaattgttaggttgatgaaagaacaagaggacaaaaatttggaaatttcagcattaaagcaagaactagaaaaaaccaaaagaacatatgaagtacaacgttcacagttggaaacagaagctaaggatgctaaagcagaattaactcaaaagtctcaagaatatgagcaccgattggaagaattaagaaataaggctgagaagatcagagaggaagaaaaggaggcagatgagaaagaaatcatcaggttgatgaaagagcaggaggacaaaaatttggaaatttcatcattggaacaaaagtctcaagaatatgagcatcgattggacgaattaagaaataagattaaggagcttgaggtttcttctgattcaaaagatcagaagtggaacatgaaaatgaaccaaatgcagactgttataaactttcaattgagttccctacagaaattggaattatcttgggaatgcattaagcaaaatgttatgaaagagcaaacggtttatgcagaggattgtgatcggttaggtgtttatcttaaaccgctgttacatgcagctgagaactaccatactcttcttgctgaaaataaaaaaatgtttaatgagattcaagaattaaaaggcaaaaaggaaaaacaatctattgttaaactcattggtgaaaatgatttggttgtggcaaatccatccaaagaaggaaaagatgctcttcgatcatttaaatttaacaaggttttcggctctgccacaacccaagcggaggtatactctgacattcaatcctttataagatcagttctagatgggtataatgtgtgtatatttgcttatggccaaactggttcagggaaaacttatacaatgactggtccaaatggggcaacaagcgagactattggtgttaattatcgagctctaaatgacctcttcaagattgccacaagtagagaaagcctcatagactacgagattggagttcaaatggttgagatatataatgagcaaggcttagcagtaccagatgctagcttgtttcctgtgaaatcgccttcagatgtaattaagctaatggacattggacttaaaaatagagccattggtgcaactgctatgaatgaaagaagtagccgttctcacagtgttgtctcaattcatattcgtgggaaggacttgaagactggttctactatggttggtaatcttcatttggtagatttggcaggaagtgaaagggtagatcggtctgaagtaactggggataggcttaaggaagcacaacatataaacagatcactatctgcccttggagatgttatttttgccctttctcaaaaaagcccccatgtaccatacagaaacagcaaacttactcaacttctacaaacttctcttggtgaccaagcgaagacactcatgtttgttcaaattaattcagacgtaagttcatattctgaaacactgagcactttaaagtttgctgaaagggtttctggagttgaattaggagctgcacgaagtagcaaagagagcaaagatgtgagagaattaatggaacaggtgtcttctttgaagaacgctatttttgcaaaagaggaggagattgagaggcttcaattactcaaaggttcagttggtagcattgttaagcgaaaccaaatttcacgaagtagaagtattaagcactatgaagcttttaaccagcaaccgatggatgaccatatacaccaaaatgaatttctccatcaatctgaacttcatgggggaaatataggaaagaatattgctgcaattgcagaaacttcaagatttacagattctgattttgatgaaaaatcaagtgatctttctgacagtgctgttgctccaggcacagaaactgacggttcagaaaattctagtctcaccgaacgcacaacatcatcagataagag

SEQ ID NO: 52521 - DNA, 87 bp, Glycine max
  Peptide Sequence Number=SeqID_144206
atgacaccaattgaaattgagaggcagttgagcaaggctgatggaggtggtaacacttaccgagactttgatactcaaatggggtag

SEQ ID NO: 52522 - DNA, 198 bp, Glycine max
  Peptide Sequence Number=SeqID_144207
atgcataaaacgccattaacgaagacgcgaagcttaccccgacccttgacggtggaagcccaaagcgtagctgcaagtcctcagtgcctcaaatcaccaaatgcgacacggacggaggaagaagaagttcaatcggcggcaagaggtagaaggcactgcggaaggaagaagaagcgtacagaaagagacctgttataa

SEQ ID NO: 52523 - DNA, 2601 bp, Glycine max
  Peptide Sequence Number=SeqID_144208
atggccgaagcttccgtaacggttggaggcaaggcttcttctctctcttcctcctccgtcttcgccgtcgccacgggcctcgctcacgtgcggatcgactcatccgcgctcgatagactctccaagaccaccgccacggaaacgacgtcgtctcagcaccgcatctgcgtccccgatttcctaaccctagaggaatcccgcgccttccttctggtcctcctcaacaacctcgtcctctccaatgccccctcccgcattcccctcctcctatcccaaaccctcaattccaatcctcccaccttccaattcctagatgctgacgtcacccaaccagaccttctcacctcttccacgctgctcgctgtttccgccattctcgaccgccagtccgccgcgctctccgccttcgccgacgtcgccgccgccttctcctgtgaggccttgaaggccgatataacgcccttcaatttgatggattccggcgacggacacgcctccaaggccgaggtcgccgtcgccgccgacatgcgggttctgctcaacggatccaaatccgtcggcaaggagaatattcgatccgtcgcgagggttcccaaggttcacgggagtgtgagggagcaggccaaagccgtgcactcgagaatgcgtgttgagttgaattcgggggttaagggtgttgttgttgggagtgaggaagctgtatgcactgtgctgttgccgttggctgcagcactgaaagaacttggtgagtgtagtttcgcacgtgccaagagtaattcggaggttattggtggtgatggtttgagattgggcattggggaggtgtttgggaaggaatgccccactcaggatggtttgagcagtggtttaaataaggctgtgaacttgtttctgggaaaggagtatgctgtgacggcggttgcggtgcttgaggctgctgagttgaatgatgtgatcctaggtgtcaaggaaatgaaagtagaggggaacacgaaagtagaggagaagaagaagaagaagaaagttgttttggggaaagggactagctcgattttggcattgatcaaggagaggttactgagtggtcgagagatagctttagggacttgggtggcagattttctatcacttttggatttggctaaacctgagtttaatgaatttttattgaaagtaaaggatgttgtagagagcaatgaaagcaggagattacccaagattcctaagtcttaccttgagtttcacaatataacgtaccaggggactcgtgattttgctaaagaacaaatgacaattagaaagaaagcttttctaataatagaagaagtttttgagaggcatggcgcaactgccttagatactcctgtttttgaattgcgagaaactctcatgggaaaatatggagaagattcgaagttgatttatgatcttgctgaccagggtggggagcttctttctttgaggtatgacttgacagttccatttgctaggtttgtggctatgaatggtctgacatctttcaaaaggtaccaaatagccaaggtttacagaagggataacccatctaagggaagataccgtgaattttatcaatgcgactttgatattggtggtactcctactccatctgaaattatgggtccggactttgaggttgttaggattttgactgaactacttgatgagctggacattggggaatatgagataaagttgaatcatagaaagttactggatagcatgatgcaaatatgtggtgtacctcctgaaaagtttagaacaatatgttcaagcattgacaagttagacaaacagtcttttcaacagataagaaaagaaatggtggaagaaaaaggattaactgctgagacagctgacagaattgaaacttttgttaaagaaaaaggatctcctttagcattattatctaaatttaaacaagagggtagtgatttctcaaaacacaaaggagcttctgaagcattgaaagagctggaaattttatttatagctctggaaaaatcaaaacgcattgataaagtggtttttgacttgagtcttgccagaggtctggattattacactggagttatatttgaagctgtttttaaaggaggcactcagcttttatttaggaatggtcatatggtttttacgcaggttggttcaattgctgccggtggccgatatgataaccttatagggatgtttggctcaaggtcagtgcctgcagttggtgtaagtctgggaattgagagagtatttgccataatggagcaacaacagaagaatctgaaccagatggctcgtccgaccaagacagaagtcttagtgagcatagtggggaatgactttacacttgctgcagagctagcaggagaactgtgggatgctagggtgaaagcagaattcttggtcaataaaagaagagcgaaacacttcgaatatgcaaaagaatcaaggatcccttggatggtacttgtttatgagcaggaaataaaagaaggcgtggtgcaattgaaaaatctcgaggccaacatcgatattaagatttctagagcagaatttgtggaggaacttcggagacggttatacccttaa

SEQ ID NO: 52524 - DNA, 228 bp, Glycine max
  Peptide Sequence Number=SeqID_144209
atgtatgcaactaagaaagcgatgcagactttcacgcttcatcgtgactttaatggcgaaaaaagaatgcaaggcatgagtaactacatggtgggacgacaatgcatcaccaaaaagaggaaaactctagatgagacttcactgttatcaagcgagtcagagaccaaccatgaccacagattgacctccactccctatgcctcacacagacctgggtatagggcctaa

SEQ ID NO: 52525 - DNA, 303 bp, Glycine max
  Peptide Sequence Number=SeqID_144210
atggtaggttacatgccttcaagttttgcagatctagtgtttgctggtgagagaattgaagcatgtttaaggaaagggaaattcaattatgtttcttttgcgaatcctggtaataggggactcgggaggagtggtgagaggaagaaggagggagaacctcatgttgtggctgcagttcctgcgtggccaaactttccaatagcccctgtcacaacctacccttcggcgggagggcgacgcggggctcataggaggaaggtattagcaccccacgcgtccatcacaagggatgacagcctttaa

SEQ ID NO: 52526 - DNA, 102 bp, Glycine max
  Peptide Sequence Number=SeqID_144211
atgagtgagataggaaggtttggaggtttgggaatggaggtacggcgcaaggaggaaggggctgcgcaggagattctgaaaacgccatctgttctagtgtaa

SEQ ID NO: 52527 - DNA, 240 bp, Glycine max
  Peptide Sequence Number=SeqID_144212
atgttgaagaaaatcctccccgcctggttgccctatgaggggtcgacaaccattcacaacatccatttaggcaatgatcaagtcaaggttggtgttgaggaagttagagatgcaaatgctcacattcttgtacccactcaagaggcatatgactgcgatacgtctgcgagcggggaatgccgatgtgtatggattcctcgagccacgatccatacagagatctgtgcaatcacaatttga

SEQ ID NO: 52528 - DNA, 342 bp, Glycine max
  Peptide Sequence Number=SeqID_144213
ggaaacatcccttagcactgccatacctcttgagcttgaggttattcctcaagtaaaggagttgttggatgaggttttggttcgtaaaagcttaactccttgtgctttgttggtgcctaaaataggtattatgaggcaccgaatccctatggtagatgctacgatgaatgtgttgagtggggttcccacgaaccctaagagaataaaggtcattcttgagtggcccactccaccaacaccactcattgagttggtgaggaaccatgttccctcatgggaagatgcccgggaaatgggtgttgagggaagaagcccagagtttcaagaatctctggatttgag

SEQ ID NO: 52529 - DNA, 139 bp, Glycine max
  Peptide Sequence Number=SeqID_144214
tgtgttccttcctcgtcctaccgtatttgggggaggatggcgcacgggagctaggagagttgggtctgctttggcagccgaactgacagctgcagaggtggtgtcgcaacctacccttcggcgggagggcgacgcatga

SEQ ID NO: 52530 - DNA, 150 bp, Glycine max
  Peptide Sequence Number=SeqID_144215
atgtcatctatcggcacgggtgaatcttgccccagtatgcatagtagcagtgtgatagcctccctctctagttgtgctcgcacagttggccctcctccaatatcagggggtggcccaggaaccgttaaaaggaaactactggtcccttaa

SEQ ID NO: 52531 - DNA, 831 bp, Glycine max
  Peptide Sequence Number=SeqID_144216
atggcttccaactctcaacaattcaatgcaagaaatgatgttattgtccttagaggagtgcatgaggtgaccacagattcatcttcatctactgaaaataaaaagcttgaaggaaaacttgatgccttggtcaacctagtaactcagcttgccatgaatcagaaatctgcatttgcccctgttgcaagagtctatggttggaggaatcttccaaatctgagatggacaagtcctccacaacaacaacagcatgtccttcctttccagaatattgctggtccaagcaagccatatgttcctcctccaattcagcaacaacaacaacagtcacaacaaagacaacaagcagctgaggcacctcctcaacctaccttggaagagttagtgaggcaaatgaccatccagaatatgcaatttcagcaagagacaagagcctccattcagagtctgaaaaatcagatgaggcagatggctactcagttgaaccaagctcagtcccaaaattctaacaaattgccttcacagactgtgcagaatccgaaaaatgtgagtgtcatcaccttgaagtctggcaaccaaattcaagtgcctccaacaatagcagaacctgcacctgaacctatcaagcttcattctacacctgaaatagaggataagatagttgcacaaaagagaaagcttcctgtcgcaacctacccttcggcgcgagggcgacgtgtgacttgtgggtgcgtcttccaggaaaggaatatgtgcggagtcgccaccaacgtttatttgaggaaaacgtcagaaaaactagaaaagacgtggtctacgaactttaagtga

SEQ ID NO: 52532 - DNA, 331 bp, Glycine max
  Peptide Sequence Number=SeqID_144217
aagatctactgcaggtgatttgatccccatcaatttggagattaatactacttgcaggaggggcaacatagagagaattaggaaatttttgcaggacttagaagtagcagcaactccaaaagaagaacctcgatctttcgaggcgtcttctagctttcctattccagggcaatctcatacagatttaattgaagaagttattatggctgaagagccaaggagagtgaccctggaagattactcaagttccattgtgccgcaattcttttccagtatagcgcggccagaggttcaggcacaaacaatcacatatcctccttgtctgatatag

SEQ ID NO: 52533 - DNA, 272 bp, Glycine max
  Peptide Sequence Number=SeqID_144218
atggagaggagcatgattgatgctgctagtggtggagcccttggtgatatgactcatgctgaggctaggaatttgattgagaaaatggcttccaactcccaacaattcagtgcaagaaatgatgctattgtccttagagtagtccatgagcaatctggagtcaatgagcaacctgaagcttctgctgcaaacatttataatagaccccctcagcagagaaaccaacaacaacagaataattatgacctctcacgcaacagatacaactccag

SEQ ID NO: 52534 - DNA, 555 bp, Glycine max
  Peptide Sequence Number=SeqID_144219
atgggtgatcaagaggagacacaggaacagatgaaagccgacatgtcggctctgaaagaacaaatggcctccatgatggaggccatgttaagtatgaggcagctcatggagaagaacgcggccaccgacaccgctgccagttcggctgccgaagcagacccgactctcttggcaactgcgcaccatcctccctcaaacatagtaggacggggaagggacacactggggcacgatggcagccctcacctgggatacaaccgagcagcttacccttatggattgccacccaactactcaccacccgtcttgcaagacgatgcgggccatattgcttctcccgtccttgaaagagaaccccctcaacagcccgacgaggcccacaaagaccctcaagactatgctcgaagggatgtcgagttctatcccccgatccccgaagggccggcacccagcacgttgcctcagcccaacatcgcaacacaaccaatagttttgtccacggaaggaccatccccggcaactgaagaaaggaggaagctcgatctccttgagtaa

SEQ ID NO: 52535 - DNA, 213 bp, Glycine max
  Peptide Sequence Number=SeqID_144220
atgattatgaagggccaagacatttatagtagccaagacgaggttactacttcaccttcctctagtgaaagtgaagaagcaaaaggggaagaatctagtgaagaaattgactcccaagaagaaaaggaccttttaatggtcagaaggattctaggaggtcaatcttgtgacttgaaaaatagcaatgttaaaagattagaacaatgcatttaa

SEQ ID NO: 52536 - DNA, 207 bp, Glycine max
  Peptide Sequence Number=SeqID_144221
atgggtgatatcatgttttggttcctacctccaaaacctcttgacccacttccattacctatatccattaccacaaagtctgccgagaagataaaatgtttcactctgaccaacacatcttcaattactccatatgatatggcaatggagcggtcagcaagttgtaaagtgttcgcttctggcaagtgcactagatcgcgcaagtag

SEQ ID NO: 52537 - DNA, 229 bp, Glycine max
  Peptide Sequence Number=SeqID_144222
gatcctgagcaactaggtgtgtcctactatgacttgagaaacaaaggtgatcaaataacaagcagagatttaaaaggggctctggaggtggcggcagtgcatttgttgcctgttgctggccatgcccaggctgttgtggtatctcgccctctgcctgcatggggggtgtcataccctaatttcgtccggggacctttgcttgatgacatgcgacctttctttggtcctt

SEQ ID NO: 52538 - DNA, 334 bp, Glycine max
  Peptide Sequence Number=SeqID_144223
atgtgggccgtcatcgatgagtgcaaagagaagctaaatctagcggcgactcacgagcaaaggctagaggatgagtacgccaagatatcagcagaaagcgaagcaagggagagggagtcaagaacttccccgattgctagccaaggccaaagcaatggcggacacctactccgcccccaagaagatccacggacttctcagctattgtcaacatatgatagacttaatggaccatatgattacgaaaccgctaggaatgcgaatcaagtcactcctcatttatccctagcatgcattgtatgtggtctcgtcctttgtcacgggaatccggaag

SEQ ID NO: 52539 - DNA, 96 bp, Glycine max
  Peptide Sequence Number=SeqID_144224
atggcacgcaacccgaggcaggattttagcgtttctaaggagagcattttcggggtcgtgaagtgcgtggctacgagtgggacttcgaaaatccag

SEQ ID NO: 52540 - DNA, 240 bp, Glycine max
  misc_feature (13)..(13): n is a, c, g, or t
  Peptide Sequence Number=SeqID_144225
atggatcaagttngacgtcaagccttcaacaaggcatatgggaagatctgggatctggcaatgatagaagtgttcgttgaagccattgcatcccgcactcaatactacgacagatgcttcacttttggggactttcagttggcaccaaccatagaagagtttgaagggatcttagggtgcccattaggaggaaggaagccatacctcttgctggattctatccttctatgccaagaatag

SEQ ID NO: 52541 - DNA, 87 bp, Glycine max
  Peptide Sequence Number=SeqID_144226
atgactacaggtgatccaccccaacagaagacaagtcaaggaaatgagaaaaagaaagaagatgagaatattacccaagatagctga

SEQ ID NO: 52542 - DNA, 141 bp, Glycine max
  Peptide Sequence Number=SeqID_144227
atggtagctataacccctgctaggattttcaagtgcaagccattggtcagtttgctcaagcaacctgcgctcctgagtgttgacttccaagaccgttcaatcagagattactcatcttgcacgttggtgggggtgccgtaa

SEQ ID NO: 52543 - DNA, 72 bp, Glycine max
  Peptide Sequence Number=SeqID_144228
atgtctgatttgacgtcgaaatgggcacttgcagctaacaaggaaagtgtcgatgaccactgtatgccaaag

SEQ ID NO: 52544 - DNA, 642 bp, Glycine max
  Peptide Sequence Number=SeqID_144229
atgtcgcttgagatcaggagaccttggggacgtcaggtggggcgagctcctggcagtcaacagataaaaggaacaaagaccacaaagcaaggaggcttgtggtggctggccagctgtgaattttgtgtgatatatgggttgtggcctctggtaatcgattaccaagggcttgaaaacgaggtcaggaagctaggagagcttctggtaatcgattaccaagggggtaggaatgggtcactggtaatcgattaccagagggagcttgggagaccctcgaaggcaacacgaggtgccgatttcggggcacgattcgattcacggctacttcatttggtgcatccagatgaacccgtgcgcacgcttcagcgtactatggagtggatactacccacgcctacaccataccgtctagtggagccagtccaagtgatcgaggtgacgtcatccgaggaagaccctgaggaggatcccgaggagctacctcctgagcctgctgtggatgctcttgactttctagagggtgatgaggacccggtccctgaggtggattctcccgaggacgtcatgtcagcatctgaggcagactctacggaggatagtggtcctggagagatggcaatcagtggaggctcttcatcatag

SEQ ID NO: 52545 - DNA, 432 bp, Glycine max
  Peptide Sequence Number=SeqID_144230
atggcaacgcagttaatccatgatcgtgtcgtgatggagtgcctagagggtgtttgggagaccctcgaaggtaatgagaggtgccgattccgtggcacaattcgacttactgctacttcgctagtacatccggagcaacccgcacgcacacttcagcagcctgtggagtggatactacctacacctactccatatcgaccagttgagccggttccagtgatagaggtgtcatcctctgaagaggatcttgacgagaacctagaggagttacctcctgaacctgctatggatgcccctgacttaccagaggatgatgaggacccgctctctgatgttgattctccagaggattttatgtcagcatttgaggcagactctacagaggagagtggccctagagggacagtgaatagtgacgactcttcatcatag

SEQ ID NO: 52546 - DNA, 255 bp, Glycine max
  Peptide Sequence Number=SeqID_144231
atgattggtactttgcacctaagtaacgtgggaaatgcttttcaatggagatggccccgaggaaacttgtctcaaagagatccaggaaggataaagcggccgaacgaaccagttctgctcccgagtatgatagtcaccgctttaggagcgctgaacaccagtagggcttcgaggccatcaagggatggtcatttctccgggagcgacgcgtccagctcagggacgacgagtataccgatttccaggaggagatag

SEQ ID NO: 52547 - DNA, 665 bp, Glycine max
  Peptide Sequence Number=SeqID_144232
acttggctttggtgaaagagttctatgcaaacttatacagctcgaagggcccttcaccaaagcagtccaaagtcagaggccatttagtgaagattgatgctgatagtctcaacacattcctggagacacctgtggtattagcagaggggttcatcttgaacactgagggccatcctgggaagattctcaggaaggatttgactactctagctcaggtgtggagtgttctctcatactccaacctggcccccacatcacatacctctgatctgacagtggatagagctaggctgatctttggcctagtctctcacatggacatgaacataggagctcttatttctggccagatgacctctatagcccagtctaacacttctaaacttgggtttcctgctctaatcactgcattatgtagagccagagaggttgtctctgacagccttacctttgagcgcctgagcccggtcattaacttggcctacatcaggaagaactgttggaatcccgaggatctaatagtttctatccaaggggctaggagggcgagggcgaggctagctgagcttccttccacttctgtagctcctactccaacatccacttcaacaaccccttttgtcccagctcagacatattctcagcgctttgaagcaatgctttag

SEQ ID NO: 52548 - DNA, 182 bp, Glycine max
  Peptide Sequence Number=SeqID_144233
atgagcctcagcatgcagagccagggcttcgcttctttttcatgccctactccagactagttcagggcagaggtcgcatggcccggggatttgcccgaggcccaagcaggagaggcgcccccggaagttccaggcgatggagaggaggcccacaaggacgaggagatggccgatttgcttga

SEQ ID NO: 52549 - DNA, 250 bp, Glycine max
  Peptide Sequence Number=SeqID_144234
atggcttccaaccttgcaacaggtgtgtcataccctaatttcgtccggggaccattgtttggtggcatgcaaccttcgcttgaccgcctcgagggggtgcaaatagcaaccaagcccacttgggccttccaaggggttccaacagaaggcggggaaaaagggcagagtaaaaatgttcagcccttctgcgatttcgtgaagatcttcaccgttcatcatcgttcttcgttcgttcttcggttttcaaccg

SEQ ID NO: 52550 - DNA, 348 bp, Glycine max
  Peptide Sequence Number=SeqID_144235
atggttgaagtctgtgctggagtcgaaatgggaggtgttggaactgtggaagaagaaggagttgttgtctctggtgctactgaagtagtggggacctctgatctcttacccctggccttccttggccctctaaatgtcactgttggatcatctagattccaacagttcttcttaatgtatgccaagttaatggcagggctcagactctctagggatctagaatctgattggactcctctagccttgcacagagctgtgatcaagattaactcagctttgtctaatgtgacatcagatgtgtgggaggtaggaattaagttagagaaggaaagaacgctccatgtctaa

SEQ ID NO: 52551 - DNA, 558 bp, Glycine max
  Peptide Sequence Number=SeqID_144236
atgaccggaaggcttcttgccggttcattggcttttgaaagccgcatccttcattatctaattgttcgcatcttgcttccaagatcttcaaaccttgcacaggtttctgaagaagatcttattgttatgtgggcttttcataaaggcctacaaattgattgggcacatcttgttagatatcgcatgcataaggcattgcgattgaatgctccattgccatatccacacatagtcaccctcttccttcaacactttaacatccctcttgattctgaaccctatgttccaatcaagagatccttcctaataggtgcttcagtcattgctcgacatgttggtgaagaaggacatgatggagaagattcatctcttctttcaaagattttggataggtttgatggtcttcaaacctttgttggtgaaaggtttgacactttggaattacaagtggagatgcgcttcaatgagatagagtcaagaatcaccaaggttgaagaagatgtttcttatattcattcaagctttgatctaccaccgccaccgccaccatcatcttag

SEQ ID NO: 52552 - DNA, 1138 bp, Glycine max
  misc_feature (1106)..(1106): n is a, c, g, or t
  Peptide Sequence Number=SeqID_144237
atgattgcggatgccagcaatcgcccaattgccaacctgggagcttcattcaacatccaggaaacgctaccgccgcaacaggacaccgttgtcatgcagcaaaatacgcacgacatcaccatggtgaaagtgttttctaccgaacccaagcataacttgctgggctatgtgtttgttgccatcgataaagcgtccctgatcgaagatcaccgccaagccttcattaaaaatgtaggctacattacattagcattaatgctgtgctccattcttgtcagctgggtcagccgctcaattagccagcctattcgtgacatgaccgccgccctcaagcgctttatgataggtagccagcaaatcagtcatggcaaaaacactttgccagaaattaaatccctgcaaagcaccattaaccaaatttcgcgggaaatgcagcatgtagaagccgacatgcgccaccgcatccaggatgcacaagcacaattgcgttaccaggcacgccatgacgccctcaccggcctcgtcaaccgccaggaactggaaagaagactgcagcaagccctgcaggatgtcaaactgcatagagccaaccatgttttctgctacatggaccttgaccagttccgagtcattaatgacacttgcggccatctggcaggcgacgagatgctgcgccagatcagcatgatcctgagccaacgtatccgcgctgaagatacctttgcgcggctaggtggcgatgagtttggcctgttattgagttactgtcaggttgaaaaagccattgaaattgccgcgcaactccgtcaaatggttgaaaccttccgctttatgcacgaaggcagactgttccagactggcatcagtattgggatcgttgagattacgtccgacttgaaggatgtcggccaaattacacgccatgcagatgccgcctgttatgtggcaaaagataatggccgcaaccagattcacctctttcatccagaagacgatgtcctgctcaaacgccatgtagaaatggaatgggtgctgcgcattaatgaggccatagagcacaacgaattcgtcctgtattgccaagggattttccccttgcagaacanagagctcccacccttttatgagatccttatcc

SEQ ID NO: 52553 - DNA, 1223 bp, Glycine max
  Peptide Sequence Number=SeqID_144238
atgtcgagagagaattggatttggttagacaatgtgtggttggtaaacaaggatcggttttttagcaaggtacggaatgtatcatcaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtgccgactattcatggaacgtgagaagcagatgaataatcatctgcttccgcaagaaatcgaagaatttcttgggaatcctgcaagagctactcgttcttttttctctgacagatggtcagaacttcatctgagttcgaatcctactgagaggtctactagagatcagaaattgttgaagaaagaacaaaagaaacatcttgttctttccaggcgatcggaaaataaagaaatagtgaatttattcaagataattatgtacttacaaaataccgtctcaattcatcctatttcatcatatccgggatgtgatatggttccaaagggtgaactggacagttccaataagatttcattcttgaacaaaaatccattttggggtttatttcatctattccatgaccggaacagtgggagatacacgttacaccacgattttgaatcagaagagatatttcaagaaatggcagatctattcactctatcaataaccgagccggatctggtgtatcataagggatttgctttttctattgattcctccggattgggtcaaaaacatttcttgaatgagttattcaactccagggatgaatcgaaaaatcactctttattggttctacctcctcttttttatgaagagaatgaatctttttatcgaaggatcataaaaaaatgggtccagacctcttgcgggaataatttggaagatccaaaacctaaaatagttgtatttactagcaacaacataatggaggcagtcaatcaatatagattgatccgaaatctgattcaaatccaatatagcacccatggttacataagaaatgtattgaatcgattcaattgcaacttcgaatatggaattcaaag

SEQ ID NO: 52554 - DNA, 117 bp, Glycine max
  Peptide Sequence Number=SeqID_144239
atggaaattttgatcgccaatacttcatcaacatttcatagggatgaaagactcgggaacacgcatgctatgcatgggaaagaggaaaatgcaagggtcacgcatgagcaaacatga

SEQ ID NO: 52555 - DNA, 183 bp, Glycine max
  Peptide Sequence Number=SeqID_144240
atgtgggtggaagccattggtctgtttgctcaagcaacctgtgctcctgagtttggacttccaagaccgttcaatcagagattactcgtcttgcacgttggtgggggattaacaatgcacatagggacaacccttcccttgtgttcaaaaatcccctacaacaagagacccacggtctcttaa

SEQ ID NO: 52556 - DNA, 336 bp, Glycine max
  Peptide Sequence Number=SeqID_144241
atggtccatgacatcttcatcaaggtgaaactagaagtaacaaggacattaacagtcctaaatgtgtttggcaatagacgaagcagcgataggaaagcacaaggatcatgtatgagcaaacatgtagaacaaaaagaacgatatgttcattatgatgccgaagagatgcatgatatgaatgcatttacgaacacgagagcccggacaatcatctctccttacttgcgcatttgggggcgcagtgccccatgtgtgcagttaaaaagacgatatggatcttccgacttcccacgacaaaagacgagatcaacatacaacgcgtgcgtgacgacatga

SEQ ID NO: 52557 - DNA, 534 bp, Glycine max
  Peptide Sequence Number=SeqID_144242
atgtttgtatttttagtaaagaaaacaccgagactttttcaagtctcacaagttatccagaactacgtagacacagccgtgtccgatggcacgcagagacaaaaattggtcattctgcaccctttgtcatccagaggcggcgggcccgatgacacgcggagacaaattggctcattctgcacccctttgccattcagacacagccgtgtccgatggcgcgcagagacaaaaattggtcattctgcaccctttgtcatccagaggcggcgggcccgacgacacgcggagaaaaatttggtcatttcgcacccctttgccattcagacacagtcgtgtccgatggtacgcagagacaaaatttggtcattctgcaccctttgtcctccagaggcggcgggcccgatgacatgcggagacaaaatttggtcattccgcacccctttgccattcagacacagccgtgttcgatggcgcgcagagacaaaaattggtcattctgcaccctttgtcatccagaggcggcgggcccgatga

SEQ ID NO: 52558 - DNA, 348 bp, Glycine max
  Peptide Sequence Number=SeqID_144243
tcggagtatcaaggaagtgtttggaggaaagggcaaaggccttggaaaatcaaggcgaatgggctttcttttattgacatcttggcgcttttgatctttggagttgtcctctttccgaatatggaagggttagtggacctagcagcgattgacgctttcctcgcctttcatcatggcaaggaaagctcggtcgtcgccattttggccatgagtcaagaacttccccgattgctagccaaggccaaagcagtggcggacacctactccgcccccgaggagatccacggacttctcagctattgtcagcatatgatagacttaatggaccatatgattggaaaccgctag

SEQ ID NO: 52559 - DNA, 898 bp, Glycine max
  Peptide Sequence Number=SeqID_144244
gtgcgtgataacaacggtaagttccgcgaagatagcgataccgacggtgtggtttactataaaggcccgctggtggtcttagtcgatcgcttcagcgcttcagcatcggaaatttttgctgccgcgatgcaggactatggccgtgcgctgattgtcggcgagcagaccttcggtaaaggcaccgttcagcagtatcgttcgctgaaccgtatctacgatcagatgctgcgcccggaatggccggcattaggttccgtgcagtacaccatccagaagttctaccgcattaacggcggcagcactcagcgtaaaggggttactccggacatcatgatgccaaccggtaaagaagatcgcgataccggcgagcagtatgaagataacgcgctgccgtgggatagcatcgatccggcgacctacgtgaagtccggggatatgaaaccgttcgaacctgaactgcttaagcgccatgaagaccgtatcgcaaaagatccggaattccagtacatcatgaaggatattgcgcgctttaacgccatgaaagataagcgcaatatcgtttctctgaactacgcgcagcgtgagaaagagaatgaagaagatgatgcgattcgtctggcgcgggtaaacgatcgccttaagcgagaaggcaagccgcttctcaaaaagatagacgatctgccgaaggattatcaggaaccggatccgtatcttgatgaaaccgtgcatatcgcgattgacctggcgcaacaggaaaaagcgcagcctccggtagaaccaccgcctgacggggatccagtcgagcagcatgaccggcctgctgatcatggcgctgctgtttggttttggcggctcgatcgtttcgctgttgatgtcgaaatggatggcgctgaagtcg

SEQ ID NO: 52560 - DNA, 549 bp, Glycine max
  Peptide Sequence Number=SeqID_144245
gcgaggacgtgcaaccctctgaaggcgagacaatgtagtcctctgaaggcgagggcgtgtagccctatgaaggtgaggacatgtagtcctctgaagatgaggacatgtactcctctgaagatgaggatgtttggtcctctgaagataaggatgttagatcctctgaaggtgagggcgtgcagccctctgatggcgaggacatgtagtcctcttaaggtgaggacctgtagtcctttgaaggtgagggcgtgtagccctcaaaaggtgagggtgtgcagccctctgaaggcgaggacgtgtagtcctctgaaggaaacgacgtgcagtcctctgaaggcgaggacgtgcagtcctgtgaaggtgagggcgtgtagtcctacgaaggcgaaggcgaggacgtgttgtcctctgaaggcgaggacgtttatgatgcaatcctaccccgcaagggcattggatagaagactccaagtagaatgggccaaagatgcaagagaagatcctagggttcttatgagccttagggtagatttcgggctcatgggctaa

SEQ ID NO: 52561 - DNA, 450 bp, Glycine max
  Peptide Sequence Number=SeqID_144246
atggccagaacacgaggtttaggtcgtgccataggtttttttagagttgtaggcagagatagacctgctgacgaggatgctggcgatgttcccgagaggcgtagccctacggcctcagcccgtaggctacgcgttcatcagatgactacggagggacgtaatatggctgaggacgtcgctgccatgactaatgatgtccctgagcagcctacggaggcacctgagatgcgtgcggacgcacagggtgctgatagtggtgaggggtcagatggtgatgatgctgcagagggattccctggtggtccacgagacccgtcagtgctcacatcatttgccgagcatgttgcacatgccgtgtggagtggacaggaacgtcctgatttgaagttagtgtcccatgggaggaaggtgacactgattgggaggccagtgcctgagattgaaggcctg

SEQ ID NO: 52562 - DNA, 210 bp, Glycine max
  Peptide Sequence Number=SeqID_144247
atgggtgaccaagatgagacacaggaacagatgaaagccgacatgtcggctttgaaagagcaaatggcttccatgatggaggccatgttaggaattagacaactcatggagaataacgtggccactgctgccgctgttagttcggctgccgaagcagacccaactctcccagctatcgcacaccatcctctcctaaacgcggtaggatga

SEQ ID NO: 52563 - DNA, 1114 bp, Glycine max
  Peptide Sequence Number=SeqID_144248
ggacaaggactacgctgaggaagaaaactggactaaggtggtaagcagaagatcaatgaaggttatgcagaaatcctctttagcgggaagacaatcacaaaatctggagataggggacaacaacaaacattatcgccttaactggaggaacaatgccgacattacctccttttatttcacccatttccccgacgaagctaatgaagagttgctatggaggcacttcaaaaactggggtgacgtacgtgaagtatacatcgctaaaaggctcaacaaggatgccaggagatacgggttcatgcggttcaagggagtctcggatgcaaaaggattggagaaaaagaaccccattaggaggaagtacaccgacgaagcaagagacaaaagggcagacgaggcacaaacaccaactattctgatcaacccagatgaaggtggggaatattggtgtaacgaaacctgggtgggcatgctaaagaaggtgatggaggtggaaaccttagaggatcgtatcacttgggagttaggatataacgtccgcactaagttcctcggagacgacatggttcttctccctgggatgtccgatgacaaagctcaactcctcattcaatcagagacggaaagcgatgattctctcttttactcactggagaagtggacgccgaaatgtagacccaataacagggttgtttggctccagctgtggggatttctgatacaggtgtgggaaatgaaaaatctcaggagggatgtagctgctattggggatgtcatcgagtcagacgatgacacagaggaccgccgacgattggaccgggctcgagtattggtgcggacaccgcttccgccgttgataaggtcggaggtcatcgtccgtgtgggggagcttgagtatcgggtatggattgtggaagagacagggttcgaaggtgggtcgaaccggaaaggaagctcgccgtccgatgggtggtcggagatgataacatcagacgacgaaggggaggttggcgatgttcttggcgacactaataccaatttctccttctcgccggagctgcccaaccagaaattgtctccgtctcgtacccaacgggcagaaggagggaccgat

SEQ ID NO: 52564 - DNA, 183 bp, Glycine max
  Peptide Sequence Number=SeqID_144249
atgaatactggttccttcagcttgaagtcatttgagggcccaagcaagctagaggctagcctgggtgagatagggtctaggaaaactggtcgacgactggcaagtgtatgtaaactaacctattcaaaagcaagtaaaggctacggagatttggatgacgccacttccagtgaaggaagataa

SEQ ID NO: 52565 - DNA, 213 bp, Glycine max
  Peptide Sequence Number=SeqID_144250
atggctcgcttagcgcacataagtggtttttggcttagcgccagtcttctcgctcagcctagaggatgtaggcgtcttctatgcgctcagccagcggatgtcgcgcttagcggattgcttgctcagcgcatgaaacggcttagcaagtcaatgaattctgcacttcaccaatcttgcccattttacctgaaattgaaatggaatgatcattaa

SEQ ID NO: 52566 - DNA, 1059 bp, Glycine max
  Peptide Sequence Number=SeqID_144251
atgtcacacaccaagtgtttgataatttgtcgcaatgcagtgctgaatctgaatcttcccccagaggtttcttgcaccttaggggacaatgattcaaccactgatgatgactcatctcactcctgtggctctaagtcatcaccgcagttagatgacaataaggctcccactccttgggttaatctattcaaagataatagaagtccttccaaaggttttggaatgaagttctcccctccaccctctgatgatgaagtgctgttggaagaaacagatttgcaacccctggaagaggcttggggacatagccttattggctatgtggctggtcgattccaaggaaagaaagctctgctggattgttgccaaaaatggggagtcaagttttcatactcagctcatgaaagtggttggctggtgtttaaatttgagtctaaggacgatctgaaccaagtcctctctcattctttgactttggcaatgaacagctcagcaagatccttgtctgggttaactcagaaatctacctctggagctttggaatcctcaagccttagggaaatcctgtccaagattggttcgcccattcgatctgaccatcttactgcttctaaggggtctatttcttttgctagagctttagttgaggttaatgcttctttggagctcatcgatgaagtgcgatttagacttcctacagggaagacttttgtgcaaaagattgagtatgaaaatagaccttctttttgcactcactacaagatgattgggcaccgcctcactaattgtaaagctgtcactgcaaataagcctgttctcatcacagcctgccccaccttggatcagccacaagtgggtgattcagcaatgcccccacataccaatacagcaggcccctctgataatccaaagaatgtccagactaatctgtctgtccctcatcacagaaaacatgttttggttgcaaatcatgtccctgtccttcagaattcttctgacctcaaagaaacagggaacactgagttggatgatcctatagaagaggggttgttcaggtga

SEQ ID NO: 52567 - DNA, 387 bp, Glycine max
  Peptide Sequence Number=SeqID_144252
atggaagggttagtggacctagcagtgattgacgctttcctcgcctttcatcatggcaaggaaagcccggtcgacgccattttggccatgtatgacacattcgaccggggaggtgaaaagagtggcgcaagaattgtttgttgtgcactggctctcccacgtgtggctggtttcacacctttttttccaagaaggatgtccaaatgttcccttgatggaacaaggggttgtattaattataatcccgtcctcgccataagacagcttggctaccccatgagaggagtgccatcagacgaaagcatcacgcctttcatcgcacggggtttcagtgaccacaacgcgagggtactccaaggagttcgcaaggcatgggatgcggtgtga

SEQ ID NO: 52568 - DNA, 717 bp, Glycine max
  misc_feature (689)..(689): n is a, c, g, or t
  Peptide Sequence Number=SeqID_144253
agccccatgaattcagtgcctagcgctgttcatgtgtcctccaccttcgagtctggagccccgcaaattgattgcctagcgctgttcgccaattctccattctccacttttattcggagccccatgaattcattgcctagcgctgttcatgtgtcctccaccttcgagtctggagccccgcgaattgattgcctagcgctgttcgccaattctccattctccacttttattcggagccccatgaattcattgcctagcgctgttcatgtgtcctccaccttcgagtctggagccccgcgaattgattgcctagcgttgttcgccaattctccattctccacttttattcggagccccatgaattcattgcctagcgctgttcatgcgtcctctaccatcgagtctggagccccccccatgaattcattgcctagcgctgttcatgtgtcctccaccttcgagtctggagccccgcgaattgattgcctagcgctgttcgccaattctccattctccacttttattcggagccccatgaattcattgcctagcgctgttcatgtgtcctccaccttcgagtgtggagccccgggaattgattgcctagcgctgttcgccaattctccattctccacttttattcggagccccttgaattcattgcctagcgctgttcatgtgtcctccancttcgagtctgtagccccgtggaattga

SEQ ID NO: 52569 - DNA, 333 bp, Glycine max
  Peptide Sequence Number=SeqID_144254
atgggtgaagtagaggagatacaagagaagatgaaggccgacgtggaggccattaaagagaaaatggccacaatgatggaggccatgatgagcgtgaagaagataatggaagccaatacggttgcaattgccgctaccagcaaagatttgggtagtatgggcggcctccatgatgtgcaaattcaaaacgagcatgccttcctgccatatggcttgcctctcaactatacgccacccaatgtggcgtacactcccaataagaatgtcaataactccactcctatacccattgagagccagcaaccccaaactgatcatgcacatgtctcttaa

SEQ ID NO: 52570 - DNA, 48 bp, Glycine max
  Peptide Sequence Number=SeqID_144255
atggctataatcatgcctatacatgcatgtctgatcatttttatgaaa

SEQ ID NO: 52571 - DNA, 213 bp, Glycine max
  Peptide Sequence Number=SeqID_144256
atgaattgcgttttcgttcatgcatcctccgcccacgagtttggagccatgcgtactgattgcttagtgcatttctccattctctaccttgttttggagccccatgaattgcgttttcgtttcatgcatcctccacccacgagttttggatcatgcgtagtgattgcttattgcaattctccattctctaccccttttttcggagccccatga

SEQ ID NO: 52572 - DNA, 55 bp, Glycine max
  Peptide Sequence Number=SeqID_144257
atggatagtgtgcttgcacaaacatctatcttagttctagcagtttccataaagg

SEQ ID NO: 52573 - DNA, 1077 bp, Glycine max
  Peptide Sequence Number=SeqID_144258
caccggaggaagatgaagaagtccgagctctaaaattagagctagggaaggcgagactcgccaaggagaagttcaaatcagctgctacacacatccggaaggagtgcaccgagttacaagaggaaaacgcggccactgcaagagcccttgaacaagaaaccaaaagggcccacaaggaggaatatggccgagagaaattccgaggagcattgtccaaaaggagtttggctcaacacttggaagccacggagcaaagcatgctagccatcatagggcaatacaaggaagaattgaaccagtccacagcccatgaacaaaagttagtggaggattttgcacaagtgtatgccaaaaaagaagcaagagggagggtgattgatgcgttgcatcaagaagcgactatatggatggataggaatttcatcataactaagaaaacaccaaggcacccctatgacactcgatccagaaaaatggataatgaagagggcgtgcaggaacagatgaaggccgatctatcggccttaaaagatcaaatggcttccatctcggaggtcatgttaaaactccagaaaaccatagaggataaagccaccgcaaccgcctccaatacagttagggaagcggagctggtgctgcagcccacctttaatccgggcctagacagaaacacggtcgtgtttggtcgaaggtatagtccgcaagcttatccttatggcctgcctccggactttaccccccgtgccaccccggaagatttaagccaagcccctacttttgaggggcaactcccaccttatgaagactatcccgggcaagacgatgcggaaggagatacccatcttggccccctgctccacctcaaagatccatccccgcatgaactaccccagccgaacatagtccgccatatcccggcctcacccacacccgtaaaagaatttgttcccttcgcggaagataagggaaagattgaggtgcttgaagagaggttaagagcagtcgagggccttggaaattacccattctcggatttggcggatttgtgtcttgtgcccaacatcgtcaccctcccaa

SEQ ID NO: 52574 - DNA, 426 bp, Glycine max
  misc_feature (17)..(17): n is a, c, g, or t
  Peptide Sequence Number=SeqID_144259
cccgcaataaacttggnccgagacaaaaacgcgacgggttttaatcggaggtatagtcctcaagcctacccttatggtttgcctccagactttactccccgtaccgctccagacgatttgagccaagcccctagcttcgagagccaagacggtttgcaagaagatgatgaaggagatgcccatttaggccctttacttcccctcaaggaaccagccccccatgagttgccccaaccaaacgtagtccgccacgtcccgtctccatccgcacccgttaaggaactcgtttgctttgcaaaagacaagggaaagattgatctacttgaagagaggctgagagcagtagaaggcctcggcagctatccgttctcggatttagcggatctgtgtctggtacctgacatcatcattcctcccaagttttaa

SEQ ID NO: 52575 - DNA, 347 bp, Glycine max
  Peptide Sequence Number=SeqID_144260
cagagtttccacaagcagcagattggttggatcaaatttctaagagtaaatggactcaggcctacgataaaggaaaatggtatgaccatatgactaccaaccttgctgaatggcataggtacttccgaagacgtatatttggcaagggaacaatcatacagttacctcacattatgttcctgtatggttcgacaactgctcaacactttgtaccagggtatgagatgaggaaatcacgatttgaggctaagtttctcactatgcgagcagagtttccacaagcagcatattggttggatcaaattcctaagagtaaatggacccagacctatgatgaaaggaaaatg

SEQ ID NO: 52576 - DNA, 498 bp, Glycine max
  Peptide Sequence Number=SeqID_144261
ttatccagaactacgtaggtctgagttcctcattggaggatacgtaggagcaggagcctcgcttttgtcgaccgcaccgctttttgttaccatgacccaaaagctggtagcccgcggagacaccttacggttatccgcacctcgtcattcagtgaccccaagtgtgattgatgagcggaggccaatgtggtcatctgcgccctttccggaggtgtcagcattttccggtggagactttttcaagtctcacaagatacgtaggcacgcagagccttgtattctgcaccctctttgtcatcctgaggcggtgggccatgacatgcggagacaaattatggtcattccgcacccctttgccattccgacacacttgtgcccgatggcacgcagagacaaattatggtcattctgcacccttttgtcatccagaggcggcgggcccgatgacatgcggagacaaattatggtcattccgcacccctttgccattcagacacg

SEQ ID NO: 52577 - DNA, 75 bp, Glycine max
  Peptide Sequence Number=SeqID_144262
atgcatataagtgatctacgtaacgaaggaaatggccccgaggaagcttgcctcaaagagatccacgaaggataa

SEQ ID NO: 52578 - DNA, 321 bp, Glycine max
  Peptide Sequence Number=SeqID_144263
atgtaccctctcttgttctcagttacaacaacccaagtatatgtaccctctatttgtaccataaaggatgtaccctccaatgtgttaagacaaagttctcaagcggttagtcctttgaaactttgtgaaggggaaacaaaagatatctcaggtgtcactggtaatcgattatcattaaggtgtgtcacaacgtgcccttcgtgggcgagcgagggcgaggctcacgggtgcgctttccgaaggaggaaagatgcgcggagtcgccaccaacatttatttgtggaaaacgtcgggaaaaccgaaggaaaccggtcaaaatga

SEQ ID NO: 52579 - DNA, 822 bp, Glycine max
  Peptide Sequence Number=SeqID_144264
ggcttcagaggactgcacgtcctcgccttcagagggctacacgccctcgtctttagaaggctacacgtcctcgccttcagcggactacacatcctcgccttcagaggactacacgtcctcgcctacagaggactaaacatcgtcaccttaagtggacttcacgccctcactttcagaggactacacgtcctcctcttcagagggctacacgtccttgccttcagaggagtacacgccctcgccttcagaggactacacgtcctcgccttaagaggactacacgtcctccccttcagaggactgcacgtcctcgccttcagaggattgcacgtcctcgccttcagaggactacacgtcctcgccatgccttcagaggacttgacgtcatcgccttcagaggactacacgccctcaccttcagtggactacacgactacatgtcctcgccttcagagggctgcacgtcctcgctttcagagggctccacatctgcgccttcagaggagtcaaggggccagtagtttccatttatcagttgcttggccaccccctgatctcagaggagggccaactgtgcgagcacaaccagagagggaggctatcgtgcaactactatgcatatcggggatagatttcgcccagaccgccacagggagacgattacggatcatgcgaaccaccacaactctgatcttcccctgccgaaggatcacgcccacaagacacccagtggacccggggaagtccaacagggtcctgcggtttccagctctggttatgggcctctgtcagtcttacagggtgtctgtcccccctagcaag

SEQ ID NO: 52580 - DNA, 507 bp, Glycine max
  Peptide Sequence Number=SeqID_144265
atggggccgcgtctggataaccttaatgccgcacgtatcggtagctcccgcgccatcactcagctgatcctcaacctggtggaaggttcgccgattaagcttatcgaaggcggcaaacagaagcgctgcttcaccgatatcagcgacggtatcgaagcgttgttccgcatcattgagaacaaagatggtcgctgcgatggtcagatcatcaacatcggtaacccggaaaacgaagctagcatcaaagagctggcggaaatgctgctcgcctgcttcgagcgccatccgctgcgcgatcgcttcccgccgttcgccggcttccgcgaagtggaaagcagcgattactacggtaaaggctaccaggacgttgagcatcgtaaaccgagcattcgcaacgcgaaacgctgcctgaactgggaaccgaccgtcgagatggaagagaccgttgaacacactctggacttcttcctgcgcaccgttgagctcacggacgataaaaactcatga

SEQ ID NO: 52581 - DNA, 426 bp, Glycine max
  Peptide Sequence Number=SeqID_144266
atgtgtcaatgggcatgtcggccgcgattgacgaatggcgcagaagacgacgtgagtctctgcgtgctatcaggcttttcgtcttacagacaacaaaaagtttatacggataaccactcgggtatttccggccgtcagcgtgactcaaaagtcagtatgacagatcttgtgagcgcggaagatgacgtaaatctccacgtgtcaacgggcttgtcggccgcgattgacgaaggtcgcagaagacgacgcttttcgtcttatagacagcaaaaagtttatacgaataaccactcgggtatttccgcccgtcagcgtgactcaaaagtcagtatgacagatcttgtgagcgcggaagataacgtaaatctccatgtgtcaacgggcttgtcggccgcgattgacgaaggtcgccgaagacgacgttag

SEQ ID NO: 52582 - DNA, 66 bp, Glycine max
  Peptide Sequence Number=SeqID_144267
atgtggctgaaagggatgaacgcgctaagcggaccatgtcgcgctaagcgcgttcatccctattga

SEQ ID NO: 52583 - DNA, 455 bp, Glycine max
  Peptide Sequence Number=SeqID_144268
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccgtgaattggatggtttccctttaaaaagatacaaatttgtagaatttagcaatgtcattgatggccagtttgaacctggtctattggttgacatcattggtgtggttgatgaggttgtctttcaccatgtttcatcaaggagtagaagggttgtttttaaacttagggacttgag

SEQ ID NO: 52584 - DNA, 195 bp, Glycine max
  Peptide Sequence Number=SeqID_144269
atgggaagagatctcaagaaggcacactgccccacaaatgaatcatggccagagaagaaaagtcatgaagaaagaagatccaagaaggcgtatattgcttgggatgacaatgactcatccgatggttcggagaaggagatcaaccttctatccaaggactatgagagtgatgagaacatctctcaagaagattaa

SEQ ID NO: 52585 - DNA, 372 bp, Glycine max
  Peptide Sequence Number=SeqID_144270
atggttctcttgaccagacatgaagagtctataaaagcaaggctttgttttgcattttcaatcaatcaatctttcaatctatccaatctttcaatctctttgaacttcttcttcttccttttgccaaaagctttccaagagttttctgggtacatcctttgtggtacaagtagagggtacatctacttgggtttgactgagaacaagagagggtacatctcttgtggatcagttctagtggagggtacatccactaggttcaaagagaacaagggagggtacatcccttgtggatcttttcttgtaaaaggatttttacaaggttggaaaagaaatctcaaggaccgcaggttgcttggggactggatgtag

SEQ ID NO: 52586 - DNA, 252 bp, Glycine max
  Peptide Sequence Number=SeqID_144271
atgggacaccctaagagaataaaggtcattcctgagtggcccactccaccaagtataaagaaaattcggggcatccatgacttaacgtacttttacaaaagatgcccaggtgtcgcaacttacccttcggtaggagggcgacgcggggctcacgagtgcgtcttccaagggaggaaggcgtgcggagtcgccaccaacgtttatttgaggaaaacgtcggaaaaaccgaaacatgtggtctacgaattttaa

SEQ ID NO: 52587 - DNA, 2025 bp, Glycine max
  Peptide Sequence Number=SeqID_144272
atggttgaatataacctttcgttatttttaccacctaccgccgcacagcaccaccgggggattgttaccccaggttatgccgcgccaccggcagcagataacgctctgtttcggccagtatttgcgctaagtattcattatccaattggcgaaacactcgctgcacgcttgcagcaatttggcgcgcgccttgatttgcgcttcttcctcccagtcgatttgctgcgtttccggcagatagcactgactcagccacgcccagccgctcttgttcagcaacagcagcggctgactcagaccgcgctgatagcccgtcagcagttccgccagctgcgcctgtgcctcttcaggcgccagcgcggcaaagcgccaggcggagttcttgcggccatacatgcggctctcgccggtgccgccggcgcagcagtacaccaggtgctccagccacagcaatatgccatccaccgccgacagcgtcgcgggccgccagcgcagcaggccgtcaccctgcacctgatgcagccagccgctgaggcgcacgccggcgatatcgatatccagctccaggctatggctctctgcgcgttccgcacgcacctgctcggccagttcgctcatctcttcctgctgcttttgccaataaatttcgccgaaggcgccatagggcaagccgccggcggcgcgcacccgctggaacagccgttcgggatcgtcaccgtcgatcagcgtattcagcagttggctgttgaactggtagcggctgaggttatccagcgtgaagggctcttcgtccggcagctcggtctcttccaggataaaactgacgcccagccgcagttggaaaaacgcgcgaatcggatggcggtaaaaccgcagcagttcatccagcgatatttgctgcagcgcttcggcgggcagcggctggttgaacgccggatgcgccgcaccgcgcccatcggcggcgggcagccactcggcggcatagctttgctcctccgagcccggcaagaagttctcggcggcgaacggcatgcgcgcgtgccacttcagcaagtgctcaccaacccgccgggcgctgtcgtctgcgctaagctcttcatctcccggcaggcaatagctttgttccaggtactccagcagctcagtgaccagtaccgaagggtagcgcgggctgttgtcctgaatggaacggccgatgaagctgatatacagccgctgttgcgcggacaaaatcgcttccaggaacagataacggtcgtcatcgcgccggctgcggtcgccgcgtttgacctgctgcgccatcagatcgaaacccagcggcggcagcgtgcgcggatacacgccgtcgttcatgcccaacaggcacaccaccttgaacggaatggaacgcatcggcatcagcgtacagaagttgatttgcccggcgaggaagcgctggctgatgcgctcctgatcgaggcgcgccgccagatcgtcccgcagaatggtcaacggcacctcatcgggatagcgcgccgccaggccaaaattgatggcctgctgccactgctgttcgatcagcgccagcaccacctcggtgtcgctgtccgcagcgaagaaggcatccagcagttgccggcagagcggcagccacgcttcgagcgggcgcgcttcgctcaagatttgccgccagtggctgagctgcgccagcaggtctgccagctgccccgccagttcggcgaccaatccgctcgattcgtcgtaaggcaaaatgccctgccaatcgccggcattgctgtccatcgcgtagccaagcaacatgcgcgtgatgccaaagcgccaggtatgttggccggtagcgggcagatccagttcgcgcacgttatcgtcgtccaggccccagcgcacgccggattcaccgacccaatggcgcagcaggcgcagcccctcttcgccaatggcgaaacgggcggccagggccggcacctcaagcagcgccagcacctgttccgaggtacaacggctttgcggcagatcgagcagtga

SEQ ID NO: 52588 - DNA, 263 bp, Glycine max
  Peptide Sequence Number=SeqID_144273
cggataacaatttcacacaggaaacagcttatgaccatgattacgaattcgagctcggtacctcatctccagctctcaaaccggctcctacttcaagctctagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 52589 - DNA, 254 bp, Glycine max
  Peptide Sequence Number=SeqID_144274
atgaccacattggcctctgcttgtcaatcgaacttggggtctccgaatgacgaggtgcggataaccgaaaggtgtctccgcatgctaccagactcttgggtcatgatagcaaaaggtggggtggtcgacaaaagcgagacttttgctcctacggtttgtggtaagttgggatttaggctcaaggcttgtagaacggctagacttgatatatatcaggatgttggtttggccaacggctcagggaaaaaggagaa

SEQ ID NO: 52590 - DNA, 255 bp, Glycine max
  Peptide Sequence Number=SeqID_144275
atggcgagggcgtgtagccctctgaaggtgaggacatgcagtcctctgatggcgagggcgtgtagccctctgaaggtgaggacgtgtggtcctctaaaggtgagggcgtgtagccctacgaaggtgaggacatgcagtcctctgatggcgagggcgtgtagccctctgaaggtgaggacatgcagtcctctgatggcgagggcgtgtagccctctgaaagtgagggtaactagtacccaaggcgagggcgggtag

SEQ ID NO: 52591 - DNA, 885 bp, Glycine max
  Peptide Sequence Number=SeqID_144276
atgagcgatggccctgacggcaacagcgtcagggcctgcaacttacagcgattgatggcgggtttcgtgggtcaacagcagggcgatcagcgtcagcgccgccatcgccgccaggtagataccgacagccggcaggccgtaattgccctgcagccaggcggcaatatatggtgcgaccgacgcgccgaggatcgacgacacgttataggagaaagaggcgccggtataacgtacttccgtcgggaacagctccggcagcagcgcgcccatcgggccgaaggtcaaccccatcaggctaaggcccagcagcaggaaggcgaagaccagaatcgggttgccggaaccgagcaacggtttaaaagcgaacagcgcgaacagaataatcatcgtggtgatgataatcatgcttttacgacggccaaaggcatccgccagcaggcccgccaccggcaccatcacgccgaaaccaatgaccgccatcatcagcatccacagcacttcggtataggtcgccagcatgatgaaggtgccgagcacggtcacgcgcacgtgcttagtcagcagcgtgccaagcggaattttgacctgaccgataatgaccagtaccgcagagaagatgaacggcacgcgccagccccattccataaactgctggtcgctcaacagccacgacagcaacaggaaggtgcccgccgccccgccccattcgccgccaaggccgagaccctgaccaaagcgcgccagcgccagcagcatcggcgccagaatgccaatgctttcatagcccggcagcaggccgatgaccacggtggagatgcccatggtcagcagcgaggcgacgagtgtgactttacggcctacgcggtcgccaaagtggccgaatag

SEQ ID NO: 52592 - DNA, 474 bp, Glycine max
  Peptide Sequence Number=SeqID_144277
atggacatgaatatgggctacttaatttctcataggatctctatgatcgcccagcacgactcctctaggcttgggtttctagccttaatcactgctttatatgccacatgccatgatgcagagcctacactgagggcaggtcattattatgcaaagcttccataccttgggcctaccatctatcatgagcatggaagactttcacactcaggtggcttggccaagagtccagccttttccttctggaggggtgagacctccacaacccaagagcctgagctcgcagaggagcatacaccagcagcggaagatgagcttacttctcttgagcccttttcatttgcttctgattcagttgtggctcaggaggaagtaccttcaccagagcttattctagagccatctcctgcacctatctctgaggataccctaccatccacaccagcattggagcaagagcagcccatttcatag

SEQ ID NO: 52593 - DNA, 634 bp, Glycine max
  Peptide Sequence Number=SeqID_144278
atgtccatgcaaaaagtttcagaatggccagggacagatagtcaactagataatgtaaaattgagattgatagctggacgtgaaaaagatggtcgtacatacaatctcccaaatgtttctgaagttgttgccctgattgttggtgattttgatgcagactcaagaagggatattattgttgaaactcaaaatggagaattacaaagaatccatgaattacactttagctatctaggactgcagtaccatttactcttcccttatggtgaagatggatatagacctgatatacttcaccgttctatatctagcaacagaaaaaggaagagaaatcatctaacaatgagagagtggttttcttatagactgcagtccaggtcaaatgaagcacaaactttgttgcattctaaaaaactattccaacaattcattgttgaagcacataccatggttgagtctgaaagacttagctacatcaggaacaaccaaaaaaaacttagagttgacaagtattgtagtttacaaacatcattggatgctggaagcagtaaaggctcatctaaaggaaaaagagtgattttgccttcaacctttgttggcagtccacattatatggatcaactttactttgatg

SEQ ID NO: 52594 - DNA, 431 bp, Glycine max
  Peptide Sequence Number=SeqID_144279
atgtggccttcaagtttgatgaagaatgttcagcagcatttcaggagtcccactgaaagcaagcttactactgcacctgtgatgggggaacacattgcaacccgactgttgaaggtcctgaatgaagcacagttgaattatccacggaaaggaaatagctgtgtgccttggagaagctcgatgatacttgcctataggacagatgggtcctcttattgcaagaatttgacatcatcatcggataagagaggatccgagaatgtggtagccaatcacttatctcggttaaagaatgaagaagtcactaaggaagagcctgaggttaccaccagaccttggtttgtggacacggcaaactacaaagccacgggagtcattcagaggagtacacttggaatcagaggagagttctacacgacgcacgcttctat

SEQ ID NO: 52595 - DNA, 295 bp, Glycine max
  Peptide Sequence Number=SeqID_144280
atgtcctcctttcgcgatttggagcagaaatgggcaccaaaggttgaagctttgttgggcaacaatggtggatgggagaaaagaagaagaaggttgcgtgagagagaaagagcttctgaaatttttttggggctgagtgaggagagagagagagaaatttccaggatgtcacacaaggaactgattaagatatttggaatggaaaactcgaaacacttggctactcctatgagcaccagttgttaccttgacaaagatgaatccggtcaacccgttgatgcaaagcaatacagag

SEQ ID NO: 52596 - DNA, 321 bp, Glycine max
  Peptide Sequence Number=SeqID_144281
atggatgtcttgcgtcttgttggaacaagtgcggggaagttcttgactcccgttcaagttgcaactccttctcaaagaggggcagccaacacccggaggaaagatagttttcttcctaactcgcttttgagaggacttcttcgtcctacttccggttcaaaattctcttcgcaatgcgttgtactaattggaacccgaagtgaagccaatctcaaacctctgtatgtcttggaattttgtgcgccgagatccctcaccaggaaaggagacatgctttcttccgtcggtgctcccctcatggggtacctagttgtcttatag

SEQ ID NO: 52597 - DNA, 168 bp, Glycine max
  Peptide Sequence Number=SeqID_144282
gaacgtcctgaattgaagctggtctcccacggaagaaaggtagagaaatttgggaggccagcacccgagattgcagggttagtcgctgccataggattaactcctttgatcgggtgttcagtagtcaccggcgatccgggagttatatccgctttcatggagaggtag

SEQ ID NO: 52598 - DNA, 229 bp, Glycine max
  Peptide Sequence Number=SeqID_144283
gaagggacctgtcactagaaccatgagcaagaggctccaagaagattgggctagagctgttgaagaaggccctagggttctcatgaacctcaggatttcagagctctttttgagcacaaaatttcgtgctcttctctccctctcccttcattcatctccttcttcctccaagctcttatccatggcctcctatggtggtaagcttcttctagactcatcttctccttga

SEQ ID NO: 52599 - DNA, 939 bp, Glycine max
  Peptide Sequence Number=SeqID_144284
aatgcttttgcaaaagggctaggcgtagaagaattccctgttgtccgtgttcctaaagataaaaggcattttaccagtgaagcggtagaaaatgctatctcagcctttaaaaagaaagtgaaaaataaagaattgacctggctttttgaaaactgctttcccaatacattagatacaacggttttctatacagaaaacaacggaacaccggatacttatgttatcactggagatatagatgccatgtggcttcgtgacagttctgcacaggtttttccttacttgcagttttcaaaaaaagatgaaaagctgcacaaattgatatcaggagtaatccataaacagacccagtttattctgaaggatccttatgcgaatgcattttataatgatgatcaaaagataagtaaatggaaagagtacgatcatacggatatgaaaccaggtatccacgaaagaaaatgggaaatagattcactctgctatccaatccgccttgcgtatcatttctggaaaacgaccggagatacaaaaccttttgataataactggctgcaaggaattaagctgactctgaaaacttttattgaacagcagagaaaaacaggtttaggaccttatcagtttgaaaggacaacagcctgggctaccgatggaatcccaatgggagggtatggatatcctacaaaacctgttggtcttatcagctccatgttccgaccaagtgatgatgctaccatttatgcattccttataccttccaatttatttgctgtgcccgctgccataaagaaatatggaatctatgaccatccgcagtatggaaaaatatatgcttttgaaacgaatggttttgggagctataacctaatggatgatgccaattgtccaagcttgttgggattgccttatctggatgctgtaaaagctgatgatcct

SEQ ID NO: 52600 - DNA, 321 bp, Glycine max
  Peptide Sequence Number=SeqID_144285
atgagatcaccgatgatagatggaggaaatgaatatgcacaaaacacaagggagacccataagggggtcgatcacggtcgtgattcagtagcgcctcgggcttcattttctcttctttcttcttcttctctctcaattctctcaatatccttcaatgctgaaccttggaaccctttactcagcccccttcacgcctatttatatccaaaaatggcatttggtggacctgcagctcacccaggcaagctgagacttagccatgaagcaattggctcacctaggcgagccagagactggtgtcgaacaacacagtttggctag

SEQ ID NO: 52601 - DNA, 279 bp, Glycine max
  Peptide Sequence Number=SeqID_144286
caacctacgctcctgaggttgccttccttaagccagttcagtatcagattcgattatgctcatctatgcaactacaaagtgtgcaaaggggtgcaatcgttaaaacgatacgagcccaaagatggagaacttggcaacaagcacccaaaaacagagaagagagggcatttgattgactgtgttttcaacaaaaagatcgaagtggttatccgaaaagaggcaaatttgactcagttacctactaacgactggaaaactggggcaaatgaagagggttga

SEQ ID NO: 52602 - DNA, 528 bp, Glycine max
  misc_feature (158)..(158): n is a, c, g, or t
  Peptide Sequence Number=SeqID_144287
atgggaatacttcaagaagttatgcaggaccatcccgtattgctgaatagagcgccgactctgcatagattaggtatacaggcattccaacccattttagtagaggggcgtgctatttgtttgcatccattagtttgtaagggattcaatgcagactntgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgaggtccaatcatagtttttcaatttctacgcaaatcaagcataaagaaaagcagttttccaatcattgatctaattcgtggtctaattcgaaaacattttgcttcgaacataggaattgctaagagtaaattcgggaaaagaccgattgtatgggaatacttcaagaagttatgcagggacatcccgtattgctga

SEQ ID NO: 52603 - DNA, 351 bp, Glycine max
  Peptide Sequence Number=SeqID_144288
atgggctacatgggagtacgtgagctcagttggaggtgggcaacaggggatgatgaacccgtgcgcacgcttcagcgtactgtggagtggatactacccacgcctacaccatatcgtctagtggagcccgtccaagtgatcgaggtaacgtcatccgaggaagacactgaggaggatctggaggagctacctcctgagcctgttgtggatgcccttgactttctagagggtgatgaggatccacttcttgaggtggattctcccgaggaagtcatgtcggcatctgaggcagactctacggaggatagtggcccgggggagatggcgatcaacggaagctcttcatcctag

SEQ ID NO: 52604 - DNA, 489 bp, Glycine max
  Peptide Sequence Number=SeqID_144289
atgcgcatagcggtggagagacctggtggcacaagtggcccctcccatggtcgaaagggagacgatcaccatgatggctacatgccttccagcttcgcggacttggtattcaccgaggaaagaattgcagtagggttgaaaagagggaagttcgattacatttcctccacaagtacccatgctaaaagagtcggagcaactggggcaaaaaggaaagagggagatacccatgccgtcacttcggcgcccgcatgggtcaagcaaccgcagacctcttgtcataccctaatttcgtcccgggaccattgtttcatggcatgtaacctttgtttgacctcttcttggtatctggcaccctttgttgcacaatacatgaagtttcgtgacatgccggaatcaaaaggaagcattgctacgcaatctgtgaaattccgtaacatgccggaaatcaaaaggaagtattgttacgcaatccgtgagtttccgtaa

SEQ ID NO: 52605 - DNA, 822 bp, Glycine max
  Peptide Sequence Number=SeqID_144290
acaagcccgtcagggcgcgtcaagcgggtgttggcgggtgtcgggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccgaaagaaaaccaagagagacaagaaaaaggtaacatcagagtggaagaactaagtcaggatgaaagagagaaaataagagaggaagagagaagacaaataatgaaagaaatgaaacgagaaaagtatgtctcctatagtagtcataactcttgcaagagcctaagtgaagaactttgtgagtattatgaaggaaggcataggtcacatcttagacctcagtcccataggagagaaagtgaaagaaagtctcaagaggttaacattaaactcccatacttccatgggaaggacaatgtagaggctaatgtagattgggaaataagggtagagcaacaacttagaaggaagtctacttcagaatcttatggctctcactcttatccaaagaaagaccaaggtcaaggaatcttaggggtgagaccttctaagcccaaagatgatacggggacgacaatcgaaaagcaagccctttag

SEQ ID NO: 52606 - DNA, 357 bp, Glycine max
  Peptide Sequence Number=SeqID_144291
atgttggaagagaagtttgttactattattgatgctagtagcaatgcaaagaaagttcattataaagcttgggaaagatctaacagactcagcctaatgttgatgagaatgactgttgcagacagtattaagacaactctccctaaaatcgaaagtgctaaaaggtttatgggattagtgggagagtgttctcaaacagctgataagtctgttgctgggatattaatgagtacattgaccaccatgaagtttgatggttcacgcactattatgttagttcaggaagaaacgaggcttaagaatcaaggaagtcactcagtccattatgtaagccaccaagggaatcaaggagcttga

SEQ ID NO: 52607 - DNA, 336 bp, Glycine max
  Peptide Sequence Number=SeqID_144292
atgagggtgactaggtttggctccatcttaggaagaatagattccctactaaaaggaaatccaagcttagcccaagaagggatggaccttttcaggttttggagaggatcaataacaatgcatataggttggacctcccagaagagtggagctgatattgaggaggaggaactaactgatttgaggtcaaatcctcttcaagggggaggagatgatgcaatcctccctaggaaggaaccagtcaatagagccatgagtaagaggctccaagaggattgggctagagctgctgaagaaggccctacggttctcatgaacctcagggtagatttctga

SEQ ID NO: 52608 - DNA, 312 bp, Glycine max
  Peptide Sequence Number=SeqID_144293
atgtctcctccacctctagaacctcacaatcactcacacacccatctcatgctctcaggacgacttcctcgtcaagctcggttctctgcaggtggctttgtttgtgctagcgcgcttagcacgactatggaccgctcaacacgcattagtggatttcggcttagcacgtgcttttctcgctcagtggatggactgaagcggtgcgctcagcgggatgacccttcactcagcgaacatgcacaactcatccttcttctagattcttcctcgcactcaaccgaggagtgttgcgctcagcggatggctcgctaa

SEQ ID NO: 52609 - DNA, 285 bp, Glycine max
  Peptide Sequence Number=SeqID_144294
atgtcagttttcagactgactcctaagcctcgtttgcctcacaatttcgttaaattctcttttctcccaaaaccctctcttatacccacatgccacctaacctgtctgagaacattgatgatcttggactcattcacgctgttagaacgtcgtgactgggagaaaaaggattcgcatgaagacagtacaagtggaggtttcaatctcttctccgtctctttgacgtttgtgaattctatcggagcagtcggaggaataactgaaggaatctcagggaaccgctag

SEQ ID NO: 52610 - DNA, 504 bp, Glycine max
  Peptide Sequence Number=SeqID_144295
atgtcgaacaatctggcgaaggcgcgcccgcgggcgctcgcgcgcatggggcgcgccatggcggtggttgccgtggcggggttgctgggcgcgtgcgcgcagcaacccaagagcatgtacagctggcagtcgtaccaaccctcggtctacgcctatctcaaggacgacggcgccgactacgcggcgcagagcctggcgatggaaaagaacatcgaaaccgcgcgggcgagcaacgcgcaattgccgccgggcttccgcgcgcatctgggcatgctgtacctgaagctgggtgatggcgccaagggcctggaacagctggaaggcgagaaggcggccttccccgaatccaagccgttcatggatttcctgctgcgcaatgccagcaagatggcggacaacgccgcgccgtccgagcccgcgtcggccgcgccgtcggcggcgcccgccgcgcccgccgccgcgcccacgcccgccagcgcacagccggccaagaaaggagcctga

SEQ ID NO: 52611 - DNA, 213 bp, Glycine max
  Peptide Sequence Number=SeqID_144296
atgattgttaaggagactgagctttgtagaagcaagcttcatgatgatgaaccaagcaattttgatgatgccaaaaggccaagcctaggatcttcttcatcaatggattcctttgcttcttggaagatgaatggcagcataatggagaaggaagagagagaggagacaccacttcaaggagaagatgagtctagaagaagctcaccaccatag

SEQ ID NO: 52612 - DNA, 210 bp, Glycine max
  Peptide Sequence Number=SeqID_144297
atggaagtttcctatagatgccactattgtatgcctgttcgaaatgtaaatcatagtattcattcttatgtgaatgggaatgaaagtacacgaagggggatactcttttgccctcgaaatgcagcaggaaatgctattcgaacagtatcggatcaaggcatgcaacgagcagaagtcatgataaaaggtcctggtctcggaattgattga

SEQ ID NO: 52613 - DNA, 207 bp, Glycine max
  Peptide Sequence Number=SeqID_144298
atgtttggggccagccccagtgaaatatgtggaaactcatgctatatgtcacctttatcgaagactctaccagaaaggttgaaaacaaaagttgaaaatcagacaggtctaaaggttaaaagtctgaaatccaacaatgacgggaagtatgatagtcaggagtttaaggacttttgttcagaaccatggaagggtcagaatgattaa

SEQ ID NO: 52614 - DNA, 579 bp, Glycine max
  Peptide Sequence Number=SeqID_144299
atggatattattccagacaagtatcccctaagcctgcagaatatcaaatttggatctaaattgtatgtcaacgctgatattacagagatacacgaatttcgtcaaagtttgtctgtgccattttattctggtgggatgatcaatgataaagatggttctcagtcccaatctagccagagtaatgtggtggaaaaatttctacagaatgctcaagtggtcagtataggtgaaatcaacaatctcagacaggattgttactgcttaactgttggaacagttgacgaaatcattattgatgctccatggagttatgacagttgtcctaactgtacaacgacatttgatccattaaaaggtggctcagcttgccgttcttgccataccagtgtggtcgatacagttccacggtataaattaaatgttaagatggagcataatggggacaaaggaaacttccttctctgggatgcaacatgtatcaagctgtttggtaaaactgctggagaatgtcgagatgagttgatagcggttggggatgatattaaggtatttccaacatgcgttgatgaaatcctgtga

SEQ ID NO: 52615 - DNA, 178 bp, Glycine max
  Peptide Sequence Number=SeqID_144300
atgacattaaccatcccagagcttttcttgaggccttatcaggttacatgggataccaccgtgtttggggtctttaatccagacttttcgttctacatagagcacgaagaccgtacctctcggaaatcccacgcggtggtcaatgtctcaacatatcagtgttacagtcatggattct

SEQ ID NO: 52616 - DNA, 420 bp, Glycine max
  Peptide Sequence Number=SeqID_144301
atggcagtgcaattaatccatgatcaagtggagatggagtgcctagagggagtttgggagaccctcgaaggcaatgcgaggtgccgattccgtggcacgattcggctcattgctacttcattggtacatccagaggaacccgcacgcacgcttcagcgaactgtggagtggatactacctacacctactccatatcgactagtggagccaacccaagtgatagaggtgtcgtcctctgaagaagaccctgaggagttacctcctgagcctgttgtggatgctcttgactttccagagggtgatgaggacccacttcctgatgtggattctccagaggatgtcatgtcagcatctgaggtagactctacggaggagagcggccctggagggatagcgactagtggagactcttcatcatag

SEQ ID NO: 52617 - DNA, 216 bp, Glycine max
  Peptide Sequence Number=SeqID_144302
acttatcaaggtaatccttgtggcgtctaccctgacttatcttccttcactggaagtggcgtctacccagacttatcttccttcaccggaagtggcgtctaccctgacttatcttccttcaccggaagtggcgtcatccaaaccttcgtagcctgtatcaaacgatccgctcctactcaggttcacatcatctggtatcagagcttcagctcttga

SEQ ID NO: 52618 - DNA, 272 bp, Glycine max
  Peptide Sequence Number=SeqID_144303
atgactgttgcagacggtattaatacaactctccctaagattgataatgctaaagagtttatgaggttagtgggagaacactctcaaacaactgataagtctcttgctgggacattaatgagtacactgatcatcatgaagtttgatgattcacgtactatgcatgaacatgtcattgagatgacaaacattgcaacaaatcttaagaccttgggaatgactgtgaatgagaatttccttattcagcttattctaaactcattaccatctga

SEQ ID NO: 52619 - DNA, 468 bp, Glycine max
  Peptide Sequence Number=SeqID_144304
atgacagatcttgtgagcgcggaagatgacacagcaaaaaagaatgtttatacggataaccactcgggtatttccgcccgtcagcgtgactcaaatgtcagtatgacagatcttgtgagcgcgaaagatgacacagcaaaaaagaatgtttatacggataaccactcgggtatttccgcccgtcagcgtgactcaaatgtcagtatgacagatcttgtgagcgcgaaagatgacacagcaaaaaagaatgtttatacggataaccactcgggtatttccgcccgtcagcgtgactcaaatgtcagtatgacaaatcttgtgagcgcgaaagatgacgttaatctccgcatgcttttcgtcttacagacagcaaaaaagaatgtttatacggataaccactcgggtatttccgcccgtcagcgtgactcaaatgtcagtatgacagatcttgtgagtgcgaaagatgat

SEQ ID NO: 52620 - DNA, 109 bp, Glycine max
  Peptide Sequence Number=SeqID_144305
gtcggtctgggccagtgcggcggtagaaaaaagcatcgacagggcagttgctgcccccgcaaaaatggctctgctggtcatagatggtcctcctcctcacgaagggtaa

SEQ ID NO: 52621 - DNA, 828 bp, Glycine max
  Peptide Sequence Number=SeqID_144306
atgaaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagtttatcagaagcttggtctaaaattcccgaaaaattagctttttatgattatatcggaaataatccagcaaaaggggggttatttagagcaggttcaatggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtaggtgtaattgttgagttctatggtggcgagcttaatggagtcagttatagcgatcccgctactgtgaaaaaatatgctagacgtgctcaattgggtgaaatttttgaattagatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaagtagaatttggagcattccaaaaacttggagatccaactacaaaaaaacaggtagtctaa

SEQ ID NO: 52622 - DNA, 231 bp, Glycine max
  Peptide Sequence Number=SeqID_144307
atgtggaccaccacgggggaggagcttgccacccagctcggccaggcgagcaaggttgcttcctctagaagcaacagccttctcgaggaaggatctggaaggcccaagagggccagattgctattcctttcgaagaagttacggaaactcacggattatgcaaaaacacctcttttcgatttccgccacattacagaatttcacagatcgcataagcctgcttccttttga

SEQ ID NO: 52623 - DNA, 144 bp, Glycine max
  Peptide Sequence Number=SeqID_144308
atgccttggaaaatatgtatggatagtttgacacatggcgtaaggaatttatttgccacaaaagtaggtgcatcttgtagggtatcattcatcgagagaaagataggaaatggctccgaagaagctatccatgaagaggtctag

SEQ ID NO: 52624 - DNA, 367 bp, Glycine max
  Peptide Sequence Number=SeqID_144309
atgagtgcaaagagttctagcgggtacacgagcaaaggaggggatgagtacgccaagtttgtcctctttccgaatatggaagggttagtggacctagtagtgattgacgctttcctcgcctttcagcatggcaaggaaagcccggtcgtcgccattttggccatgtatgacacgttcgaccgaggatgtgaaaagagcggcacaagaattgtttgttgtgcactggctctctatgtgtggctggtttcacacccttttctccaagaaggtaggcccgtctatccgctacaaggtcaccgctcgtgcgtcgaaaaaggaaaggcgaattggaccaactcttggctaacatggagggcgtctgttaatg

SEQ ID NO: 52625 - DNA, 312 bp, Glycine max
  Peptide Sequence Number=SeqID_144310
atgcgtctaccggggaaggagagtctgccgatgggatcccccataaccataaatgagattgtggatgttagcatatcgttcctagatgaccatttagaggaaacaccgggttcgacaaaaatagaagaaaatcactcaaagtgtatcaatcttgcacagatcatggattacttgcatgatcatggatcaatagggcttcccttgggaatgggttcttttggtggtttagatggtcggcttttgtgtgtttgcggctttagattttactggcttgttcttgatctgtacaagtttggtctagtgcggggcgag

SEQ ID NO: 52626 - DNA, 294 bp, Glycine max
  Peptide Sequence Number=SeqID_144311
atgaaggactccttgaggcaaagttggtacattgatagcggttgctccaaacacatgacgagagatgcatcaaagtttattcatatttctcccaaaaatagtggacatgtgacctatggagacaacaacaaagtgatgagaatcctgaaactggccaaatacaggctaaaggcccaattggagaaggacgaaggcccaagtggagaaggacaaagcccccgagtggagaaggatgaaggcccaaaggcagagacactatcaagactattaattgttgctgaaggcctagattaa

SEQ ID NO: 52627 - DNA, 207 bp, Glycine max
  Peptide Sequence Number=SeqID_144312
atgaaggctgcacgagttccgtaccaaggattgaagagttatttttttaagaccaaagaagagaatgttcaagcagctgatgactcgctcagcgaggcaaaccctctcagcgagtggcatccgcttagcgaggcatccaactcgcttagcggatgggaaaccctagaagacgatagtcagagatgtgctcacccagtgcacagctag

SEQ ID NO: 52628 - DNA, 267 bp, Glycine max
  Peptide Sequence Number=SeqID_144313
atgatggcacatcaaaaccccccatacttagccttttgcactcctgggcaaaatgaaacaaagaacaaaatccaaggatatcaaagggagacaaacaaaaacattcacatatttctcaatgaacatcaaggaatgaaaggaatggcacatgaggatcaaaaggtctttaaagttgtaatggggccaaggacaaggtatggagaaatatggaataagtggctaaatcccaaaggaatagaggagcaaaggggaataagtgcatattaa

SEQ ID NO: 52629 - DNA, 132 bp, Glycine max
  Peptide Sequence Number=SeqID_144314
atggagttcaatattcacttaggatcaacatttcagccagcaattatatcaccaaaactcaaatttacaatagacacaatcataaggaaccctaaaagttcatccaaaggttcacaatcaaagactctctaa

SEQ ID NO: 52630 - DNA, 360 bp, Glycine max
  Peptide Sequence Number=SeqID_144315
atgaggggccaatggatcccctttgatgaggatgccatcaatcaatttctggggcatccattggtcttggaggaaggccagcgctgtgagtttagtcagaggaggagccaagcatcggggttcgatgaggaggccatcagccagctattgtgtgttccggggcaggactttgcctggagcatggcagggagacgggtgcagatcatgcacaccagcatgaccaccctcacacaaatttggatgacgttactgctcaacaacattctccccagcgaccataattctgacctccccttgccaaagtgccagctagtctatgccatcctaactcagggatcacacctcgtagacacccaatag

SEQ ID NO: 52631 - DNA, 519 bp, Glycine max
  Peptide Sequence Number=SeqID_144316
atggccccgaggaagcttgcctcaaagaggtccaggaaggataaggcggccgaagaaactagttccgctcctgagtatgatattcagcgctttaggagcgtcgtacaccagcagcgcttcgaggccatcaaaggatggtcgtttctccgggagcgacgcgtccagctcagggacgacgagtatacggatttccaggaggagataggtcgccggcggtgggcatcactagttacccccatggccaagttcgatccagaaatagtcctcgaattttatgccaatgcttggccaacagaggagggcgtgcgtgacatgaggtcctgggtaaggggtcagtggatcccgtttgatgccgatgctatcgtccagttcctgggatatccgttagtgctggaagagggccaggagtgcgagtatggccagaggaggaaccggactgatgggatcggtgaggaggccatcgcccagttgctatgtataacggggcaggattttgcccggactgctgccggaagacgg

SEQ ID NO: 52632 - DNA, 177 bp, Glycine max
  Peptide Sequence Number=SeqID_144317
atgggggttaagtacctcaaggcggtcaagcgaaggttgcatgccaccaaacaatggtccccagacgaaattagggcaaacaattcatgggactccagactcaatgatggaggatgcatgaacaacgctagacaatcaattcatggggctccagacttgatggtggaggatgcatga

SEQ ID NO: 52633 - DNA, 468 bp, Glycine max
  Peptide Sequence Number=SeqID_144318
atgcaagcacaagcacaacaacaaaaaaacctagagataaatggactaaagaggatagaagaagaatccaatataatcttaaaggaatggcagcccaaggtaactgccatttctgaaagtaaagatctttcctctatgtctcttgccactttgtttggcaaattgcaggaacatgaaatagaactccaacatctcaaccaaaatgaagagaccgacaaaaggaaaagaagcatagcactcaaagcctcttcctcaatacaagaagaagaagaagaagaagaagaagaagaagaagaagaagaagaagaatctgatgatgaagaggacttctcactttttgtgaagaagtttcataaatttgtcaaaaatagaagaatggagagaaaccataacttcaacaatgggaagagatcccaagaagtttctcgacacttaaatgctataagtgtaatcaacccggtcacataa

SEQ ID NO: 52634 - DNA, 195 bp, Glycine max
  Peptide Sequence Number=SeqID_144319
atggcatcttcatcgtcatcttcatcacatattaacattaagtctggccccatcgattctgataacatgtttggaatggggaagaagatcggaaattacatatcagacgagttgtccccacgtatcaaggggaagaagaaattccagagcaaatttttccttttcttcgacaatttggtttcgcctggattatga

SEQ ID NO: 52635 - DNA, 190 bp, Glycine max
  Peptide Sequence Number=SeqID_144320
ctccaaacttgaagatggaggacacatgaacgaaaacgcaattcatggggctccgaaaaaggggttgagaatggagaattgcactaagcaatcactacgcatggctccaaactcgaagggattgcgaatggagaattgcactaagcaatcactgcgcatggctccaaactcgaaggtggaggacacatga

SEQ ID NO: 52636 - DNA, 198 bp, Glycine max
  Peptide Sequence Number=SeqID_144321
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggcgctaggcaataaccttcatggggctccgaaaaagggtgagaatggaggattgccttga

SEQ ID NO: 52637 - DNA, 642 bp, Glycine max
  Peptide Sequence Number=SeqID_144322
atggctgctagtgatattgccatcttaagagacagagcccacatcccaaccaagaagagcttattggagcttacatcacaggatgcattgttggcacagaacaagttgctatctaagaaactggaggcattaaccgagacactaactcatgactctggatgttgtatccctagtgaaaaaccaattgttcatgaagtcaaatacatggggaatcagcccagaaatacttttaatgcaggaggatttaccggattccaaaatggccagcaatatcaacaacatagacaatggcagaaccaccctagcaatcaatccaacagagaccagaatggacagttcaataggcctcagcagcaagggcctagtctctatgagcataccacgaagctggaagagactctagctcaatttatgcaggtttcaatgtctaaccagaagagcacgaagttcgccattaagaatctggaggtccaagtgggccagctcataaagcaattggcagatagaccgtcaagcagctttactgcaaatactgagaagaatccaaaggaggaatgtgaagctatcatgacaaggaatagaatggcaacccatgttgatgaaggaaaagttgagaagaaggtggaggaacaaaaacaatag

SEQ ID NO: 52638 - DNA, 186 bp, Glycine max
  Peptide Sequence Number=SeqID_144323
gtcgactctagaggatccccggttcgtgaacgagcaccccgacctcgtcgagggcatcagggcgcagttggtcgacaaggaccgcaacccgaagtgggacccgccgacgctggcgcagctcgggccagacgcaggcgcctccgcccgcgactacgtgccgcagccgcccctgttctgagcccctga

SEQ ID NO: 52639 - DNA, 396 bp, Glycine max
  Peptide Sequence Number=SeqID_144324
atgaagagttggatgcagagttcaaaatatgatgtctaccttggagcctacctgaatagcggacactggaaaatggtcatcattatgcctaaagaaaaccttgtcgtttggttttgttccttgcataacaggccagacaactatcttaaaggaataattaacagtgttttgaaaggacttgatgatactccacaacctaaatccaaggatggtgctaggtggattattgttaagtgttatagacaaaaaggaaccactgagtgcggctattacatcatgcactggatgtccacgataatcttaggaactttcaagaataattgggaaacgtattttaatgatgttagaccattggaagcagagagattgaaggtgcttcgcatccaacgggcatag

SEQ ID NO: 52640 - DNA, 237 bp, Glycine max
  Peptide Sequence Number=SeqID_144325
atggagaattggcgaacagcgctacgcaataacctcgcggggctccagactccgcttggaaatgacattcatggggctccgaaaaaagtggagaattgccgaacagcgctacgcaataacttcgcggggctccagactcgaaggtggaggatgcttgaacagcgccaggcaatgccattcatggggctccgtaaaaaagtggagaatggagaattggcgaacagagctaagcaataa

SEQ ID NO: 52641 - DNA, 711 bp, Glycine max
  Peptide Sequence Number=SeqID_144326
atggcttctccacctgcctcacctcctcctccttgtcctccttctcctcgtccttctgctcctccttcagatgcattagcttcaccgtctgccgtgaagcggacacgcaaagcctcacgtctacgatccttgtataccagaccacctggtgcagacagaccagtggtccacgttgatcctactaccggcaaggctggcggtccccacatgaagaaattaaaaacatatttggggattgtggtgcgtgataaggtggacctcacgtacgagaacaggaaggaggcagaatttgaaatcccaaaggcttctgacaataggacaaaaaagaagttgcttcagactgttgccgatcaggacgatgtggacgacactgtctgtgagaaatacggcataaacaaggaaaaatggacccagttttgccagactcgcagagacccttcttgggaggatgtgcgcaaaaaggcacagaccatccagaaacagaacactaccgcccatgttttgtctcgtgggggttatgaatatttggagcagaagctcctggctgagaagaccaagaagaagctggaggaagctgcacagtcaggaagccttgatggtgtcatcgaccctccatccccggtcagacgccatgtgaagtggaagatggtccgcacgaagaaaacaagggagatgacgactaaggccgcaaaggaaatcactgagaagatc

SEQ ID NO: 52642 - DNA, 195 bp, Glycine max
  Peptide Sequence Number=SeqID_144327
atgaccaagaaaagatcgcacctctcgcacacaagaggggccgaaaggcatcctcctataagcaaaagtgccgaaggggcaggcgttcaagcatctgggtcaatgaatggcaggggaaaatggtcctttttggtaacctgggttcagcctcctatagtcaatgcagactcttccaactgttctgcaaccgagtag

SEQ ID NO: 52643 - DNA, 516 bp, Glycine max
  Peptide Sequence Number=SeqID_144328
accaagagggctcgtagggaagaacacggccggaacaagttccgaggggctctgtggggcagtaacaacgagcttaagcttcggagagaggaaagggaccagtcacgagtagacagtttgatcttaagagatgaattgaaggcttgctcaaggtacaagagaagtttgtcccaacagttatgcgagacagagaccaacatgttagctatcatcaccatgtaccaagaagaactaaatctagccacggcccacaagcatagagtggcggaccagtatgcccaagtgtacacagaaaaggatgctagaggaagggtgatcgactcgctacatcaagaggcaacgatgtggatggaccgattttcccttaccttgaacgggagtcaagagcttccccgattactagccaaggccaaggcaatggcagacaccaactccggccccgaggagatccacggatttcttggctattgtcaacatatgatagatttaatggcccatataattagaaaccgctag

SEQ ID NO: 52644 - DNA, 72 bp, Glycine max
  Peptide Sequence Number=SeqID_144329
atgtccccagtggagtcgccaactgtcgcaacgttgcccttttgcgggcgaccgaaaggcgaaggtcacggg

SEQ ID NO: 52645 - DNA, 336 bp, Glycine max
  Peptide Sequence Number=SeqID_144330
atggggatcgcacatacaaagacacccagtggaccagaagatgtccaacagggccctggggtttccagctctggttacgggcctctgtcggccctacagggcgcccgttccccccagcaaggatcgcgcctgcaagacacccagtggacccgaagaagtccaacagggtcttggagttgtcaagctctaattacgggtctctgtcggttctacggagtacctgtcacctccagcaagggcatcaggccccctactaatcgagctttcatcaagaagtactgcgtccccaggcaggcccagggcaaaacaccacagcaacattgggatggccggtag

SEQ ID NO: 52646 - DNA, 183 bp, Glycine max
  Peptide Sequence Number=SeqID_144331
atggagtggtttttccgcatatctcactcattcatgataccgacccaggaaggtgaccagccgagagatgcaccagctgcagaccctgaggactacatacaaccgcccagcccccaggttcgagtagcatttgacccccctccacatgtggatgattacgagggatatgaggcaattgcatag

SEQ ID NO: 52647 - DNA, 191 bp, Glycine max
  Peptide Sequence Number=SeqID_144332
ggatcgcgcctgcaagacacccagtggacccgaagaagtccaacagggtcttggagttgtcaagctctaattacgggtctctggcatcaggccccctactaatcgagctttcatcaagaagtactgcgtctccaggcaggcgtagggcgaaacaccacagcagcctggggatggtcggtagcgggcaatag

SEQ ID NO: 52648 - DNA, 498 bp, Glycine max
  Peptide Sequence Number=SeqID_144333
atgcccactgggcggaaggaagccatatcttttctctgggttctatccctccacgacaagagttgccaaggtagtgaaaatctcagcacaagagttgaaccaggtaaagcaaaacagaaatggagtagtcggagtaccaaggaagtgtttggagcaatcgacgtttttctcgcctatcataaccacaaggaaagtccggttgtcgctatgccagccgacctatatgacacctttgaccgaagatgtgaagaaagcaatgcaaggattgtttgttgtactccagctctctatgtggggctggtttcacacctttttctccaagaaggtaggcccgtctatccgctacaaggttaccgctcttgcgtcgaacaaggaaaggcgaattgggaccaactcttggctagcatggaggggcgtctgttaatttgttccctcgctagaaggaaggaagaatcaggattctatcttcatgcgacggatgtccaaatgttcccttga

SEQ ID NO: 52649 - DNA, 745 bp, Glycine max
  Peptide Sequence Number=SeqID_144334
atgggtaaagcggcgcgtgaagcgtcgtacaaactggcggagctctccaccgaacaaaaaaatcaggtactgctgaccatcgccgatcggctggaagcggaaagcgccgacattctggcggctaaccagcaggatctggctgatgcgcgcactaacggcatgagtgcggcgctgctcgatcgtctgacgctcaacccgcagcgcctgaaaggcatcgcggatgacgtgcgccaggtgtgccgtctggccgatccggttggccagctgatcgacggagggcggctcgacagcggcctgcgcattgagcgacgtcgcgtgccgctcggcgtaatcggggtgatctacgaagcgcgcccgaacgtcacggtcgatgtggcgtcactgtgtctgaaaaccggcaacgcggcgattctgcgcggcggcaaagagacctggcgcaccaacgccgccacggtgcgggtgatccagaacgcgctcattgagcatggtttaccggcagcagcggtgcaggcgattgagaacccggatcgcgaactggtgaatcagctgctgaagctggatcgctacgttgacatgctgatcccgcgcggcggtgccgggctgcacaagctgtgtcgcgaaaattccaccattccggtgatcaccggcggtatcggcgtatgccatctctatctcgacgaaaccatggagacggacgccgcgctggaggtgatcgtcaacgccaagaagcagcgtcccagcgcct

SEQ ID NO: 52650 - DNA, 129 bp, Glycine max
  Peptide Sequence Number=SeqID_144335
atggtgcaaacgtccttggctggacgggagctgagccagaagagttttcagcgcaggccaaaaaacttgggtggtgttgagcgtactggtgagtactatgcgaggcttgctgaggctttggccaagtgg

SEQ ID NO: 52651 - DNA, 246 bp, Glycine max
  Peptide Sequence Number=SeqID_144336
atgaaaatttatgtgagtggtcgactaggaaaaaaagttgtcatcatcaaaaagggggagattgtagaagcaaagcttcatgatgatgacaaaggagatgaaaaaaagcgcaaagatcaatcaaagaaaaactcaagtgaatcaagaacaattcaagagttcaagataagaatcaagaagaattcaagactcaagaagaaagttaagagtcaagactcaagattcaagaatcaagagaaggcttaa

SEQ ID NO: 52652 - DNA, 333 bp, Glycine max
  Peptide Sequence Number=SeqID_144337
atggtgaaagttggaacctcttacgtgccgatcaacgtctcattttcgccaaaagttggcccagggcttcccggtatcaacagggacaccaggatttatttattatgggaagtgatcttccgtcacagctgtccctcctgttcagctacggacggggtgggcgcgtcccattcgccattcaggctgcgcaactgttgggaagggcgatcggtgcgggcctcttcgctattacgccagctggcgaaagggggatgtgatgcaaggcgattaagttgggtaacgccagggttttcccagtcacgacgttgtaaaacgacggccagtgaattgtaa

SEQ ID NO: 52653 - DNA, 373 bp, Glycine max
  Peptide Sequence Number=SeqID_144338
atggcctccatgtcagcctccatctactcttgtacctcctccgctttacccattactctagctctagcacgggaaagaagtagatccctcgagccatcaagccaagaaaagtatggcagtaacgcgaatgatgctatagtgaagtatggtgcacgaatgttctgtacgcaggacagtccgggattgaagagttcaagatatcaatacctaaacatcagtgttggacgtatgagaagcaatgatgtagacgttgatcctcttgttgcccctagagttgatctgctaggaatgagcaattttgattgccaatacttcaacaacatgtctcatagggatgaaagactcgggaatacgcatgctatgcatggaaaat

SEQ ID NO: 52654 - DNA, 284 bp, Glycine max
  Peptide Sequence Number=SeqID_144339
atggaggacttctgcctcactcccacttgctgcacatctgccactgcttcctctgtgttagagccagtcttcaggactttcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 52655 - DNA, 780 bp, Glycine max
  Peptide Sequence Number=SeqID_144340
atggaactatttagtaagagtttggaaacccttaatgaagctgaccgttatttagagcgtcttccaaaagaatctcctgaaaaacttattgaaacagctagaagctatgctatccggggcatgatttataaaagccagtccaactcggaaattgctctggaaaaattcctgatctctatcgggaattttgaaaaagtaaaaatgaagaaaaccacctttgccaatatgagtgtggtttattacaacataggatattgttatcttaatctgaatgaacaggaaaaagccaggcaggcatttatccgctctatacaatacgcagaaaaactcaatgccaaaagtctcaaagcatttgcccttaaaggcttggcagaaatgtacaagcaaaaccgggaaaatgaaaaagccctgggacttcttatccaggcagaaagcctttctcaaaatacaggagacctaatcctcaatgagggaatctacaaagaaatgtcagaaaactatctggccatgggaaagcctgacctttaccaggtttacaacaaaaagtattttgaaatgcgatttaaaagggaacaaagtgaattaagctccattaatcattccatcaataaccacaacagggaaacacagaagaaagcgaaagaacttagaaataaatacaactatcttagtattgggattattttatccggttcagcaattattgctattctcatttacttcatccatgaccaacaaaaaagcatcccgaaaggaatgcttaataatgtatactatgtg

SEQ ID NO: 52656 - DNA, 587 bp, Glycine max
  Peptide Sequence Number=SeqID_144341
aatgtgaaggcaaagtgcaaatcgctaattggtcagaagaatgcctcggactacgtaatggataattggggtaatctggcagattgtccttcggaacaggagttccttgagcaccttcaaaggcttcaagtagtgtgttctctgtggccaatgttcgttgactacgtatgtgagacatggattgtcccacacaaggagaagtttatcacggcctggacaaataagcacaccgaaattagagcatcattcgaaacaagtacgcatgtcgttggtcatgtttttaagaaaaccttatacaagaggcttctgggaatgaaccacgctaggtcttccttatgcatgcaagctacaaaggggctatgtgaggccgaagtgagcatcaaggaagatatggatagaatatataaaatattcgaggaacttgatgtttgcggtaaagttactttcaagagtaaactccgagaattcacgtttcccgatgagacctttatgtgtcctcctccgccaaaggttaagacgaaaggttccccgaagaaagtaatgaaaggaagcgaaagattgacaaagcgtgatccatcttattggga

SEQ ID NO: 52657 - DNA, 55 bp, Glycine max
  Peptide Sequence Number=SeqID_144342
gagagagaatcaatgttcagtagtacgcctggtgaaccgggttctaccacttcag

SEQ ID NO: 52658 - DNA, 528 bp, Glycine max
  misc_feature (248)..(248): n is a, c, g, or t
  Peptide Sequence Number=SeqID_144343
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggctccgnccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccg

SEQ ID NO: 52659 - DNA, 533 bp, Glycine max
  Peptide Sequence Number=SeqID_144344
atggcgcttactaggcaccctttggacccagataagtccaacaggaccctgggatttcccgcactaatcacaggactctgccagtcgtttggagtccccgtggcacctaccaaggtgattcgcccgcccatcacccgggcttttattgagaagtactgcacccagagacaggctcagggggatgctccacaggccgcgggcgcgccaccaccacctcatcaggctggcccggctgggtcatttgacatggagcagtatttacggcatttggttcgccagcaggcagccaaccaccgggcacatgtgcagacccatgattgtctataccagatgagcctcagcatgcagagccagggcttcgcttctttttcatgccctactctagaccagttcagggcagaggtcgcatggcccagggattggcccgaggcccaagcaggagaggcgcccccggaagttcccggtgatggagaggaggcccacgaggacgaggagatggccgatttgctagactgggagatccccagattcat

SEQ ID NO: 52660 - DNA, 852 bp, Glycine max
  Peptide Sequence Number=SeqID_144345
atgcgcctcgcggcacagctgagccgcacgtttgcccgcaaggtcacgccggggcagattatggtcgcctccacggtcagcaagctcagcgcgctgctggactcgtcgatgagcgacgcgcaggcgcagcgtctggggtatgaaacccttctcccgctgcgtgaaagcgacggcccaacgctgttctgcttccatccggcttccggttttgcgtggcagtttagcgtgctggctcgttatcttagtccgcgctggtccattaccggcattcagtcacctcgcccggacgggccaatgcagcagtgtgcggatctggatgaggtcatcgaacatcacctgaaaaccttgcgcgcacagcagccgcagggaccgtattacctgttcggttattcccttggcggcacgctggcgcagggcattgccgcgcgtctgtgcgcgcagggggaagtcgtcgcgttcctcggcctgctggatacctggccgccggaaacccagaactgggcagagaaagaggcgaacggcctcgacccggcagtgctggcggaaatcgagcgcgagcgacaggcgtttatcgccgctcagcagggacagggctccagcgaactgtttagcgctattgagggcaactacgctgacgcggtgcgcttgctcaccacggcacacagcgcacgcttcgagggtaaagcgacgctgtttgtggccgagcgcacgcgcacgcaggatccgcaggttgcgtgggtgccatgggtaggtgaactggaggtgtacagccaggactgcgcccacgtggatatcatttcaccgcaggcgtttgagaagataggaccggtgttgagggagattttggggtag

SEQ ID NO: 52661 - DNA, 556 bp, Glycine max
  Peptide Sequence Number=SeqID_144346
tctaaaagagttagagcagttgatgggtcagctccagcggcaagcttttcgcaaagcttacggtaaaatctgggacctagccatggtagaagtctctacagaggccattgcctccctcacccagtattatgatcagccgttgaggaagcaagtcaaaaatggggtggtcggaataccaagaaaatatctggaggtaaaagcaagaatcttggcagataaaggcgagtgggtcccgttcatagatattctcgcactgttgattttcgggggagtcctctttccgaacgtggatgggttggtgggcctggcagcgatcgacgcttttctcacctatcataaccacaaggaaagtccggttgtcgctatgctagccgatccatatgacaccttcgaccgaagatgtgaaaagagcaatacaaggattgtttgctgtactccaactctttatgtatggttagtttcgcacctttttcgccaagaagtgaggcatgcttgcccgttagaaagccaccgttcatgcacagagaaaggagggcgaattgggatcaactcttag

SEQ ID NO: 52662 - DNA, 126 bp, Glycine max
  Peptide Sequence Number=SeqID_144347
atgatgagcatgaataagataatggaagccaatgcagttgcagttttcgctaccagcgctgttgctaaggtgaacccgatgcccccatctggccttaaccaaatgaatcatccaaccttagatatg

SEQ ID NO: 52663 - DNA, 579 bp, Glycine max
  Peptide Sequence Number=SeqID_144348
atgacggacgtgtggggtgctaataccttccccatgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtcacgcgtcgccctcccgccgaaggaggagggcgtgcgagatatacgatcctgggtgaggggtcagtggatccggttcgatgcagatgctctcagccagttcctgggataccctttagtgttggaggaaggccaggaatgcgagtatggccagaggaggaaccggtccgatgggttcgatgaggaggccatcgcccagttgctatgtataccggggcaggattttgcccgaactgctgctgggagacgggtgcggatcatgcgcaccaacatgaccaccctgactcagatctggatgactttgctgctcagcaacatccagcccagcgatcataattccgacctccccctgctgaagtgtcagctggtgtacgccatcctgacacggatgagcattcacgtggcttag

SEQ ID NO: 52664 - DNA, 255 bp, Glycine max
  Peptide Sequence Number=SeqID_144349
atggcaagcagagaccaagtttggtcattctgcacccatgatacgcggagataccttatggttatccgcacccctttgctaggcagacacagttgtgtccgatggcaagcagagaccaagtttggtcattctgcacccatgatacgcggagataccttacgagaccaagttggtcattctgcacccatgatacgcggagataccttatggttattcgcacccattcttttgctatctgtaagacagaacgcttga

SEQ ID NO: 52665 - DNA, 440 bp, Glycine max
  Peptide Sequence Number=SeqID_144350
gccacacttcaagaactctgtagcacgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 52666 - DNA, 1056 bp, Glycine max
  Peptide Sequence Number=SeqID_144351
atgggcgcgcgctatggcggcaacctgccgcggctggcgggcgtggcctgcgccattctctgttcgttcacctatctggtggcgcagatctacggcgtgggcatcatcaccacgcgcatgaccggcatctcgttcgaactgggcattttcgtggcgctgggcggcatgctggtctgttcgttcctgggcggcatgcgcgccgtcacctggacccaggtgggacagtacatcatcctggtgatcgcctacctggtgccggtggtgtggctgtcgatcaagcacaccgacatgccggtgccgcagctgtcggccggcgtggtgctgcaggaagtgacggaaaaagaggtctacctgcgcaacgaccccgccgaaatcgaggcgcgccgcctgtggcaggagcgcgccgacgagatggcgcaacgggtccatgacctgcccgagtcctgggcgctggaaaaggacaagctgcgcagtcgcctggcccagctcaacgccagcgatgcgcccatggtcgagatccgctcggtcgaacgcgagctggcggcatttccgccgacggtggaagaggcgcgcatcgcctggtcgcaggccaaggccactttcgaggcccgggccgcgccgccgaccccgcatgcggaaccgttcccgtccagcgatccggacgagcgccgcaacatgcgcatcaatttcctggcgctggtgctgtgcctgatgctgggcaccgcggggatgccgcacatcctgatgcgctcatataccacctcgtcggtggtggaagcgcggcgttcggtgtgctggtcgctgctgttcatcctgttgctgtatttcatggcgccggcgttggcgctgctggtcaagtacgaggtctacacgcaggtggtggggtcgaatttcctcagcctgccgaattgggtgcatgcctggagcgcggtcgacagcaacctgctggacgtcaccgacatcaatcgtgacggcgtgtccagctcagcgaaatcagcatgggcgcggacgtggtgttgctggcgatgcccgagatcggcgggctgccctatgtga

SEQ ID NO: 52667 - DNA, 363 bp, Glycine max
  Peptide Sequence Number=SeqID_144352
atgtgtcttcattcttcatctagtgttaatggtgagggttctactcctaaggaccccttgtataagatattagatgagttgagatcccttaagttgtggaaagaaaaacaagagagaaaagaaaaagagggtgccatagttcacatactaaacatcactcccaatgaaaagaaaaggatagaaggcctcaagaggattcatagggatcctccagtagagtattggaaagatcttaaaagtgcccttaggaagaaacacattccctcctactatgagagggagcttatggacaagctccaaaggcttagacaagggagtatgagtgttgaagaatatagacacaaatgggactactccttttaa

SEQ ID NO: 52668 - DNA, 204 bp, Glycine max
  Peptide Sequence Number=SeqID_144353
atgacgttcctaaatggaaaactccacacaactccggaatttcaaaaacacactattgacaacaatgaaggatcccacggtcatgtggctccgcatgcccccggactcttgggtcacggtaacaaaaagtgtggtggtcgacaaaagcagggcttttgctcctacgtatcctcaatttgtgatgaggaactcagacctacgtag

SEQ ID NO: 52669 - DNA, 504 bp, Glycine max
  Peptide Sequence Number=SeqID_144354
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgattgactggcggcgcgatcaatttcgaagggttgctggtggcgcgtaccgtcgccgtgggcgccgagaccgtgctggcccggatcatccgcatggtcgagcacgcgcaggcggccaaggcgccgatccagcgcatggtcgatcaagcttatcgataccgtcgacctcgagggggggcccggtaccagcttttgttccctttagtgagggttaa

SEQ ID NO: 52670 - DNA, 231 bp, Glycine max
  Peptide Sequence Number=SeqID_144355
atggaaaaacgccagcaacgcggcctttttacggttctggccttttgctggccttttgctcacatgttctttctgcgttatcccctgattctgtggataaccgtattaccgcctttgagtgagctgataccgctcgccgcagccgaacgaccgagcgcagcgagaaacagctatgaccatgattacgaattcgagctcggtacccttatattatccgttaacttcggttaa

SEQ ID NO: 52671 - DNA, 243 bp, Glycine max
  Peptide Sequence Number=SeqID_144356
atggaaaaatctgaaaagaaaaatcatagtgaaaagaaactgaagaaagcatacatcacatgggatgaaaatgatttggaatcctctgaagattctgaaaatgaagagataaatctctgccttatggccaaaatttacgaaagtgatgaagaggtatgtttgagaaagaagtggtacatagatagcggatgctcaaaacatatgactggagatgcatcaaattttacacacatctctccatag

SEQ ID NO: 52672 - DNA, 559 bp, Glycine max
  Peptide Sequence Number=SeqID_144357
cgtgactcaaatgtgagtatgacagatcttgtgatcgcggaagaggacgcttttcgtcttacagacaccaaaaataatgtttatacggataaccactcgggtatttccgctcatcagcgtgactcaaatgtgagtatgacagatcttgtgagcgcggaagatgacaatgtttatacggatgaccactcgggtatttccgcccgtcagcgggacttaaatgtcagtattacagatcttgtgagcgcggaagatgacacagcaaaaaagaatgtttatacggataaccactcgggtatttccgcccgtcagcgtgactcaaatgtcgaggcgcagaagagaacgttagtctctgcgtgctatcaggcttttcgtcttacagacgagcaaaaaagaaagcttatacggataaccactccgggatttccgctcctcagccgtgactcaaatgagacgacgttagtctctgggtgctatcaggctttttgtcttacaacagcaaaaaagaatggttatacgggtgaccactcggggatttccgcccgtcagcgggacttaaatg

SEQ ID NO: 52673 - DNA, 534 bp, Glycine max
  Peptide Sequence Number=SeqID_144358
atggcttctaggaaacgtaaaagtattggttcaagacccacatctcagtatgacacaaggagattctcttccttagatgcttggaccagatacacagataatgttctggggagaaatattttacctgagaggaaggtagagctctatcatactgagcgagatgacttgaaggctgaattggagaggcgtaatttccataaatgcctcaccaatttagtcgatgggagcatagacctggctttgatgaaagaattctatgcaaatttatacagttctaaggatcatccaccaaagcagtctagagtcaaaggtcatttggtgaagattgatgctgacagtctcaacacattcctggagacacctgtggtattagctgagggagagactctacccacatactctagatattgcaggtttcctacagacttcagagagatagaggctgccttatgcatacctggccgagggttcattttgaactctgagggccatcctgggaagattctcaggaaggatttgactacactagctcag

SEQ ID NO: 52674 - DNA, 513 bp, Glycine max
  Peptide Sequence Number=SeqID_144359
atggcgggattgcggacggcggcgccctgcacggggcgcgaggccctgggccgtggggcattttgtaatgccgccggcgcgccggttcctgtctgcgggccgcgcaatggaagagcgccccagctcgcgatgagtctgaggcgctcctgcccggcttcgcacgcgatggctcggtatccgcgaattgtggcgctctgcggcagcctcgacactgtgaccctcattcatcgcgagcggagaacggcagtgtcgggatatttgcagcgtcaggcggggcagggcatgacggaatacatcgtgatcgtggcgctggtggcgattgccgccatcgcggtctatcagcattttggtcaggtcgtgcgggcgcagaccgcggccatggcgcgcgaactcgcgggcgaagacggcagcgcgcaaacccgtgcggcggccgcggcggtcaaaaaggcggcgggccaggtctcaacgcgcacgctcaagtccttcgccggcaatgccgtgggcggcaaatga

SEQ ID NO: 52675 - DNA, 447 bp, Glycine max
  Peptide Sequence Number=SeqID_144360
atgggttctccacctgcctccactactcctcctcctcctcctcctcctcctccttcacctccttctcctcctcctcctcctcctcctacttcgaacgcatcggcttcgacgtctgccgtgaagcggacacgcgaagcctcacgcctacgatcggtgtccactaaaccacctggtgttgagagaccagtggtgcatgttgatcctgctatagggaaggccgacggtccccacaagaagaaattaagaacatatttggggattgtggcacgtgataaggtggacatcacctacgagaactggaaggaggtccctactgctcagaaggacccgatttgggaggatattcagcaaaatttgatatcccagaggcttctgacaggaggacgaaaaggaagttactacagaacgttgggaagagatggaagcagtttaattcagacctcacta

SEQ ID NO: 52676 - DNA, 939 bp, Glycine max
  Peptide Sequence Number=SeqID_144361
atgtcgactcccttgcaaagtgaactgtttcgaagggcggcagaggccagatttgaggaatgcgccggcgtggacgacggtgagccgattccagtcgatgccgttcagttttggacccggcaggcagcggaaggcggcgatcttgaggcgctcgtcatagccggtttgcagttctcagatgaaactgttgacgagtcacttctgtgggatcgggttattgccgaaggaaatggaactgcgctctatctgatggcagatctggcaggttcacctgagtttgccaggcgttttggagggcttgtcgaccaggatgatgcacggttggtgacctccatggtggcgtgtgagctcggcttggactgcggttccggcagtaggttgatgatgtctttatgtgtggacagtcttcaatgcagtgatggcagttatgaagaatgggcgatggatactcaggtagcgtcgtcgcgtcgtggcgagatccgggcgcaggctcgatcgcaatgctgtgtgcgcatgcggcatttggtaaaaccgtcaagatcgccgcgggggattcggcatactccggctgcgctgcgatcaatcaagctaatgtgtccccaagaggcggagcatagaatcaatgcgggctgggcagcttgggggcgctacacaagcttgaatgggatcttcagtctccccaaagggagtctgattgagctcacctacatcgacggctcgaaggaaacgctgctggttagttgcactaacagtcagatgtgtgtgcagcctgtacccggtacacagaagcccgcacccgcaaaaagtggtggcagtggtggcggtggacgtcccgctagcggtggaggaagtggtggtggctatgttggtggcagcggttgcttcgggaactgcactggagttgtgactgtcgggcctttccaacagaacgaacgatag

SEQ ID NO: 52677 - DNA, 222 bp, Glycine max
  Peptide Sequence Number=SeqID_144362
atgacgccgcctgcaacagcggaagcggagcatgcattgccgctggcggcgcaaaagctggcgctgattgactcgctgcaggcgctgctgacttcacccgcgcaacctttagccgcgatggcaccgccgtcgcgagcgcatcatgtttcgcccaacgttcactcttctgctgactggcaggctgctattcatggcatccgcgccggacctttcattgcttaa

SEQ ID NO: 52678 - DNA, 585 bp, Glycine max
  Peptide Sequence Number=SeqID_144363
atggtcgaagagctgattctgtccggtgccgacattgtgaaggtgggaatcggtccgggttcggtctgcaccacgcgcgtcaaaaccggcgttggctacccgcaactctccgcggtgattgagtgtgctgatgcggcgcacggcctcggtgggcagattgtcagtgacggcggttgcgccgtgccgggcgatatcgccaaggcgtttggcggcggggccgatttcgtgatgctcggcggcatgctggcggcgcacgatgagtgcgaaggcactcttgttgaagagcagggcgagcagttcatgctgttctacggcatgagctccgaatccgcgatgaaacgtcatgtgggcggtgtggcgggctaccgcgccgcagaaggtaaaaccgttcgtctgccgctgcgtggaccggtcgcggagacggtgaaagatatcctcggcggactgcgttcggcctgtacttacgtcggcgcagagcgcctgaaagagctgaccaacgcaccacctttattcgtgtggcagaacaggaaaaccgcgtctttaaccgctgatgtgccgcaacgggcgccgcgtgcgcccgtttaa

SEQ ID NO: 52679 - DNA, 447 bp, Glycine max
  Peptide Sequence Number=SeqID_144364
atgtggcgctttttgtctggcagcaataccccagctgctggatacgcgcaaaaccctgcccgggcctgcgcaccgcgctcaagtatgcggtgctgtgcggcggcgggcagaatcatcgcctgggcctgtccgacgcggttcctgattaaagaaaaccacatcattgccagcggttcggtcagtaaagcggtagagaaagccctgtggctgcacccggatgtgccggtcgaggtggaagtggaaagtctcagcgaactgcagctggcgctggcggccggtgccgacatcattatgctggataacttcacgctggcgatgatgcagcaggcggttacgctgacggcgaagcgcgcgctgctggaggtgtccggcaacgtgacggagacgacgctgccgcagattgccgccaccggagtggattatgtctcggtggggcgcgctgactaa

SEQ ID NO: 52680 - DNA, 1281 bp, Glycine max
  Peptide Sequence Number=SeqID_144365
atggaacaacagcatggcgaaacgctgcatcgcggcctgaaaaatcgccatattcagctgattgcgctgggcggtgccgtcggtaccggtctgtttctgggcagcgcatcagtgattaaatcggccggtccggccgtgattctcggctacgccatcgccggttttattgccttcctgatcatgcgccagctcggcgaaatggtggtggaagagccggtggccggcagctttagccacttcgcctataaatactggggcaactttgccggctttgcctccggctggaactactgggtgctgtatgtgctggtggcgatggctgaactcaccgccgtcggcaaatatattcagttctggtggccggaatttcccacctgggccactgcggctatcttctttgtggtgatcaacgccatcaacctgaccaacgttaaagtgttcggtgagatggagttctggttcgcgattatcaaagtggtggcggtcatcggcatgatcctgtttggcggctggctgctgtttagcggcaacggcggcccacaggccagcgtcagcaacctgtggaaccagggcggtttcctgccgcacggcgtcagcgggctggtgatgatgatggcgatcatcatgttctccttcggcggccttgaactggtggggatcaccgccgcagaagccgacaatccacaagagagcatccctaaagccaccaaccaggtgctgtggcgtatcctgattttctacatcggctcactggcggtgctgctgtccctgctgccatggacgcgcgtcaccgaagagaccagcccgtttgtactgatcttccacgaactgggtgatgcgctggtggcaaatgcgctcaacgtggtgatcctgaccgccgcgctgtcggtgtataacagctgcgtttactgtaacagccgcatgctgttcggcctcgcgcagcagggcaacgcgccaaaagcgctgctgaaagtggaccgtcgtggtgtgccggtggcgaccattctggtctcggcggtagccactgcgctgtgcgtgttgattaactatctgatgccgggcgaagccttcggcctgctgatgtcgctggtggtctccgcgctggtcatcaactgggcgatgatcagcctcgcgcacctgaaattccgcaagaaaaaagaccagcagggcgtgacaacccgtttcagggcggtgctgtatccgctgggtaactggatctgcctgctgttcctggcggccattctggtgatcatgctgatgacgccgggcatggcgatttca

SEQ ID NO: 52681 - DNA, 634 bp, Glycine max
  Peptide Sequence Number=SeqID_144366
atggcctacagtaaaattcgccaacccaagctctccgatgcaatcgagcagcagctggaatccctgattatggaagggacgctccagccgggtgaaaaactgcttcccgagcgtgaactggccaaacagtttgatgtctcacgtccatcgctgcgcgaagcgatccagagtctggaagccaaaggcctgctgctgcgccgtcagggtggtggcaccttcgtacagcagaatctctggcaaagcctgagcgacccgctggtcggcctgcttgctgaacatcctgaatcccagtttgacctgctggaaacccgccacgcgctggaaggcgttgcggcctactacgctgcgctgcgcggcaccgatgaagacctgcagcgtattcgcgactgtcacgtcaacatccagcaggcgcaggacagcggcgatttagatgctgaggccgatgcggtcatgaagtatcagatcgctgtcacagaagccgcccataatgtggtgctgctgcacttgctgcgttcgatgggccctatgctggaacagaacgtccgtcagaatttcgaattgctctacgctcgccgcgaaatgctggcgaaagtgagcggtcaccgcgccagtatctttgaggcgattgtggctc

SEQ ID NO: 52682 - DNA, 2184 bp, Glycine max
  Peptide Sequence Number=SeqID_144367
gcttacgtgaaagatgcggtgaaacgcgctgaagcggcaccggctgcggccgcaggcggcggtattccgggcatgctgccatggccgaaagtggacttcagcaagttcggtgaaatcgaagaagtggaactgggtcgtatccagaaaatctcgggcgctaacctgagccgtaactgggtaatgattccgcatgtgacccacttcgacaaaaccgatatcaccgatctggaagcgttccgtaagcagcagaatgcggaagccgagaagcgcaagctggatgtgaagttcaccccggtagtgttcatcatgaaagcggtcgcggcggcactggagcagatgccacgcttcaacagttcgctgtcggaagatggccagaagctgacgctgaaaaagtacatcaacatcggtgtggcggtggatacgccaaacggtctggtggttccggtgttcaaagacgtgaacaagaaaggcatcactgagctgtcgcgtgagctgatggcgacgtcgaagaaagcgcgtgatggcaaactgaccgccagcgatatgcagggcggctgcttcaccatctccagccttggcggcctcggcaccacgcacttcgcgccaattgttaacgcgccggaagtggctatcctcggggtgtctaaatcggcgatggagccggtgtggaacggcaaagagttcactccgcgcctgatgatgccgatttcgctgtcgttcgaccaccgcgtcatcgacggtgcggatgggcatcaagagcctgggaaagggtcgcttttgaccgccggcaatctaacaagaggtcctgcaggttactctgcagccttccgttgcgctgatttaggtctggaaaccgtactggtagagcgctacagcaccctcggcggtgtctgtctgaacgtcggctgtatcccgtcaaaagcgctgctgcacgtggcgaaagtcatcgaagaagctaaggctctggaagagcacggtatcgtgtttggccagccgcagactgacatcaacaaaatccgtacctggaaagagaaagtcatcactcagctgaccggtggtctggctggcatggcaaaaggccgcaaagtgaaagtggtcaacggtctgggtaaattcaccggtgctaacacgctggtagtggaaggagagggcggcgcaaccaccatcaacttcgataacgccattattgctgctggctcgcgtcctatcgaactgcctttcattccacataacgatccgcgcgtgtgggactctaccgatgcgctggagctgaaagaagttccgaagcgtctgctggttatgggcggcggcatcatcggtctggagatgggtaccgtctaccatgcgctgggttcagagatcgacgtggtcgagatgtttgaccaggtgatcccggccgccgataaagacgtggtgaaagtgttcaccaagcgtatcagcaagaaattcaacctgatgctggaaaccaaagtcaccgcggtagaagcgaaagacgacggtatctacgtatcaatggaaggtaaaaaagcgccggctgaaccacagcgttacgacgcagtgctggtggcgattggccgtgtaccgaacggtaaaggtctggatgctggcaaagcaggcgtggaagtggacgatcgcggctttatccgcgtcgacaaacagatgcgcaccaacgtgccacacatctatgctatcggtgacatcgtcggtcagccaatgctggcgcacaaaggcgtgcacgaaggtcacgtggcggcagaagtgatttccggtctgaagcactacttcgacccgaaagtgatcccttctatcgcttacaccgagccagaagtggcctgggtgggtctgaccgagaaagaagccaaagagaaaggcatcagctacgaagtgtccaccttcccgtgggcggcatcgggccgtgctatcgcgtctgactgtgcagacggtatgaccaaactgatcttcgacaaagagacgcaccgtgttattggtggcgcgattgtcggtaccaacggcggcgagctgctgggtgaaatcggtctggctatcgagatgggttgtgatgccgaagatatcgcgctgaccatccacgcgcacccaaccctgcacgaatcggttggcctggcggcggaagtgtttgaaggtagcattactgacctgccaaatccgaaagcgaaaaagaaataa

SEQ ID NO: 52683 - DNA, 213 bp, Glycine max
  Peptide Sequence Number=SeqID_144368
atggaatatgaatttctgcgtgacgtgaccggtcaggtccgggtgcgcatgtcgatggaccacgaagcggtggggcactggttcaatgaagaggtgaaagagaactttgcgctgctggatgaagtcgaagccgcggtgcgtgcagtcaaaggcacgcagcagcagtggcagcgcgtcgggcacgaatatacgctgtggctggatgaggaagag

SEQ ID NO: 52684 - DNA, 927 bp, Glycine max
  Peptide Sequence Number=SeqID_144369
atgggcggcgggcagatccattcactcaatatgctgcttggttcggcacaggccgcgcattctctgggggtgaagattttcgaatcctcaccggtagtagaggtgaattacggcaaacaggtgcaggtgcgcaccgcgatgggcagcgttaaagccgcaaaactgctgtgggcctgcgacagcttcctcaacaatatggagccggagatctacaacaaaacgctggtcacctactcttatcaggtatcaaccgagccgctctccgatgaactgatcgagcgcatcagcccgctgcgcggcgccttcagcgatattcgcccggtgattaactactaccgcgtcacccgcgaaaaccgcctgctgtttggtagcgccacccgtttcctggagtatacgccgaacgatttcgccgcctggaatcgtacgctgctggcggaggtcttcccgtatctcaaagatgtgaagatcgatttcgcctggggcgggccgatggcctgtagcgccaacctgttcccgcagattggcaccttacgcgaccataacaacgtcttttacgtccaggggtactccggcttcggcgtcaccccctcgcacatcgtgtgcaaaatcctcgccgaagggatcaatggcggttccgaccgctatcgtctgctaagcagcattccccacgcgaccatccacggccgtgacagcctacgtctgttattagtcaccgccggaaaactgatgcatcaaaccgccgccgatcggcagcgtcagcctgctcggcgcgacgccgaccgtcggcgacccgcaggtagcgggcgcgatgatctacggcgagccgcaggacgcctttacctgcggactgttttcgtccaccgaagggagctttaccatgacctatccgtttaccgaacacgccaccgtgctggagggcgaagttga

SEQ ID NO: 52685 - DNA, 132 bp, Glycine max
  Peptide Sequence Number=SeqID_144370
ggtgaagtaaaggaggtctcctccaccactacatacactaaaggagggatttatgaggaatggtttcagccggtgtccattgaccttgaagctctatctatggattcacttttgatttcaactgtaccataa

SEQ ID NO: 52686 - DNA, 777 bp, Glycine max
  Peptide Sequence Number=SeqID_144371
atgattggtacctcaaagccttacactggggcaatgaggggcaccgtgcatgagcctcaagcgaacctaggggaaaatcaaaataccctcaccttcagagcgctacacgccgccctcgccatcagaggactacacgtccttgcctttagagggctacacgccctcaccttcagaggactacccgtcctcgtcttcagaaggctacacgccctcgccatcagaaggctgcacgccttcgccttcagaggactacacgtcctcgcctttagaggactgcacgtcctcgccttcaaagggctacatgccctagcctttagagggctgcatcccttagccttcataggactacacgtcctccccttcagagggctacacgccttcgccttcagaggaatacacgtcctctccttcagagggctacacgccctcgccttcagaggactacacgtcctcaccttcagaggtctacacgccctcaccttcacaggactacccgtcctcgtcttcagaaggctacacactctcgccataagagggctgcacgccttcgcctttagaggactacacgtcctcgcctttagaggactgcacgtcctcgccttcaaagggctacatgccccagcctttagagggctgcatcccctagccttcagaggactacacgtcctccccttcagagggctacacgccttcgccttcagaggaatacacgtccttgccttcagagggctacacgccctcgccttcagaggactacacgtcttcgccttcagatga

SEQ ID NO: 52687 - DNA, 471 bp, Glycine max
  Peptide Sequence Number=SeqID_144372
atgccctcgccttcagaggattgcacgcctccttgggtactagttaccctcataggactacacgccctcgccatcagaggactgcatgtcctcaccttcagtagggctgcacgccctcacctttccagaggaccacacgtcctcgccttcagagaaggctacacgccctcgggtactagttacccactcagaggactgcatgtcctcgccttcgtagaggctacacgccctcagaggactgacatgtcctcaccttcagagggctacacgccctcaccatcagaggactgcataagtccccgccttgaagggctacacgccctcacctttagaggactacatgtcctcgtcaacagagagctgtacccctcaccttcagaggactacacgtcctcgcctcaaagagagcatgcacgcccttcaccttcgagaggactacacgtcctcgcccaaaggcatcttcctttgtag

SEQ ID NO: 52688 - DNA, 522 bp, Glycine max
  Peptide Sequence Number=SeqID_144373
atgagtcatcattcatctagtgttaatgatgaggatactagtcataaggatcctttatctagaatcttaaatgagttgagttccctcaagttatggaaagaaaaactagaaagaaaagaaaaagtaaaaaagagggaagaaataaatcaagatgagagggaacaaataagggaagaaaaaagaaggaaaataataaaagagttaagaaaagaaaaacatgcctcatgtagtagtcatgactcttgtaagagcctaagtgaagaacttcatgactattatgaaggaaggcataggtcacgtcttagacctcacttccatatgagagaaaaggaacgaaagcctcaagaggctaaaattaacctcccatacttccatgggaagtacaatgtagaggcttacctagattgggaaatgaaggttgaacaactctttgcttgccatcatattagtgaagagagaaaagttccattggctgcacttagctttcaagggagcgaaggattcatggggatcctccaatag

SEQ ID NO: 52689 - DNA, 315 bp, Glycine max
  Peptide Sequence Number=SeqID_144374
atggtgaaagttggaacctcttacgtgccgatcaacgtctcattttcgctcaaaagttggcccagggctgtcccggtatcaacagggacaccggattatttcttctgccgaagtgtatcagaatcaaaccatcaagcttattcgcaatacgtgcgcctcgaggggtgctccagtggcgtatctgtttctatcagctgtccctcctgttcagctactgacggggtggtgcgtcacaattccacaaagcataccgccggacatcagcgggcaagtgtagccgggtgcacagctgagctaactcacaccgccgcttaa

SEQ ID NO: 52690 - DNA, 90 bp, Glycine max
  Peptide Sequence Number=SeqID_144375
atggcatcacgttccattcatatgcccgaaagggttccagatgttgttgacatacaaaagccgcacaagattccatgggctcttttttga

SEQ ID NO: 52691 - DNA, 305 bp, Glycine max
  Peptide Sequence Number=SeqID_144376
atggctactcacaccgttcgtcaaccatgggcaaacgagcccattgacgcacagagactaacatcgtcttctgcaccttttgtcgtcctaacccgtgaagtcaggggcaaacaagcccgttggcgcgcagagattaacatagtcctcgacacctttttccgtcttgacccactaacatcgtctgctgcacctttggtcgtcctgacccgtgaagtcaagggcaaacgagcccgttggcgcgcggagactaacatcatcttctacaccatttgtcgtctgacccgtgaagtcaaggtgacatgcgg

SEQ ID NO: 52692 - DNA, 251 bp, Glycine max
  Peptide Sequence Number=SeqID_144377
gcccacttgggccctccagaatattcctccagaaggctgttgcttctggaggaagcaacctggctcgcctgggcgagctgggcggcaagcacctcccctattttgctataaataggggaggaagtgaagaagaaaaggccgaggcgcttccgaaacgtttccgtaacgttttccgtgaagaatttcgcaaaggtttcgaccgttcttcgacgttcttcattcgttcttcatcgttcttcgatcttcaacag

SEQ ID NO: 52693 - DNA, 456 bp, Glycine max
  Peptide Sequence Number=SeqID_144378
atggctgctgtatccccaatgaagaaccaactcatgaagtcaactatatggggaaccagccaagacaaaatttcaatgcagatggatattccgaatttcagcatggccagccatataattcacaacaaagacaatggaaaaatcaccctggtatctatgtcaaaccataagagcacagagtcaaccattaagaatctggaagtccaagtgggacagctggcaaaacaattggcggataggttgtcaagcagctttactgcaaacactgagaagaatccaaaggaagaatgtaaagctttaatgataaggaggaaaatgacaattcaggccgatgaaggaaaagctgagaagaaggcagagggatataaacaacagtcggcagttgagccggcactggaaccagtgtctgactttgttgaacttgaggaagttgtggaagatgaagatgaccaatag

SEQ ID NO: 52694 - DNA, 543 bp, Glycine max
  Peptide Sequence Number=SeqID_144379
atgacagcagagaccaagtttggtcattctgcacccttgtatcatccagaggcagcgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaaaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatgatgcgcggagataccttacggttatccgcacccttttgtcatccagaggcggcgggcccgatgacaagcagagaccaagtttggtcattctgcacccttgtatcatccagaggcggcgggcccgatga

SEQ ID NO: 52695 - DNA, 453 bp, Glycine max
  Peptide Sequence Number=SeqID_144380
atgggtgcagtagaggaggtgcaagagcagatgaaggctgacacaaaggccttgaaagagcaaatggccacaatgatggaggccatgatgagcataaaggagataatggaggtcaatgcggttgcaatagctgctaccagcaccattgttgaggtggacctgacccccccatatggcctcaaccaaataaatcatccgacctcagatatggtaggtctggaaggcaaagagttgggaggtgtgggcagccctcgtttagtgcgaaaaacaagcatgccttcccaccatatggcttacctcccaactatacaccacccaatgtggcgtacactcccaatgagaatgtcaataactccacccctatactcattgagagccaacaacctcaatctgatcatgcacatgtcgctcgacccattggggagacacatgaaacgccccaccacaatctag

SEQ ID NO: 52696 - DNA, 231 bp, Glycine max
  Peptide Sequence Number=SeqID_144381
atgggtatcaccttccttcctttttgccccagttgctccgatccttctagcgttggtacttgtggaggagacgtaatcgaacttccctctcttcaaacctacttatgctgccagttgagtctgattgggagctgtcgcaacctacccttcggcgggagggcgacgcgagactcgcgggatgcgtgttccacgaaaggaatacgcgcggagtcgccaccaacgtttatttga

SEQ ID NO: 52697 - DNA, 255 bp, Glycine max
  Peptide Sequence Number=SeqID_144382
atggagaagggattgaaacctccacttgtactatcttcatgcgattcctttttctccctccatgaacattatctcacaaatcccaacgttaacgaaaccgggatgataattttactgagaccatttggggtttctgcgggaaaggaaaaagctacaatgcgaaaggttagatggcctgcgggaaaaagagaggattttgggagaagagagaagaaacgaaattgtgaggcacaggaggctgaggagtcagtctga

SEQ ID NO: 52698 - DNA, 453 bp, Glycine max
  Peptide Sequence Number=SeqID_144383
atgactgtggaagacaatattaaggtagctctccctgagatcaatagtgctaaagagtttatggggttagtgggagagctctctcaaatagctaataagtctcttgctgggacattaatgagtacacttaccaccatgaagtttgatggctcatgtactatgcatgaacatgttgttgatatgacaaacattgaaacaagacataagaccttgagaatgactgtgaatgagaacttccttgaaatcactgtccattatgtaagccaccaagggaatcaaggagctggaaagaaatttgtgaagaagcatggtaaaggccaaggaccaatagagattaatgacggctctgtgcaaatccagaagaaggcatcaaagggaaataattgtcatttttgtgggaaatctggacacttccacaaggattgcccaaagtgtaagtcttggttcgaatag

SEQ ID NO: 52699 - DNA, 234 bp, Glycine max
  Peptide Sequence Number=SeqID_144384
atgtcgtcgtggcatagggatcgtgcccgcaaaacactctgtggacccggagaagtccaacagggtcttggagttgccagctctaaatacgggtctctgtcagttatagggagtgcctgtcgcccccagcaaggtcatcagcccccccctactaatcgagctttcatcaagaagtactgcgtctccaggcaggcgcagggcgaaacaccacatcagcattgggatggccggtag

SEQ ID NO: 52700 - DNA, 459 bp, Glycine max
  Peptide Sequence Number=SeqID_144385
atgaccatgattacgccaagctcgaaattaaccctcactaaagggaacaaaagctggtaccgggccccccctagaggtggacgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaataacgaagaggcccgcaccgatcgcccttcccaacagttgcgcaacctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 52701 - DNA, 432 bp, Glycine max
  Peptide Sequence Number=SeqID_144386
atggaagcgcagttgatccatgatcgtgttgtaatggagtgcctagagggtgtttgggagaccctcgaaggcaatcagaggtgccgattccgtggcacaattcgactcactgctacttcattagtacatccggaggaacccgcacgcacacttcagcagcctgtggagtggatattacctacacctactccatatcgactagtggagccagttcaagtgatagaggtgtcatcctctgaagaggatcttgaagaagacctagaggagttgcctcctgaacctgatatggacgcccttgacttacctgaggatgatgaagacccactccatgatgttgattgcccagaggatattatgtcagcatctgaggcagactctacagaggagagtggccctggagggacagcgaatagtgacgactcttcatcgtag

SEQ ID NO: 52702 - DNA, 598 bp, Glycine max
  Peptide Sequence Number=SeqID_144387
tgatatcctgtactaccctttgtgtcccgagggacgagaggctaggttagccgaaagatggtatcggttcaaggacgcaagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggacgcgtgcaaaggtttcctcgggccagactgagattggccctcgagtgccaaggccgacgggagcttgactgcaagacccacccgtcgagcatggactaa

SEQ ID NO: 52703 - DNA, 282 bp, Glycine max
  Peptide Sequence Number=SeqID_144388
atgagttcagtggacaggacgatcgatgtgaggcataggccaattgatggaggggaaatttcattctcctttcttcatgagaaaaggcaccacccagacaggacggaagctatagtcataacatcgccgaaaacaaccatcgactggcaagatactgcccgggagcagaaagagtcagggggtgaagcctacgctagcatgcctaccgcccccactctctactattggtggctaataggccccttcgcgtatcctgtcttttggttggccagtaaggagtag

SEQ ID NO: 52704 - DNA, 474 bp, Glycine max
  Peptide Sequence Number=SeqID_144389
atgcagtcccagcttcagtcacagatgcaatcacagggacttgcactgcctccagagcctgaggttggtccctcaactgctcgtgtcagcacaaaggatagttgtgttgatccctcagggaacgatccagacacaggtgactcagacaaatgtgggttgtacatcaaagaaaatcctccctgcctagttgccctaggaagagtttatgagggatccataatcgttcacaacatacctttgctgcatgatcaagtgaaggtcgatgttgaggaggttaaagatgcagatgctcccgttcctgtacccactgacaagggagttgtgggaccaacaaaacctgcagataggccggatcatgaggtcgatgatcccctatacctgatgacattgaccatcccacaactttttttgaagccgttgcaggttatgtggtatgctatcgtgttcggggtgtttaatcaagacttcccctag

SEQ ID NO: 52705 - DNA, 920 bp, Glycine max
  Peptide Sequence Number=SeqID_144390
aggactacacgtcctcaccttcagagggctgcacgccctcgccttcatagggctacacgccctcaccttccgaggactacacatcctcaccttcagaaggctacatgccctcgccttcatagggctacacaccctcgccttcagaggactacacgtcctccccttcagaggactacacatcctcgccattagagggctacacgtcctcgcctttagaggtctacacgtcctcgccttcagaggactacacgccctcgaattcagaggactacacgtcctcaccttcagagagctacacgccctcgccttcaagggactacacgtcttcgccttcagaggactacacgtcctccccttcagagggctacatgtcatcaccttgatacggctacacaccctcaccttcagagtactacacgtcctccccttcataggactacatgcccttgccatcagagggctacacgtcctcgccttcagagggttacacgtcctcaccttcagaggactacacgtcctcgcctttagagggctgcatgccctctcccttatagggctgcacgccctcgccttcataggactccatatctgctccttcagagaactcaagagggaggctatcctgttgctactatgcataccggggcaagatttcacccagtcgctgcaaggagatgagtatggatcatgcataccaccacaatgtcgatctccccctgcggaagtatcagttggtctgtgccgtcatgacatagggccttggggtttccagctctggttatgggcctttgtcagtcctaccggggatcacgcccgcaagacacccagtggacctggagaagtccaacagggtcctggggtttccaactcagattacgggcctttgtcagttctacggagtgtccgtcgctcccaacaag

SEQ ID NO: 52706 - DNA, 67 bp, Glycine max
  Peptide Sequence Number=SeqID_144391
atggtcatccgcaccctttttgctatcaagagacaatcaagtccaatggcacgtggagacaaacaag

SEQ ID NO: 52707 - DNA, 345 bp, Glycine max
  Peptide Sequence Number=SeqID_144392
atgctgacatctccggaaagggcgcagatgaccatattggtctctgctagtcaatcacacttggggtcactgaatgacgaggtgcggataaccgtaaggtgtctccgcaggctactagctcttgagtcatggcaacaaaaggcggtatggtcgactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggctcgggagttgtatttacgcgcggggaaggtattag

SEQ ID NO: 52708 - DNA, 258 bp, Glycine max
  Peptide Sequence Number=SeqID_144393
atggtgatgcaatcctaccccgcatgggcattgggtagaagactccaagtagattgggctagagatccaagggaaggccctagggttctcatgagccttagggtagatttcgagcccatgggctatgatgcaagctccattggagcttgtaggcctaggatattcttcatcaatggattcctttgcttcttggaagatgaatggcagcggaatggagaaggaagagagggaggagacgccacttcaaggagaagatga

SEQ ID NO: 52709 - DNA, 408 bp, Glycine max
  Peptide Sequence Number=SeqID_144394
atgggtgaagtagaggaggtacaagagaagatgaaggccgacatggaggccatgaaagagcaaatggccatgatgatggaggccatgatgatcatgaagaggataatggaagccagtgcagttgcagttgccgttaccaacactgttgctaaggtgaatccgatgccccaatctggcctcaaccaaatgaatcatccaacctcagctatagtaggcaaagatttgggaagtatgggcggcccccatgatgtgcaaattcaaaacgagcacgccttcccgccatgtggcttgcctctcaactatacgccacccaatagggcgtacactcccaataagaatgtcaataactccactcctatacccattgagagccagcaaccccaagctgatcatgcacatgtctcttaa

SEQ ID NO: 52710 - DNA, 357 bp, Glycine max
  Peptide Sequence Number=SeqID_144395
atgtcttccttcctttctggctctgccataggcatcagtaacccctggtggaccgagagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 52711 - DNA, 441 bp, Glycine max
  Peptide Sequence Number=SeqID_144396
atggcacctaccaggcaccctctggacccggataagcccaacagggccctgggatttcccgccttgatcacaggactctgccagtcgttcggcgtccccgtcatacctagcaaggtgattcagccgcccatcacccgagcttttattgagaagtattgcacgcagagacaggcgaccaaccaccgggcacatgtacagacccacgattgtctttaccagatgagcctcagcctgcagagccagggttttacttcttttccgtgccctactccggaccagttcagggcagaggtcgcatggcttggagattggcctgaggcccgggcaggagaggcaccagcggaggcaccagcagaggctcccgacgaggcagatgaggcccgcgaggacgaggagatgaccgatttactggatttcttaggagggagcggggccacataa

SEQ ID NO: 52712 - DNA, 683 bp, Glycine max
  Peptide Sequence Number=SeqID_144397
ttcctgggccaccccctgatattggaggagggccaactgtgcaagcacaaccagagagggaggctatcacgcagctactatgcataccagggcaagatttcacctgtgccgctgcaaagagacaagtgtggttcgtgcacaccaacatgaccaatcttacacggatatggatgacattgttatttagcatccttttgcccagcgaccacaatgccgatctccccttgcagaagtatcagttggggtcacgcccacaagacacctgtggacccggagaagtccaacagggccctggggtttccagctctggttacgggcctctatcagtcctacagggtgcccgtaccccccggcaaggtcatgccatcatgacagggatcgcgcccgcaggacacccaatggacccaaagaagtccaacagggtcctggggtttccagctctgattacgggcctctgtcagttctacagagtgcccgtcatccccagcaaggtcatcaggcctcctactaacagagctttcatcaagaagtattgtggccccgtgcaggcagaggacgagacaccacaacagcctggggaaggccagcaacaggcaacaaatgctccgccgccacctccagagcccctcagctcatccacaaaaaggttagagtattgcctacgacacatggccgaccaatag

SEQ ID NO: 52713 - DNA, 374 bp, Glycine max
  Peptide Sequence Number=SeqID_144398
gcattggaagttgtgagcaatgcttgcgtggagtctcccacggtaagccacgctcatctggtgccgcgttgatggtagctcgggtgatgttgaggcatggatatgagcccgaaatgggtttgggccggaataggaatggtgtggcaagtctagtagagtttgcggagaaccgcgggagggtggatgtgcaagggaaaggtttccgtaatacacgaagaaaccactcaagagcaaccaaatccaacaatgagtcctatgatagtagtgataccgaggacctgaacattgattttgagcaattgataagtcaagccaaagaaggggaagatgaggattgggggtttcccccagagttgagaagaatggtcaaatag

SEQ ID NO: 52714 - DNA, 494 bp, Glycine max
  Peptide Sequence Number=SeqID_144399
gccgtaaaatccagctgaacggtgtggttataggtacattgagcaagagactgaaatgcctcaaaatgttctttacgatgccattgggatatatcaacggtgttggaacctcttacgtgccgatcaacgtctcattttcgccaaaagttggcccagggattcccggtatcaacagggacaccaggatttatttattctgcgaagtgatcgtccgtcacaggtatttattcggcgcaagtgcgtcgggtgatgctgccaacttaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgagaaaaaaggctgcaccggtgcgtcagcagaatatgtgatacaggatatattccgcttcctcgctcactga

SEQ ID NO: 52715 - DNA, 765 bp, Glycine max
  Peptide Sequence Number=SeqID_144400
gaaggaagaatcaggattctatcttcatgcgaaggatgtcccatgagaggagtgccatcagacgaaagcatcacgcctttcatcgcacgaggtttcagtgaccacaacgcgagggtactccaaggagttcgcaaggcatgggatgcagcctatcataagtggctgagagtccgaacacaaggactggattggctcccaaatctaaagactgtgagagacgatgaggttaaagcttcggaagaaagtgatgaggtacaagccctaaaggcagagcttgaaagagcctgggtagtcgaagagaagttcaaggcagcaatagtgagctcaagctccgaagaggtgaaaggaatcatcacgggtcaaagcatgatcttgaaggacgagctaaaggtttgccttaggtcgaaaagaaatttgtcccaacagttaagcgagactgaagggaatatgtgggccatcatcgataagtgcaaagagaagctaaatctagcggcgactcacgagcaaaggctagaggatgagtacgccaagatatcagcagaaagagaagcaagggaaagggtaattgattcattgcaccaagaggcaacaatgtggacggaccgatttgctcttactttgaacaggagtcaagaacttcccccattgctagccaaggccaaagcagtggcggacacctactccgcccccgaggagatccatggacttctcagctattttcagcatatgatagacttaatggaccatatgattagaaaccgctag

SEQ ID NO: 52716 - DNA, 420 bp, Glycine max
  Peptide Sequence Number=SeqID_144401
atgccctcacctttagaggactacacgtcctcgcctttagaggactacacgtcctcgccttcagaggactacacaggactcctcgtcctcgccttcagagggctacacgccctcaccttcagaggactacacgtcctcgcctttagagggctgcaccccctctccttcagaggactacaggtcctcgtcttcagagggctgcacgcccacgccttcagagtactacacgtccttgccttcataggactacacgtcctcaccttcagaggacttcacgtcgtcgccgtcagtgggatacacgccctcgtctttagaggactacacattctcgccttcagagggctagacgccctcgcctttagaggactacacgtcctccccatccgaggactacacgtcctccccttcagaggactacat

SEQ ID NO: 52717 - DNA, 584 bp, Glycine max
  Peptide Sequence Number=SeqID_144402
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgctcaatttcgcttgcaagaaggttaagatgcttcttcaatattgccaccagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 52718 - DNA, 552 bp, Glycine max
  Peptide Sequence Number=SeqID_144403
atgggtgaagcagaggaggtgcaagagaagatgaaggctgacatggaggccatgaaagagcaaatggccacaatgatggaggccataatgagcatgaagaagataatggaagccaatgaggttatagttgccgctactagcgctgtcgctaaggtgaacccgatgctcccatctggcctcaagcaaatgaatcatccaacctcaaatatggtaggcaaagatttgggaagtacggatgaccccatgatgtgcaaattcaaaacaagcacgccttcccgccctatggcttgcctcccaaactatacaccacccaatgtggcgtacattcccaatggggatgtcaataactccactcccatactcattaagagccaacaacctcaatctgatcatgcacatgtctctcgacccatggaggagacacatgaaattccccaccacaatctagctgacttcgagccttggctcggatatgccactgaagggcaagcagttggtggtatacccatgccaaacactttggagagccctcagtttcgcccacaaccataa

SEQ ID NO: 52719 - DNA, 249 bp, Glycine max
  Peptide Sequence Number=SeqID_144404
atggaaagtgtagacgatgcgataaaagaagcctcggacgggaacatatatttcagtgttcttactaccaaatttgatatgcaaaattggtatttggatgtgctagaggcaaggtctcatggacaagttttcaagtacaatcccacatcaaatgagactgttattttcctcgataatgttgcctttgccaatggggttgcactctccaaggacgaagattatcttgtggtatgtgaaacttggaagtaa

SEQ ID NO: 52720 - DNA, 210 bp, Glycine max
  Peptide Sequence Number=SeqID_144405
atggctggggaagagagtaaaggtaggcacacacgacagcgtggatgtccatgggtcatagtaatgcatgtggcggtgggtggtgattgggtggcactgagtggttgcggtggtggtgtttgggtggaagtggggtgctgtgaccatggaggtttggggagaggtggtcatggatgtttgcttggtagaaaatcaagaggggatttttag

SEQ ID NO: 52721 - DNA, 192 bp, Glycine max
  Peptide Sequence Number=SeqID_144406
atgctgatcatagcctacttctcaaaaagcgcacaaaaatggcataaaacactcgacttcgtaaaaatagctatagagcttcttcatcagcaaggcaaacacgaatgctactgggtttcaactgtggactcccgcatacttgtgtcattccatgagcctggcttgttgccaatgcctatttttttcttgtaa

SEQ ID NO: 52722 - DNA, 1845 bp, Glycine max
  Peptide Sequence Number=SeqID_144407
atggctgacgaaccactatatccaatagcagtgcttatagatgagttgaaaaatgatgacatccagctgcggttaaactcaattcgcaggctatcaacaattgcgcgtgctcttggggaggagcgaacccgtcgagaattaattccatttttgagtgaaaataatgacgatgatgatgaagtacttcttgcaatggcagaagagttgggagtgttcattccttatgttgggggagtggaacatgctagtgtgttgctgccaccgctggagacactttgcactgttgaggaaacctgtgtgagagataaagctgcggagtcactttgtagaattggatctcaaatgagggagagtgatttggttgaatattacatcccgttggtgaagagattggcagcaggtgaatggtttactgctcgagtctctgcatgtggactatttcatattgcataccctagcgcaccagaaacatcaaagacagagttgagatcaatatacagtcagttatgtcaggatgacatgcctatggttagaaggtcggctgcatcaaatcttgggaaatttgctgcaactgttgaatatgctcatttgaaggctgatctcatgtcaatttttgatgatcttactcaagatgatcaagattctgtcagattgttggctgtggagggctgtgctgctcttggcaagctgttggagccacaagattgtgttgcacatatactcccggttattgttaacttctcccaggataagtcttggcgcgtgcgttacatggttgcaaatcaattgtatgagctttgtgaagctgtaggccctgaacctaccagaacggaattggtacctgcttatgtgcggttgcttcgagataatgaggctgaagtgcgcatagcagctgctggaaaagtgaccaagttttgccggattttaaatccagatctttcaattcagcatattctttcttgtgtgaaggaattgtcatcagattcttctcagcatgtccggtctgctttggcttcagtaataatgggaatggctccagtgttgggaaagggttctgttcaaagtatggggacctatttgagaggtttcaaacaatttaggaatcaggaagcaacaattgagcagcttcttcctattttcctttcccttttgaaggatgaatttcccgacgtgcgcctaaacattatcagcaagcttgatcaagtgaatcaggttataggaattgatctgttatctcagtctttgttaccagccattgttgagcttgctgaggataggcattggagggtccggcttgcaattatagaatatatacccttattggcaagtcaattgggggttagttttttcgatgacaagcttggtgctctttgcatgcagtggttacaggataaggttcattcaattcgtgaagcagctgctaacaacttgaaacgccttgctgaagaatttggtcctgagtgggctatgcagcacataattcctcaggttttggagatgaacaacaacccacactatttgtatcggatgactattcttcgtgctatctctctgcttgctcctgtgatgggccctgaaatcacttgttcaaacttgttaccagttgttgttgctgcatcaaaagacagagtgcccaacataaagttcaatgtggcaaaggtattagagtccatcttccccatcgttgatcagtctactcttactgtgaacatcattgtcattcaggtggtggagaagactattcgtccatgtctggttgagctcagtgaggatcccgatgttgacgtgcgatttttctccaaccaagcactgcaggcaattgatcatgtcatgatgtctagctag

SEQ ID NO: 52723 - DNA, 1797 bp, Glycine max
  Peptide Sequence Number=SeqID_144408
atggtagttggaggttcgaataccggtgttcatggatggcgagacatcaagagtctcaccgtccaagtcatcaccgggagatggttcgtggtgttcgcctcctttctaatcatggccgccgctggagccacctacatgttcggtctctattccagcgacatcaaaacaaccctcggttacgaccaaaccactctcaatctcctcagtttcttcaaggacttgggcaccaacgttggggtcatctcaggcctaatcaacgaggtcgctccaccttgggttgtcctcgccattggtgccatcctcaacttctttggctacttcatgatttggctttccgtcacccaaaaaatagccaaacccaaagtgtggcagatgtgtctctacatctgcataggcgctaactctcagaccttcgccaacactggttcccttgtcacttgtatcaagaactttccagaaagaaacggggtcgtgttaggtatcctcaaaggttacctcggtcttagtggtgcaatcatcacacaactctactctgccatatactatgatgacacaagggctttgattttgctcatagcttggctccccgctgctatttccttcgcttcccttcgaaccattcgctacatgaagcctgttaggcagcctaatgagctcaatgttttctacaagtttctgtatatttctcttggccttgctgggtttcttttggtcatgatcactgtacagaaaagggtcaacttcactcagagtgagtttggtgtcagctctgctatggtgctctttctgctcctcctcccacttgctgttgtttctatggaggaatataaggtctggcagagtaaaaggctcgctttggttgacccctccccggtgaaaatagtaaccgatcagggtgaaaaggtgaaacccaatgagactactgatggtagcagcaattcactttcttccaatgataccaggtggtgggaaaatgtttttagtccaccagcaagaggtgaggactatacaatacttcaggcgctattcagcatcgacatgtggatactattcatatgtagcatatttggtattggtggcacgttgaccgcaatagataaccttggtcagataggaaagtcgcttagatacccaaagaaaagcataagcactttcgtgtccctagtaagcatttggaattatctaggaagggttttcgctggatttgtttctgaacattatctacaaaagtacaagttccctcgtcctctcatgcttacactaaccatgctcttgtcatgtgctggtcaccttctgattgcatttgacgtgccaaatggtctttatgcggcttcggtgattattgggttttgttttggcgcacagtggcctttactttttgccattatatccgagctttttggacataaatattatgcaactttgtataactttggaagtgcagcaagtccactagggctatatgtgcttaatgtggtgatgactgggcatttgtatgacaaagaagccaagaagcaacttgcggaattggggcttgagagaaaggaaggacaggaattgaactgcattgggatccattgcttcaagttatccttcattattatcacagctgctactttctttggtgttattgtttcactcatcttggtagctaggacaagaaccttttacaaaagtgacatatacaagagataccgggatgctgcagccacggtgacagaagctgaaatggcgaaggtggagaacggaaacaacgcaaagaaagatgagaaacatgtggtgccaactcaggagtaa

SEQ ID NO: 52724 - DNA, 1611 bp, Glycine max
  Peptide Sequence Number=SeqID_144409
atgttcaacaagatcataaagctcgcccacaagaaatgctccaaactcgaattcctcgaaaacggacagcaattctacgaagtagtcatcaaacatgcgtctcgttccgccaccgccacccccgctaccgtcaattccgattctcaaaaccctccaccgtcgtcgcttcttcccaacccaaccgcaattgagtcactaccgccactgcgagacgtcgacgtttcggaacgcccggctctgttcctccgcaaaatccaagtgtgttgcttcttgtgcgatttctcagatgtcctcaagtacgtttacgagaaggaaactaagcgccaaacactcgaggagctcgtcgaaatcatccaatcaggctccttcggattcaccgaaaatcaagaagacttgatcaacatggtctccgttaacattttccgttgtttccctccatcatctctcaacacacagaatgtggatcctgaagacgatgaaaaatatcaggaaccatcgtggccgcatttgcagcttgtgtatgaaatccttttgcgttacattgtgtcgcccgagactgatatcaagacttccaagcgctacattgaccacatctttgtcttgaagctcattgagttatttgactccgaggaccagcacgagcgcgagtatttgaagaccattcttcaccgcatttatggcaagttcatggtgcacaggcccttcataaggacagccatcaacaatgtgttctatcggtttatatttgaaacgcagaggcataatggtattgccgagttgctggagattctgggaagtattatcaatggctttgcattgccaatgaaagaggagcacaagctgtttttcattcggactcttataccgcttcactatccaaaaactttttcctcttataaccaacaactgtcttattgcgtggttcagtttgttgagaaagacaacaggctggctgatcctgtgatcaaggggatgttgaagtactggcctgtcacgaattaccaaaaggaagtgttttttcttgcagaattggaagagattattgaggcaattcaatatcctgagtttgtacattgcacagtctctctttttaggcagattggacgctgccttaacagtcctcactttcaggttgctgaacgagcactttacttgtggaaaaatgagcagattataagtatagtatcccagaatcgaaatgttatattgccagtaatctttgaagctctggaaaataacttgaaaagccattggaaccgagcagtgcttgggctaacagccaatgtgaggaagatgtttctggagatggatgccgaattgtttgaagagtgtcaaaaacagtacttagagaaggaagccagggctagagagttggaagagaagagggagttaacatggaagaaattggaggcagtggctgcacaagccgtgagggatgacatggttttgaacggacgatggtggcgctgcttggctgctgctgctgctgctgctgccacctctgaatatcatcccgaagaagtcccccccatcgtcactgctggacccgtcagtgttgcctttgctggtggctccggtcacggtcccaccgccgttgaagccgggatataa

SEQ ID NO: 52725 - DNA, 1260 bp, Glycine max
  Peptide Sequence Number=SeqID_144410
atgctccccatcacctgcattctttttatgtgccttttaagttccttctcacccccaatcaacgctcttctcaacctcaacctcaccctgccccatcaataccctcaccccgaatccgtcgtccaagatatccaacggaaggtgaatgcctcactacggagaagggaaatgctgtcaaaggacgaacaacaaggcatgtcttcgtgtctgacaggaaaccccatcgacgactgctggcggtgcgagccgaactgggcggcggagcggcagaagctggcggagtgcggcctcgggttcggcaaatacgccatgggcggcaaaggcgggcagatctacatcgtgacggactcctcggaccgcgaccctgccaaccccattccgggcaccctccgccacgccgtcatccaagacgaggcactctggatagtcttcgccgccgacatgaccatcaacctaaaacacgagctcatattcaacagctacaagaccctggacggccgcggagccaacgtccacgtcaccggccacggctgcatcacgctccagtacgtctccaacatcatcatccacaacatccacatccaccactgcactccctccgggaacaccaacatacgagccagtccaacgcacgtagggtggagaggcaaatcggacggtgatgggatttcgatttttggctcgcggaagatctggatcgaccattgctcgctgtcttattgcacggacggcttgatcgatgctattatggggtccactgggattactatttcgaatagtcattttgcgcaccatgatgaggtgatgcttcttggacacgatgataagtacttggtggataggggcatgcaggttacaatcgcgtttaatcacttcggcgagggtttggtgcagcgcatgccacgatgcaggctcggttatatccacgtcgttaataatgacttcacgcagtggaggatgtatgctatcggcggtagcgctaaccccaccatcaacagccagggcaaccgttacacggctcccggagaccctgatgccaaggaggtgacgaagcgcgtggacacagacgatagagagtggagtggttggaattggaggacggaaggggacataatggtaaatggagcgttctttgtaccatcgggtgctgcggggcagagtggccagtaccaagaggccaccagtgtgcaagccaaatccgccgtgcaaattgaccagctcactatgtactccggtgtcttgggtgatcccaggtattaa

SEQ ID NO: 52726 - DNA, 192 bp, Glycine max
  Peptide Sequence Number=SeqID_144411
atggtgttagtgatagtgaaacatttccggtggtacttggtagcattgtgtgattgcaataaagatgagtgcagtgaaggtgacaataatgaggtcatgatggaggaggaaaattatgaaggaggagaaaagtggggtgatggggatggagatttggtagtgccgtattggcaatgttactggttgaaatag

SEQ ID NO: 52727 - DNA, 234 bp, Glycine max
  Peptide Sequence Number=SeqID_144412
atgagggaagcgtacttaaaagtgaaactatcatacccttgggtccttacatatggtcatggaagaagtgttgctgttatgtgtgcactgttagtagcacgaggcatcacagaggattggaagaatgctgagaagcttatcaagcaaaaacgaccttacatccggatgaatgctctccatcgcaaggcacttgaagaatggtccagacaccaattgtctgcaccgaggaagtag

SEQ ID NO: 52728 - DNA, 822 bp, Glycine max
  Peptide Sequence Number=SeqID_144413
atggcaaaaccaaagcttcacttgctgtcctttctcttgtgcaccatcttgctaagcttcttccactgcacattttcactgatcaacccagaggatgagaccagctggattgacatggaaactgaagacattaacgttgtgcaaagcttattcttcaatggctttccatgctatgttcaattgcaggattttgagacatcaattgagttcttctgggcaccattgttggtagaactgaagaaaggggctggcaataagagaattctacatttggatttgattgaagagaatgcaaggtgttggaagggagttgatgttcttgtttttgattcagcccactggtggactcactcgggccaaacacgctcgtgggattattacatggagggaaatagtatcatcacaaacatgaatcctatggttgcctgtcagaaaggactcagtacgtgggcaaggtgggtggatcttaatttggaccctagaagaactcgagttattttccgaagcatgtcacctaggcataacaggctaaatggtcggaaatgctataagcagaggaagccattacaatttttcagccacatacacgttcctgaaccactggtagtgctaaaaggagtgctaaagagaatgagatttccagtatatctgcaagacattacaacaatgactgctttccgaagagatggacatccttcagtgtatagcaaggcaatgagtgaagagaggcagaaaggcacaggtctttcctctgattgcagccattggtgcctccctggggtgccagacatttggaatgagatgctcagtacattgatctaa

SEQ ID NO: 52729 - DNA, 1626 bp, Glycine max
  Peptide Sequence Number=SeqID_144414
atggcggcgtcatcttcctcagcatcgctctttggatttagagaagaggatcaacaaaaccagatgaagcaacagcattccctgacaccatccccatcaacaactccagctgcacccccaccccagaagaaaaagagaaaccaacctggaacaccatgcaaatccagatgcagaggtgatagcactatctcccaagaccctaatggcaacaaacagaagacaacaaaagagccaaagagaaaggtttatctgtgtcctgagcccacatgcgtccaccatgacccttcaagggctcttggagacctcacagggattaagaaacactactctcgcaaacacggtgagaagaagtggaagtgtgacaagtgctccaagaagtatgctgttcaatctgattggaaagcccattctaagacctgtggcaccagagaatatagatgtgattgtggcaccctcttctccaggagagacagtttcatcacccacagggcattctgtgatgcactggctcaagagagtgcaagacaaccaccgagccttagcggcggcggaattggtagccacctgtacggaagcaccaccaatatggccttaaacctatctcaggtcggttctcagatacaagaccccagcaacgcccaacccaccgagctcctccgcctcggcgccacctccggtcgaaccggccatttcgaccacatcctcggttcacccttcagaccctccaaccaacaacaacaacccttcttcatgtccgaacaacccaaccaaacctaccaccaccccgaccaaaacaaacccttccaacaagggttaatgcagcagttgtctgatcaccaccaccttaacaacaacaattcacccttcaaccttccttttctctccagcaacacagccaacgcttcgttctctgaacacttcaacaatgccaatggaggaggcaacaacaacaacaacaacgagggcactaactacttcgctacttcaagtgcaccttctctcttcagcaacagtgccaatgcgaatgcgaatgcgttatctcacatgtctgcaactgcactgcttcagaaagcagcacaaatgggtgcaacttcgagcaacggcaccgcttcgcttttgaaaagcttcggaagcgcgtcttccagcagcggcggcggctcaaaatctgaacaacaacacagggtgccaccactggtgaatgctgcaaactacgttggtggaatgttcggagggaatcacgtgaacgaacaacagagtaacagtaacctccaagacctgatgaactcgttcgctgttggtggaaactcttccattttcgaagctggtggctttgaagcatatgatcatagtaataacaataataatagggacccaaaagtgcttgcaatgagtggaagtaacagcgttggagggtctgatagactcacccgcgattttctgggtgttggtcagatagtgaggggaatgagtgggagtggaggggttgcacagagagaacaacaacagcaacatggcttcaacttgagttctttggaagctgaaagaaataataataataataatagtaataatgctgcgccgtcatcagggcaagcttttggaggtggtggagggaattttcagtga

SEQ ID NO: 52730 - DNA, 1671 bp, Glycine max
  Peptide Sequence Number=SeqID_144415
atgtcttggaaagggctacttatggagtggttgactagaaaggttgagtggagcattgtagagggtcctcgcacattggtgggagttgcaacttttgactcaacgattcatttctacaacttgaaacgtgcattgcagcagccactgatgctcattgttcctgatgtccaagatgtttatactcccttgcaaactgatgtaattgttccactatctgagtgccgtcaacacttagaattacttctggaaagcattcctaccatgttccaaaataatagaacctctgaatcagcttttggtgcagctatcaaggcggctttccttgcaatgaaggacactggaggaaagctgttggttttccagtcagtcttgccatctataggcattggtgcactttctgcacgggaggctgaaggtagaacaaatatctctgcaggtgaaaagtttttgtatattcttcaacgaaatcccattcttgtcgaatttcaggaagcccataagttacttcaaccagcagacaaagcattcaaggaactggctgttgaatttgctgagtatcaggtttgtgttgatgtgtttgtgactactcagacttatgtagacatcgcttcgatatctgttatcccacggactactggtggacaggtctattactattaccctttctcagctctttctgatactgcaaaactttacaatgatcttagatggaacatcactaggccacaaggttttgaggctgtaatgcgtgtgaggtgcagtcagggtattcaagtgcaggaatactatggcaacttctgtaaacgcatcccaactgatgttgacctacctgggattgactgtgacaaaactttcatggtaactttgaaacacgatgataaattacaggatggatcagaatgtgctattcagtgtgcccttctttacacaactgtgtatggccaaagaagaatacgtgtcataactttgtctctgcctgtcactagtatgctcagtaatctgttccgtgcagctgatttggatactcaattttgctgtttcttgaagcaagctgctagtgagattccttcaaagccactcccacttgttcgggaacaagtgacaaacctttgcattaatgcactgttttcataccgtaaattttgtgctacagtgtcctcatctggacaacttattcttccggaggcactaaagcttttgcccttgtacacacttgcattaactaagagtacagggttgcgaactgagggaaagatagatgagcggtcattttggataaactatgtatcctctatctctgctccattagcaataccacttgtgtatcctaggatgatggctatccatgatcttgactcaaaggaagatgaagactctgttattcctccctttcttcctctttctagtgaacacgtcagtgatgatggaatatatcttcttgagaacggtcatgattgtttgatatatgttggagactctgtgaatccagacattgtgcagaaactgtttggtgttgctacagttgacaaagttcctaccctgcagtatgacaatccactatcaaagaagttaaatgaagtgataaatgagatacggcggcaaagatgttgctacctccggttcaagctctgcaggaaaggagatccatcaggctggatttttaagtactag

SEQ ID NO: 52731 - DNA, 1863 bp, Glycine max
  Peptide Sequence Number=SeqID_144416
atggaggacgcagacgcatacgcagtagggatgaatccgtgggagcaacactcgggtgttatcaagctgcctcgctatgactacaactctccctcttctcttctcttctcttctcttctccgtaactcccattccgattttctcatcacttgtactatcagttcagtaaactcacttacttctcttcattctcattcttctccttccaaccttccttttcattttttcaattcctctttccatagcgctacaaaagaagcaatctctatccttcataagtttgttgcttatgactcttcaaacaaccctaaagaagaaggcactagttctaagaaaaggaagttatgcacacaagatactgctgacgaatgtttcgaccacaaggatactgagtctgcttctgctaactctgcagaagatggtgttaaagcagagggagagaaagatggagtagcttgtctttctttggttaagctcacaaggaatgggttgcttctccttaactttcccagtaacacacctcccaacactgttaatattgtgtccaatatcattcaagctttggagtctggaactgtaactttgccagtgattcaatccctatctaacaaaagggagattgtatcatctgattttaggataaagaagatagaatatgcaagagcagatgttcctcagcctaggaaaattcctttgcccccaagttataaaccaaaactgaaagtgttaggatccaattgcaagaatccaattatgatgggccaaggctgcggtgcatggtgtgatgttaaattcaattgcaagtctgttgagccagctatattgacaaatttcagagccttcaaaacttgttattctttctggaaaaaggcacaaagtgtttttgctaatgacattcaacaattgtatgatgttgctaaaaaattagccactcttaaacaaactaatcatgacatggttgcctatgttttgaaagcccaatctgcagtggaggaattaaaattatcattggaagccaataaacttgaagacataaagacgaaacttaataatctatatatggtgttggtactacgtgggatgcatccagattttgatcatattcgtgaccaagtcttaactagccaagaagttccttctctagagaatttaattactcggctccttcgagtcccctcaccaaaaataggaggaaattcagttgacaatattgaaacttctgtcatggtatctaatcgagggggacaaggtggtcgtggaaaccaaggaggacgagctggaagaggagacacttgttattctattcacggattccccggaaaatcggtgaatatttcaaagtctgaaacatctgagataaagtttttggaggctgactatcaagagtatctccaactaaaagctaccaaggaatctcaaacatcatctgttataagtggtcacaactccactgcctgcatttcccaagttggtaataatcaaagtccatggataattgattcagccgatggttctagagttgcaacaacaggaatcggccataaggaagtggatgttgctttccctttcccaagtttcctcctcagtagacttagacttccacaagatgaatcttatactaataagcttcccatgtttctggtctcttgggtgccttcatcagctgggggacatggaaaactgggtgtatttggcaataggtggcaacaaccagctgtaaagcacttcccttacgcggcctgtgaactggaaaggactattataccaaagggaaatttcgagatgataggaaacacctattttaacactcttctctgccttgtattcaaaacagctcatcagcccctcccagaaatcacttaa

SEQ ID NO: 52732 - DNA, 162 bp, Glycine max
  Peptide Sequence Number=SeqID_144417
atggtaggcatacttgtgttgcttcactggcttgcactcacagttggtgccaatcgcattttccctatccaagctacctgcaatttgaacgaaaaagaactacaagaagtagtatcaaggcttgttaagaagttcttggctgataaacaggacaaactttaa

SEQ ID NO: 52733 - DNA, 1449 bp, Glycine max
  Peptide Sequence Number=SeqID_144418
atgaagtgttcggacagcgggtcattatgtttagggaatgaaatgacgaagcaaaagggcattctgatcgctcgtgatagtgactgtgattccctagtgtcatctccttccttgctctcgaattctgagaaagtgaaggaagtgtttgtgggtggtggtgatgaagtggagttttgtgcacagaaggacaggggagaggagaagttgaaaaaggggattgacatgacaatcatcaatgatgctgaactgttgatcgttgagttgtgcaacgccgatgaaagcgtttttcgtgaaggcgatgaaagggagttgtttttcaaggaggatgaggagacttccaaattcccattttactggcaacgtttcccattcaagttcaaatctcgtgcccaccaaatactgtggcccgaggagaatagagatataaagattatagggaaacctcggaaaattgaagaagtgaaagcaggtcaaagattcttcttagttcgatgtgcaaaaaacatccagggtgccagtggaggtcgtcgccgccgatggggaggtcatccacatggatgggctcgagggaaaggcacgaagatggaggtagaaacgacgattactgaggagctggtggctgccgccaaggagaatggggtggaggccatgaagactgaggttggtaaaactaagcaacttagcctagaattgactaagagtatgggaacggtgaaaaatttgcaagaggatcttgacaaacatgttgcctatctgtccagtaaggtcgaagaaaacaaggccttaagtgtccaagttgctgacccagagcagcaaatgaatgacataggcaagaagatgaaggatctaacctcagagaaaaagacaactaaggcagagttagggaccgtgagggacgagatggctgagatgaaggaagctcttgcaaaaatggagatcgagttgcgggagaaggaagaagttgagtctactttgaaggctgaattgaacgaggccaaaaggttgatcgtgataaaccacctagaaggggatgacctttcttgcgacgtcttcaagcctatacaccccattttgcaaggactcgatgatgtcgaatgggcctttccagtttggtgcaagttttccttccaagttgtccttccaggcatctcctcggagcctccaaaccaattcgttgggcttgaagccatgtccaattctactaccaaggattatgagttgttggccatgttgaccatgcttctgcgaagtgaagtggtacccccaaagcacgctcgggagctcatccacccacagtcccttggggactttggacagtcttttgcgcaacatgacaaggatgatcttgtttgcgacttcttgttgcccattggtcaagggatgctcaaccaaggatgtgagatgcttgataccaagctgcttaaggaactcttcatagcccttttttga

SEQ ID NO: 52734 - DNA, 1878 bp, Glycine max
  Peptide Sequence Number=SeqID_144419
atggaggcatctgcgacactcagattcgtcacacacaccctctccctcttcccacatacacccatctcttctatttcagtttcaccaaaattcagttcaaacactacgctgtcggtggcgaagaaaaagtcaagcatcgaaggtgtgagcgaagagttgaacgccatgacctctcagaaccttgacttcgcaccctcccggagacgggttcgtgcagctttcaccgaggtgcaccagcagctcgaccatttcttgttcaagaatcagtcattgattttgatgtttcaatctcttcatgtgtttgtctttggttggcaaactagactgctcctgccgggatcagaactgaggaagaattctaggggattggaaattttctgcaaaaactggatgcctgaaccgggcgttccactcaaggctgctttgtgtttctgccatgggtatggcagcacttgcactttcttctttgatggtattgccaaacgaatagatgcttctgggtatggtgtttatgctatggactatcctggttttggtctatctgaaggattacatggttacataccaaaatttgatgatttggttgatgatgttatagaacattatacaaaaatcaaagctaggcctgaggtgagagggttgccacgattcatattggggcagtcaatgggcagagcaattgctcttaagttccatttgaaggaaccaaacacttgggatggagtaatccttgttgcaccaatgtgtaaagttgcagagggcatgctaccaccaatggcagttttgaaggtattaaatcttttgtctaaagtgatgccaaaggcaaaactgtttccgcacagagatctatctgcactgactttccgagaacctggcaagagaaaagtggctggttacaatgttatttcttatgatcatccaacaggattgaaaactggcatggagcttttaagtgctactcaagaaatcgagtcactattacataaggtttcagctccattattgattctccatggagcagacgatctggtgacagatccattagtgagccaatttctttatgagaaagcttctagcaaggataagacactagaaatctatgaaggaagttaccacggcattttggaaggggaacctgatgacagaatttttgctgtgcacaatgacattatctcatggcttgattttagggagtgccccacagaattgcgagaagccattgcaagtataatttttgctgctcctagatgttcagatgtaccagacttattgcacatcaagaacttgtttaccactaaatatgggaaagaatttgtctctgcagtatctgaacttcgtcctgattcgggcgtgaaccgcacgatcatcgaaaagctttcagttagtgctccatctggagaggtaaaactcaaggtcttgagggagattgcagaagaatacaatatagcatgggattcttctaaaactgaggctgaatttaggaaaaaccatgaagatctcctgggtggagcaaaacaagttagtgctggagctacgctttctcatactcccaacagaaatggttctaataatccatcacctcgtattacggaaccttctatcaagtctgtgcatgctaagcaagaatataaaccccttgaagctcccagcccttctaacaataattctttgttgaatactaatgaaatcgaacattcgcacgaaaataatgatgttcctgctggagatgctaaaagtgagataagatttcaatcctctgatgtactggagaaggcgcgggctgccattgcttctgcagatcgtgcatctgcagctgctcgtgctgctgctgcactagttcagagtaattttggatcattgaaactgggaggtaaataa

SEQ ID NO: 52735 - DNA, 291 bp, Glycine max
  Peptide Sequence Number=SeqID_144420
atgttgtttgccggcggcaagaaactcctctatgtgtgtgtggtggtgatgcttgtggtgttgcatatctgccacacgtgccaagttggggcgattcgtgtgttcccaggaaatgcagcggccaacgtagaattcagccacggcaatatggataacaataagagcaaggaagatctgttcaagaagtacttcggtggaaggactcatcttcgtcccagcaacacaacccaaaagggttttgatgatagcaaaagaagagtaccaagttgcccagatcctctccacaattaa

SEQ ID NO: 52736 - DNA, 987 bp, Glycine max
  Peptide Sequence Number=SeqID_144421
atgagaaaacttcgcatcatttgcgacgatcctgaggctactgattcatccgaagatgagtctgagagggttcagaagccgagaagagtaaaaagaagcgtgttggagatgtctcttccccctctccctcaaacattcaccaccactactcctgatactagctcctgtgaggtgaatagcagcaaaaatgcaacattgaaggtttgcactgaaggtcaaccccagagcaagaagagggttttgactcacactccatcaacgagaaggagcacttgtgggaaatatagaggtgttaggcagagaaaatggggtaaatgggctgcagaaattcgtgacccgtttcagtgtactcgtatatggcttggcactttcaacactgcagaagaggcttccaaagcctatgaaaccagaaggcttgagtttgaagccatggcaaagactcaaactctaaaaactggttctgaacctttgtctacaacttctgataagagtaactgctgtaactcctctgctgctgccgccgccgatgtgtctgtgtctgaaaagttttctactacttctgatgactcggaagagagtatgttgtcacacaattcaccatcctctgtgcttgagttggatacctcggcttccaaatccgttgagaagggtaatggttcaactgaggaagctactggggctaataatttggtggctgaacttgcagggcttgagataccagatttgagtctgttgaacctgccaccaccaccatctgttgctgcggatgctgctgggattgagccaaattttgggcttgattttgattggctgtcgtttaatgattatggacagggttttgaggatttcggtggcttggagaacattcatattggtgggtttgatgacactgagcctagtgagcttcctgacttcgattttggtgattttggtgctgatgagtttgctggttggattgaggaacccctcaatataccttgtgcctaa

SEQ ID NO: 52737 - DNA, 2778 bp, Glycine max
  Peptide Sequence Number=SeqID_144422
atggcttcttctattcgcttagttactctctgtctctcttaccttcttcttacttggcttctacatgtaaccgctgaagaggctactagctcctctaacaaaattggcctgggctaccgtctaatctccatcaaagatgcccctgatggttcccttgtagggctcctccaagttaagcagaacaacaatgtctatggccctgaccttccccttttacgcttctatgtcaagcacgagactgagaaccgtttgagggtacacatcactgacgcaaagaaacaaaggtgggaggttccttacaaccttttgccaagggagcaaccaccggctctgaatcaatacatcgtatggtcgaggaagaagaacctagtatcagtgtccgagtactctggctctggctctgaccttgtcttcagctacatttcagacccgtttagtttttctgtcaaaagaaagtcaaatggggataccctttttgactccaattctaatgagttcaactcattggtcttcaaggaccagtaccttgaaatttctaccaaattgcccaaagatgcatctttgtatggtttgggagagaacacacagccacacgggatcaagctgtacccaaatgacccgtccactttgtataccactgatgtatcagccattaatctcaacactgatttatacgggtcacaccctgtgtacatggatctcagaaatgaaggtggcaagccttatgcacatggtgttcttttgttgaatagcaatggaatggatgtgttctatagaggaacctctctcacgtacaagattattggaggggtgctcgatttttacttctttgctggacccacccctctcaatgttgtggatcagtacacttccttaattggcagacctgctccaatgccttattgggcttttggattccaccaatgcagatggggctatcacaatctatccgttgtagaagatgttgtcgagaattacaagaaggcaaaaatcccacttgatgtgatctggaatgatgatgatcacatggatggccacaaggacttcacactcaatccagttaactaccctcattccaagcttttagacttcctggacagaatacatagcattggcatgaaatacattgtaatcattgatccaggaattgctgttaactccagttatggtgtatatcaaaggggtatcgctgatgatgtttttatcaagtatgaaggtgaacctttcttggctcaagtttggccaggagcagtatattttcctgattttctcaatccaaaaacagtttcctggtgggttgacgagattcgtcgcttccatgaactagtgcctgttgatggcctatggattgacatgaatgaagcttcaaatttctgctctggaaagtgcacaattcccaagggaaaagtgtgccctagtgggacaggacctgggtggatatgttgcttagattgcaagaacatcacaagcacacggtgggatgatcctccctacaaaattaatgcttctggagtacaggctcctataggcttcaaaactatagccactagtgcagttcactatgatggtgttttggagtatgatgctcacagcatttatggtttctctcaagcaattgcaactcacaaggcccttcaagggcttaaaggaaaacgacctttcatattgtcccgctccacttatgtaggttcaggcaaatatgctgcacattggactggtgacaataagggcacgtgggaggacttaaggtactcaatatccacaatgctcaattttggaatatttggggttccaatggttggttcagacatatgtggtttctatccagcaccaactgaagagctttgcaataggtggattgaagttggtgccttctaccctttctcaagggaccatgcaaacttctactcccctagacaggaactttaccaatgggaatcagtagctgagtcagctagaaatgctttaggtatgaggtataagctcctcccgtatctttacaccttgaactatgaggctcatgttagtggagcaccaattgcaaggcctcttttcttctcatttccaacttatactgaatgttatggcctcagcactcagttcttactagggagcagtctaatgatttctcctgtgcttgagcaaggaaaaacacaagttacagcactcttccttcctggaacctggtacaatttgtttgatttaacacagaccattgtgtcaaaagatggtaactatgttacccttgacgcacctttgcatgtggtcaatgtacatttgtatcagaatagcattcttccaatgcaacagggtggaatgatatctaaggatgctagaatgacacccttcagcctcattgtgaccttccccgctggtgcaactgacggagaagccaaagggaatctattccttgatgatgatgagctgccagaaatgaagcttgtaaatggctattcaacctacattgatttccatgcaactatcaaagaaggaacagtgaaaatttggtcagaagtccaagagggcaagtttgctttagataaaggttgggttattgacacgataaatgtgttgggattaaaccgaaatggagcactacctaaaattgagattgatggagaaccactaatgagtttgtcaaatgtgcaagtcagcacaactcaacataagtacttgtacgggcagggagatggagataaaatattgatggtaggattgaagggtttgaatatccctgtaggtaaaaattttaatgtgacctggaagatgggatcataa

SEQ ID NO: 52738 - DNA, 599 bp, Glycine max
  misc_feature (23)..(23): n is a, c, g, or t
  Peptide Sequence Number=SeqID_144423
gtgaaggcattggcagatcaggnggaatgggcttcatttattgacatcttggcactgttgatatttggtgtcatcctctttccaaatatggagggattagtggtcctagcagcaattgatgccttccttgcgtatcaccatagcaaggaaagcccggtcattgctattttggtcgatgtctatgacacgcccacttatccactgcaaggtcatcgcttatgcgccaagaaaggaaagaaaaactgggagcaactctgggctagtgtggagcgccgtcggaggaaagcatcacgcctttcatcgcccagggttttagtgaccctaatgcaagagtacttcaaggagtccgcaaggcatgaggtgcaatgcaaacttaaagctacaagagaggaaaaggctgaaactccaaaggagagtgaggaagtgcaaaccctaaaggcggaacttgaaagagcccaagtagtgaaagagaagttcaagtcaacagccatcaaagtctggaaagagtacgatgaactaagggatatcaatatggccactgtcgaagccttggaacgagaaaccaagagggcccgaaaggaagaacacgaccgaaacaa

SEQ ID NO: 52739 - DNA, 753 bp, Glycine max
  Peptide Sequence Number=SeqID_144424
atggagagaagtatgatagatgctaccagtggtggagcccttggagacatgactcctgctgaagccagaaatttaattgagaagatggcttccaactctcagcagtttagcgccagaaatgatgccatagtcattagaggagtgcatgaggtagctacaaactcagctgcatcatctgagactaagaagcttgaaggaaaactggatgcattggttaacttggtttgtggtttgtgctcctctgctgaccaccatacagacctttgcccttccatgcagcaacctggagcgattgagcagcctgaagcttatgctgcaaatatttacaatagacctcctcaacctcagcagcaaaatcaaccacagcagaaaaattatgacctctccagcaacagatacaaccctggatggaggaatcaccctaacctcagatggtccagccctcagcaacaacaacagcagcctgctccttccttccaaaatgctgctggcccaagcagaccatacattcctccaccaatccaacaacagcaacaaccccagaaacaaccaacagttgaggcccctccacaaccttcccttgaagaacttgtgaggcaaatgactatgcagaacatgcagtttcagcaagagaccagagcctccattcagagcttaaccaatcagatgggacaattggctacccaattgaatcaacaacagtcccagaattctgacaagctgccttctcaagctgtccaaaatcccaaaaat

SEQ ID NO: 52740 - DNA, 493 bp, Glycine max
  Peptide Sequence Number=SeqID_144425
ggcagcacgccctcgccttgagagggctacatcccctcgccttcagaggtctacacgtcctcaccttcagaggactacatgtcttcaccttttaaggactacacggctacacgccctcgcctttagaggactagacgtccttgcctacagagggttgcacgccatcgccttcagaaggctacggctgcacaccctcacgtttagagggctacatcccctcgccttcagaggactacacgtgctcatcttcagaggactacacgtcctcacctttagaggactacacgttctcaccttcagaggactacacgtcctcgccttcagagggctacacgtcctcgccttcagagggctacacgccttctccttaagagggctacatgccgtcaccttcagtggactacacgccctcacctttagaggactacacatcctcaccttcagagggctacacaccctcgccttcagaggacaacacgtccttgcctactga

SEQ ID NO: 52741 - DNA, 225 bp, Glycine max
  Peptide Sequence Number=SeqID_144426
atggtttggcccagggcttcccggtatcaacagggacaccaggatttatttattctgcgaagtgatcttccgtcacaggtgctccagtggcttctgtttgtatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 52742 - DNA, 87 bp, Glycine max
  Peptide Sequence Number=SeqID_144427
atgtttgtattcaacaatgctttgaaaggagttgacgatactccacaaagtaaatccaaggttgctgctaggtggatggttgttaaa

SEQ ID NO: 52743 - DNA, 828 bp, Glycine max
  Peptide Sequence Number=SeqID_144428
atggcggcaggcgctggcgccgaggtcgcgccacgctcgcgggaagcggcccggcgtcggcttgtgagccgccggcgcgacggccccggccgccgcgctacacgcccaggcctgggacgtgccgctccaggccacccggcctttctcgatgatggcgtggcgatccgcggtggccagcagcggctccaggttcttgtcgatgcacagcaccgccagcccggtgcgcttgaggctttccagcgcctgccagatctcttcgcgcaccaccggcgccagcccttccgtggcctcgtccaggatcagcaggcgcggattcgtcagcagcgcgcggccgatggccagcatctgctgctcgccgcccgacaggtggctgcccaggtggcgcgcgcgttcggccagccgcgggaacagcgcgtagacgcgttccagcgtccagggctgcgccagcccctggcgattgtgcgcggtggccaccaggttctcgcgcaccgacaggttggggaacacgtgccggccctcgggcaccaggccgatgccgcattgcgccaccttataggccggcagggcggcgacgtcgcggccgtcgaacgtgatggcgccgcggctggcgcggttcaggcccatgatggccttgaccgtggtcgacttgcccatgccgttgcggcccagcagcgtcacgaactcgcccgcggcgatatccaggtcgatgccgaacagcgcctggctggcgccgtaatgcgcggtcacgccgcgcagcgacagcagcgcgctcatgccggcgctccctgcgcgcggcggccggcgtggccgcgttcgctgcccagatag

SEQ ID NO: 52744 - DNA, 99 bp, Glycine max
  Peptide Sequence Number=SeqID_144429
atggttaaactagccaaaataaacactaaaagcggtgtgaaagataaggctgcacttgaacacaaagaaaagaagacaagcaagaaaccaaaaagatga

SEQ ID NO: 52745 - DNA, 192 bp, Glycine max
  Peptide Sequence Number=SeqID_144430
atggtgaaagttggaacctcttacgtgccgatcaacgtctcattttcgccaaaagttggcccagggcttcccgctgtccctcctgttcagttactgacggggtggtgcgtaagggcaaacgcaccgccggacatcagcgctggcaagtgtagcggtcacgctgcgcgtaaccaccacacccgccgcggttaa

SEQ ID NO: 52746 - DNA, 625 bp, Glycine max
  Peptide Sequence Number=SeqID_144431
acacgtcctcaccgttagagggctacacgtcttcacattcaaaggactacacatcttcaccttcagaggtacacgccctcgctttcagaggactacgtcctcaccgttagaggactacacgtccttcaccttcagagggctatcacgccctcgccttcagaggactacaccttcgcctttcagagggctacacgccctcgccttcagaggactacacgttccttcagagttttcagaagggctacacgccctcgcttttagcaagggctacgcgcctcacccttcagaggactacacgtcctccccttcaaggactacacgtcctcactacagagggactaggcgcctcagagggctacatcctcgccttcagaagggacatgcacctcaccttcagagggactacacgccctcacttgcagaggactacacgtcctcaccttcaggaggagtactcctcgcctttcagagggactacacgcctctacctttagaaggactacacgctctcacctttcagaggactaggcacgtcctcgcctttagagggctacatgccctcgccttgccttcagagggactacacgtcctcggctttagaggctacacgtcctcggtttcatag

SEQ ID NO: 52747 - DNA, 114 bp, Glycine max
  Peptide Sequence Number=SeqID_144432
atggcttcctttcgtgatttggagcataaatggtgtgcaaaggttggagctttgatggagcttcaatgtccctcgcgtttctctgcacccgtcaaggccagtttccgaaagtag

SEQ ID NO: 52748 - DNA, 225 bp, Glycine max
  Peptide Sequence Number=SeqID_144433
atggcagaagaagatgcactttctcttgacaacattgaatgtggtgtatgtgctgagtacaccgatgccggtgtatatggaaggcgaaactctggatcaaacaaggaagcgttcgaaatgggagaacgacgattacatttgtcgtggacacattctgaacggaattatgggactctcttgaatccaagtatatggcagaagatgcctcaagtaacaaattcttag

SEQ ID NO: 52749 - DNA, 507 bp, Glycine max
  Peptide Sequence Number=SeqID_144434
atggtggttcgtgccttcgacggaacctcgccgagaggcgaggaagacatcttagtgagctgcccgtcctctatgccttatgtggaggccgcagaggaatcattagaaaccgctttccagtcttttgaggtggtaagcatttcctccatggactccttctctgggcaagcttgcctgtccgatgcagcagtaatgatggcccgagttatgttggggaacggttacgaacccgggatgggtttaggcaaagacaacggcggcataactagcctgataaatgccaaaggaaatcgtgggaagtatggtttaggctataagcccactcaggcagatatgaagagaagcatcgcgggaaggaagagcggtggtcaaagctcgcgttggagacaagaaggtggaggaagcccgccctgccacataagtagaagctttataagcgcgggtctgggagacgaaggtcaagtggtcgcgatatacgaagatgatgttccgagtacattggatttg

SEQ ID NO: 52750 - DNA, 204 bp, Glycine max
  Peptide Sequence Number=SeqID_144435
atggcgctacgaaaaagggatagagaatggagaattgcactaagcaatcactacgcatggctccaaactcgtgggggtagagaacggagaattgcactaagcaatcactacgcatggctccaaactcgtgggtggaggatgcatgaacgcaaacccaattcatggggctctgaaaaaggggtagagaatggagaattgcactga

SEQ ID NO: 52751 - DNA, 540 bp, Glycine max
  Peptide Sequence Number=SeqID_144436
atggtaatgttaactaaaaacaacttgccaagtgctaaggaattccttcgtggaaagtatcttatggataaagaatatcccggcagaatgaccatttatgcagaaagtcgaagtggtgataggctagaaaccagcggctcagagctatgcgacgaggagaataaaaatctaagatgtgtactatctgaaagtgataagtcgttgttggtagagttaggcgagcactccattgagtgcctactggttcacaccctaggccatctgtttaatctggaaaatattgtcagtcttgctagtttggttgatcgtatagaacgcaatgtaagggattatgcctcatcgtcaacattgtattataatagtaggggccataattactataggagctctttagtatatgccgaatgcttgtttaaccccgcattacttcctataaagttaaacctacctatggtatttccacctaaagattgggagccccacaaacctgaacagaaaccaaccctacgggccaaatctacagcactcaacggagtatga

SEQ ID NO: 52752 - DNA, 2083 bp, Glycine max
  Peptide Sequence Number=SeqID_144437
atggcgggcggcggcatgctggccgatatgtctatcaacgcgatattttccgcgctacacccggtacatgccgctaccggcgtgaaagtgctgaatgatgatgccgagcgtgatttctcgctgccgggacgttttcccctgcgctggcagcgcagctataacagtctgacgcagcgcgtcggcctgtttggccgtggctggtcgacggtgttcgacagctatctgacgctggaaggcaatcaggccacctggtttgatgacaacggccgcgaactgcgtttcttgcccggtgaaaaagaggtgctttacagcatcagcgaaggactgatggtgcgacgcaatgcgcacggtgacgtggcaatcgctgacgatgacggcgcggtctggcgcttgtacaaacccaccgccagaaacccgcagctcttgcgtctcgcctcgctgagcgacgagtacggcaacgcgctggagatgggctgggatgagcagagccggctggtgcgcatccatgatgaaccgctggcgattgacgtgacgctgcactacaacgacgaacgccatccgcaacgcgttaccgctgccaagattgatgcggcgggcaatcgctatcgccgtgaatataacgatgccgggcaggtcattcgcgagacggactgctccggccagactacgcgttaccgttatcatccgctgggctggctgagttgtgttacagcagccgatggcgaagaaacgcgatactactatgatgccgccgggcgaccccggcagatggaacgtgctgaaggctgggaagaacgtctggagtggagcgaacgtggtctgccagtggcgtatgcctcggcagacggtaaacgcagcgaattcgcttacgaccaggccggcagactgactctctcgcgaaacgcgcagggcgaagaggtgcagcgccgctgggacagccgtggacgtttaatctcgctgcaaaatcagaacggtgaaagctaccacttcgaatggggcgcagattcgctgctgctggcgcaggtcgggctggacggtgtggcaacaagctatgactacgatgccgccggacgcgcagttgcccgcactttcgccgccggtcacccgcaggccattacgcaccgcttcgccttcagcccggcagggcaactaatggcgcgcatcaccccggaaggccagacgcgctatgactataccgcggcgggccagctggcaagcgtggcgcagcatctgccactgggggaaaaccagtggagccgtgaagccgagcaggcgattactttcgcgtatgacaaagctggtcgcgtgatagcggagcagggcgatcagggcagcctggcgtggcagtatgacgcgctgggcaactgcactgcgctgacattgccggatggccgccagctgaaacagttgtattacggcagtggccatctgctgagcatcgcgctggataacctgccggtcagcgaatttacgcgcgatacgctgcaccgcgaactgagccgcagccagggcggactgaccacgcgcagcgattacgatcggctgggtcggctggtgcgtcgcgatgtgttcgacggtgaggcacagcgcccggcaccgcgccgctggtcacgccggcgtgatttcgactacggcaacaacctgattcgcgaacagcgcgacgacaatcctttcagccagacgctctggcactacgacagcgcgggccgtctgctggcgcaggaaggtgtacagcccggtaatgatacgtggcagtgggatggcgcgggtaatccgctggaccgcagcgcggcagcagcggtaacgtacaaccgtgttacgcagctgaacggcatccgctggcgctacgacgtgcacggccgcaccagtgaaaaggatgatggtcagacgcgctggcgctatcgctatgatgacgagcatcgcctgatcgaagtcgtcagcgaaccgcgcgatcgcaacaagcctcaggtgcaggtgagtttccgctacgatccgctcgggcgtcgcatcagcaagcgcgtgcagcgtttgctgcacggcaagccagccggagcagccaccctcacccgtttcgtctgggacg

SEQ ID NO: 52753 - DNA, 828 bp, Glycine max
  Peptide Sequence Number=SeqID_144438
atgctacaagtgctcaccttcagaggactacacgtcctcgccatcagagggcaacacgctctcgcctacagaggactacacgtcctcgccattagagggctgcacgccctcgccattagaggactacacgtcctcgccatcacatggctgcacgccctcaccatcaaggaactacacgtcctcgccttcaaagggctgcacgccctcgcttttagaggactacatgtcctcgccataaggggactacacgtccgcgcctttagagggctgcacgccctcactttaggaggattacacgtcctcaccatcagagggctgcacgccctcgccatcacaaggctgcacgtcctcgccttcaaagggcaacacgtccaaacctttagaggactacacgtcctccccatcaaagggctgcacccctcgccatcagaactgctacactgccctcaccttagagaattacacgttctcaccttcaaaggtagcacgccctcaccttcagaggactacacctcctcagcctttagaatgctacaagtgctcaccttcagaggactacacgtcctcgccatcagagggcaatgcacgtcctggccattagagggcagcacgccctcgccttcagaggactacacgtcctcgccattagagggttgcaagccctcacctttagaggattacacgtcctcgccattagtggatttcaggtcctcgccatcaaagggctgcatgccctcaccttcaaagaactacacgtcctcgccttcagagggttgcacgccctcactttcagaggactacactgtcctcgtcttcagaggactacac

SEQ ID NO: 52754 - DNA, 135 bp, Glycine max
  Peptide Sequence Number=SeqID_144439
atggcaaagctcagagattcggaagcctcgccggagataatggatacgaatcagcaaagaagaagggtttcagaagcaaagaggaagaaaggtttcggggtttcggaagcaaagaagctaaaggggtttctctga

SEQ ID NO: 52755 - DNA, 606 bp, Glycine max
  Peptide Sequence Number=SeqID_144440
atggcatcgttcaaccagatgcagtcccagatgcaatctcaaggacttgcactgcctctcgagcctctggggagttgtgttgatccctcaagaaacgatcctgagacgggtgactcagataggtgtggcttgtacattaaagcagatcctgcctgcctggttgccctggggagagtttatgagggatccactggttttcataacactcctttgttgcctgaccaagtaaaggtgggtgtggaggaggttacagatgcagatgctccagttcctgtacccactgatgaggtttccttagtggggcaggcaattcacaccttctttgcttggccgacacatttggtcaagtctttatcacaacaaacagttgtgtctccagcaaaaccacctcaaaagcccgatctggaggtcgatgatccgctttatctaatgacattgaccatcccagagattttcttgaggccttaccaggttacatgggatgccactgtgttcggggtctttaatctagacttccctctctacataaagcacgaagacctctccgaaatcgcacacgatggtcaatgtctcagcatatcaatgttacagttgtggattctgtaa

SEQ ID NO: 52756 - DNA, 205 bp, Glycine max
  Peptide Sequence Number=SeqID_144441
atggcttcttcgtcgtcatgctcatcaagtatacaaactaggtctggtccaattgatagtgacgtgttgtggatgcaatccaagcatgtttcagaacatgcttggaatagggaaccagacagaaaactacacatcaggcgagcagtcccgacgtatcaaggtgaagaacaaataccggaggaaattgttcctttgcttcggcaat

SEQ ID NO: 52757 - DNA, 342 bp, Glycine max
  Peptide Sequence Number=SeqID_144442
atgacttcaaaagaattgaacgaggagccatatgaagtgaaaatctcatgtacggctaccatgagacaaaagattttctttctaaagaaattcgattcggaactacgatatgtccaaggtccaatatggaaagaatttcagaggttttccttgactttgtccgtgtcaacaaacaattcgaaatgcctcgacttttttagaataggtccgagtcaaatagcaatgattcgaagcactttacactattttggaaacccaaggactcaatcgtatggatatgtaaaatacaggatttccaatcctagcaggaaagggggggaacggatactcaatttcaagtga

SEQ ID NO: 52758 - DNA, 186 bp, Glycine max
  Peptide Sequence Number=SeqID_144443
atggcgccaaaaacttgtttgatcgcggcaagtgcaccggatcgcacaagtagtataaaatggatagtcaagcctaatcctgatcaagcatcgtcctcaaattcctcttgttggactaaacttgaccagaaccgcattaagacaaacatacaaacaactaggttactgtaccccgattcctcgtga

SEQ ID NO: 52759 - DNA, 261 bp, Glycine max
  Peptide Sequence Number=SeqID_144444
atggatattgcaccactgtggcacttctttatctctaattcttttgctatttacacaatcttgtttaattctcccaacaatttcagattgagttggttcttgcctagttcagaagagctaaagggagggttgatgaaccagctatcagggattgttgcttttgaaattgaatatggacatgggttgaagagcaagaaaggcggaatgaagaacttagacatgcatttcaaacgcaagcacctgatgtatagctcaacgtag

SEQ ID NO: 52760 - DNA, 324 bp, Glycine max
  Peptide Sequence Number=SeqID_144445
atggctccaaagaagcttctatctaagagggcaaggaaagatgctgttggagaaggatccagtgtgaccccacaagtggatatggaattcgatggacattggttccaaagcaaggaacaccaacaccgttttgaagcaatcaagggaggcagtggactcaccatggctaagtgtgatctagaaatagtcatggagttctatgccaatgtaaggcccacagaggaaggggtctgggataagtgctcctggtcacctactgtgcgttccggggctggacttcacccgaagtgtgacagggagatgggtgcggatcatgctcactag

SEQ ID NO: 52761 - DNA, 140 bp, Glycine max
  Peptide Sequence Number=SeqID_144446
atgggagaagttggatcatctagaggaaaggctcaggtcgttgaagaaggcagagattatgcctttactgacgtagaagagttattcctagtacccaaacatgggtcattcccaagttcaaggtgcccggactttgacaa

SEQ ID NO: 52762 - DNA, 420 bp, Glycine max
  Peptide Sequence Number=SeqID_144447
atgacgggatcgaaccgacgaccccctgcttgcaaagcaggtgctctcccagctgagctaatcccccaatattcggtggtgggtctggttgggctcgaaccaacgacccccgccttatcaagacgacaggtgatcttctctagaaaggaggtgatccagccgcaccttccgatacggctaccttgttacgacttcaccccagtcatgaatactaccgtggtaatcgtcccccttgcggttagactaactacttctggcccgggaacgtattcaccgcgacatgctgatccgcgattactagcgattccgacttcatgctctcgagttgcagagaacaatccggactacgatcggctttctgagattagctccccctcgcgggttggcaactctctgtaccgaccattgtattacgtgtga

SEQ ID NO: 52763 - DNA, 270 bp, Glycine max
  Peptide Sequence Number=SeqID_144448
atgttgaggaagcttgggaggattgatggggacccggtgttgagagaaacgaggatatgggctacgtggaagtacgtgagctcagttggaggtgggcaacaggggatggtgggtttatgcacgctttgtggatgtggaaacttgttgtgcaccatcgcccgaccgccacctagtaccacatgtgatggagtggtacctggagatatgtcgcgggggtcaggagaccttggggacgtcaggtggggtgctattgcccaaaaccaagcttga

SEQ ID NO: 52764 - DNA, 129 bp, Glycine max
  Peptide Sequence Number=SeqID_144449
atggataagagcttgaagctagaagaagatgagtggagggagagggagagaagggcacaaaatttttgtgcctcaaatgagcccactaatccaagatcaagtccaagattctcctctaagtgtgcttag

SEQ ID NO: 52765 - DNA, 858 bp, Glycine max
  Peptide Sequence Number=SeqID_144450
atgatgaatgggattgtggcactccactcgccgccaatgcggaaggatgccgccgaaaagaagggaacgctgcttcgctctgctggatgcgtcggatcccgtataacaagcgagctttttaccaaaaaattcaaacatgtggtcgcaaaatgctatccagctctcttgttgcgtagcaatagaagcctgctcatgctgctttggcggcgctttttcgccttctcttcgctctggacaggagcgctagtggacacggggggggagcaggcgaagcgtgtcgttcgtaatgaacagaaagataccactacttcgcctctttgttggagcgccggcgcgaacacagtggtatctgaccaggaccagaaacagattcgaatttggatcttgacatgtcggtggtttttaaccgtgggcatcatgccaggaagttggtgggctcatcatgaattaggtcggggtggctggtggtttcgggatcccgtagaaaatgcttcttttatgccttgggtattagccacagctcgtattcattccgtaattctaccccttcttcattcttggatctcgtttcttaatattgtgactcttccatgctgtgtctcaggaaccttttcaatacggtccggattgctagcttccgttcatagttttgctacagatgatacacgaggaatctttttatggcggttcttccttctaatgaccggcatatctatgattcttttctcccagatgaagcagcaggcatcggtccgtagaacttctaaaaaagagatggttgtggcgcgaagtactcttgtgcacctccgtcactcggctcgcgcgcaaccccgccccgttatgttatggaagaattga

SEQ ID NO: 52766 - DNA, 854 bp, Glycine max
  Peptide Sequence Number=SeqID_144451
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccgtaaactgcttgaaaaaacagggattcactccccttatctagaacaagttgaaaccatcggcaatcagcatcgtgatccacgtgaagaagccttgcaactagaattagctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 52767 - DNA, 517 bp, Glycine max
  Peptide Sequence Number=SeqID_144452
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaacacttgtgctaagcgagcagagcgcgttaagcgcaaaaataggtacctgcgctgagcgagcagagcacgctaagtgcgagtatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 52768 - DNA, 210 bp, Glycine max
  Peptide Sequence Number=SeqID_144453
atggtgcaagatgacatgtcaaatgaggtttatcataatgatgatgaccctaagggctatgaagagcccatgagaagctcatattgcaacaaatggcaaaaagccatggaatctgaaatagaatcaataaaaagattggagcagatggaaaggtcgagacctataaagctcgccttgttgctaaaggatatcgtcaataggaaggaatag

SEQ ID NO: 52769 - DNA, 360 bp, Glycine max
  Peptide Sequence Number=SeqID_144454
atgtcgggaaacctgtcggtgccaactgcattagaggccaacgcgcgggcgatcgggcggctttgcgtattccgggcgctaaggcggagtgtgcatactggcttactatgttgggtaactgagcagggtgtcagtcgaagtgttcatgtggcagagaaaaaactgcaccggtccgcaattcctgttgagctcctacgctcggtcgtcatgcggcgacgtgaaagtggttaccccacggggcggaattgtcagagaaggaggccacatgatgaagatatcttatacagggaagtgagagcggccgcggcaaagccgtttttccataggctccgcccccctgacaagcatcacgaaatctga

SEQ ID NO: 52770 - DNA, 348 bp, Glycine max
  Peptide Sequence Number=SeqID_144455
atgattatgaggggccaagacatttatagtagccaagatgacgctactacttcaccttcctctagtgaaagtgaaaaagcaaaaggggaggaatctagtgaagaaatctacccccaagaagaaggaaaaccattagtggttaaagagaagtttaaggaggtaagtgtctcctccaagagtgatcaaagggttcccatgaaccctaaaagaataaaggtcattcctaagtggcccactccaccaagtgttgagggaaggagcccagagtatgacgaacctcaagatttgaggtcaaatcctttccaaggtggagggaatgatgcaatcctaccctgcaagggcatttga

SEQ ID NO: 52771 - DNA, 252 bp, Glycine max
  Peptide Sequence Number=SeqID_144456
atgagtcgatctcttgctttcccaagggtggacccttgggtacttgtacctatcacttttagaggactacacgtcctcaccatcaaagggctgcacgccctcacctccagaggactacacgtcctcgccttgagaggactacacgtcctcagcaccagagggctgcacgccctcacctccagaggactacatgtcctcgccttgagagggctacacgccctcaccttgggtactagttaccctcaccagtga

SEQ ID NO: 52772 - DNA, 690 bp, Glycine max
  Peptide Sequence Number=SeqID_144457
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatccggcctcgagcaaatgaatcatccaacctcaaatatggtaggcaaagatttaggaagtacgggcggcccccatgatgtgcagattcaaaacgagcacgccttcccgtcatatggcttgcctctcaactatacgccacccaatgtggcgtacactcccaataagaatgtcaataactccactcctatacccattgagagccagcaaccccaaactgatcatgcacatggcaagcagttggtggtatacccctacaaaaccctttggagggccctcagtatcacccacaactgcacctcttgcattccacagcggttaaaaaccctcatgactatggcaggaatgggaaagttggatcatctagaggaaaggctcagggccattgaaggaggtgaagattatgcctttgccaacctagaagagttgttcctaatacccaaacatggtcattcccaagttcaaggtgccggactttggcaagtacaaggggactactcgctccaagaaccatctaaagat

SEQ ID NO: 52773 - DNA, 201 bp, Glycine max
  Peptide Sequence Number=SeqID_144458
atgggggtgtcacaacgtgcccttagcgggcgagcgagggtgaggctcacgggtgcgcttcccaaaggaggaaagatgcgcggagtcgccaccaacgtttatttgtggaaaacgtcggaaaaaacgaaggaaaccggtcgacaaaagcggggcttttgctcctacgtaccctcctttggagaggaaatcagacctacgtag

SEQ ID NO: 52774 - DNA, 270 bp, Glycine max
  Peptide Sequence Number=SeqID_144459
atgacagaagcttgcatggatgagactcaaaggaggacaatcaacagaagcaactcaaatcaattgaacaatgttcaagactcagggaagaaagttagaagtcaagaatcgattcaaggtatatatcaaatgatctccgggaatcaagattcaaggttcaagatctcaagaatcaagacaagattcaagactcaagattcaagaatcaagagaaggctcaatcccaagataagtatgaaaagtttttctcaaaaattgaatagcacatga

SEQ ID NO: 52775 - DNA, 639 bp, Glycine max
  Peptide Sequence Number=SeqID_144460
atggcgaatcaagaggagcgggtcccgtttatggacgtattagcattgctaatctttggggttgtcctctttcaaaacatggatagtttggtggacctagccgcaattgatgctttccttacatatcaccatagcaaagagagcccagtggtagctattttggcggacttatttgacacatttgaccgaaggaagagtagattggaccaacccttggctgggataggaggtagaacaatcaattggtttcctcgatggaaggaaggaaaggagggagttctcttctcatgtggggactaccccaacatcctgttgataggaacgaggggttgcattaactacaatcccgcacttgctataagacagttagggtaccccatgaggggagcacagacggaagaaagcctctcttatttccttgtgagagatttcggtgcgcaaagtttcaagattataaaaagagtccataaggcgtgggaaagcccgttaaggaaagataaagaacttaggggcattcgtaatgacatcatcggtggttatcatgaatggctgaaagtttgtacacgagggttagattggctctccaagttaaagattatcgatgaagagaacttcgaagctccggaagaggatgaagaa

SEQ ID NO: 52776 - DNA, 195 bp, Glycine max
  Peptide Sequence Number=SeqID_144461
atgcttatgttgacaagcttgcttcttttggtgcatagaatgcgggaaaaaaaatactttggtgctagaatgttcaatttggagtccacaagaggaggatctccatattgtgctggagtttttgttggagatggtacaagacaagcaagtgaaatggagctggagcttgcagagtatcatggcaagtatatatga

SEQ ID NO: 52777 - DNA, 228 bp, Glycine max
  Peptide Sequence Number=SeqID_144462
atggctccgagaaagctttccgcaaaaagatctaggagggacgccgcggctgaagggaccagtgccgcccccgagtttgatagccaccgtttcaggagcgccgagcaccagcaatgtttcgaggccaccaaaggatggtcgttccaccgtgagagacgcgtccagctcagggacgatgagtacatagattttcaggaagagatagctcgccagcattggacgtcgctg

SEQ ID NO: 52778 - DNA, 720 bp, Glycine max
  Peptide Sequence Number=SeqID_144463
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttctcgaactcggtataatagcccttaaatcaaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 52779 - DNA, 780 bp, Glycine max
  Peptide Sequence Number=SeqID_144464
atggggacgaggggttgtattagctacaatcccgttcttgttataaaacaactgggctaccctatgagaggggcgccactagaggatgagctcgcacctgtcatttctcgaggcttcaagaagaccaacatggagacacttcagaaggtccgcaaggcatgggaggtggctcttaggacagaactcgagcaagctcaaacagtcaaagaaaggttcaaatcagtggctcttaggatccgaaaggagaatgccgaactgagggatgtaaatgtagctaccaccaaggccttggaacaagagaccaagaggagtcgtagggaagagcacggccggcacaagttccgaggggctctgtgggatagcaacagcgagcctagacttcgaagagaggaaagggaccaatcacgagtagacagtttgatcttaaaagatgaattgaaggcttgctcgaggtccgaaagaagtttgtctcagcggttatgcgagacagagaccaacatgttagctatcatcaccaagtaccaagaagaactaaatctagctgcggcccacgagcatagagtggtggacgagtatgcccgagtgtacgcagaaaaggaggctagaggaagggagatcgactcgttacatcaagaagcaacgatgtggatggaccggtttgcccttaccttgaacgggagttgtcgcaacctacccttcggcgggagggcgacgcgtgactcgcgggatgcgtgttccacgaaaggaatacgcgcggagtcgccaccaacgtttatttga

SEQ ID NO: 52780 - DNA, 330 bp, Glycine max
  Peptide Sequence Number=SeqID_144465
atgactagaggcaatccatctgacttacaaccctttgatcctgagatagataggacatttcatagattagttaggcatcattttataccttttgatcattctgagcattccataactggtgaatttgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctatgaaagcttgtgcatccaataccctgatgaggatgtcccatat

SEQ ID NO: 52781 - DNA, 444 bp, Glycine max
  Peptide Sequence Number=SeqID_144466
atggtttatccaagtggtactagacacgaatcccttaagcatgtagtaaagggtttgaatcctgacgaatgcgtatatggagaaaatcttgttgagagggagatcccacttatgagtgccaacagaatattctataaaaaggttgaatatgtgcttgaagattgtaatgaggttctcgtcaaaatcaacaaatttgtcgtcaacaaagaaggcttagtatgtgtggaaacgttgtgtatgcctgttactaaaccagaaagatttgagttggatgcttttgagttagatgaccctgaagatgctggcaggtatatagttagaaagagcataaagagtgcaaaagacatagttcgtttccctttccaacagaatgccaccatactttacttattgcacactgtgtacagaggcacagagaatctcccattacttactgtgcactat

SEQ ID NO: 52782 - DNA, 678 bp, Glycine max
  Peptide Sequence Number=SeqID_144467
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatccagaccagcgtcgaagttaccattacgcgccgccagtcgtgccaggccataatagccaccggctttgctgttgccgctccagaccgcacgccagaaatcctcttcggcttgttgatattgtccctgacgttcgtaagcactggcgcgaatcaaactcgcctgtccgcactgcggatttttgttcagcgcatgtgcgcgtttcagagcctgagtggcatacgccaccgcttgcggatcaagcttatcgataccgtcgacctcgagggggggcccggtaccagcttttgttccctttag

SEQ ID NO: 52783 - DNA, 339 bp, Glycine max
  Peptide Sequence Number=SeqID_144468
atgtccaaatcttgtggatttgggatgaccggccctctcgatgagtcgatctcttgctttctcataagggggggctacacgccctcaccttcagaggactacacgtcctcacctttagaggactacgcgtcctcgccatcagaggactacatgttccccattttcaaaggagggcatgccctcacctttagaggattgcacgtccttgccatcataggactacattccctcgccttcgaaaggcgacacgtcctgaacttcagagggctacacgccctcgcctttagaggactacgcgtcctcactttcagtgggctccatatccacaccttaagataa

SEQ ID NO: 52784 - DNA, 279 bp, Glycine max
  Peptide Sequence Number=SeqID_144469
atggtggagaaggagtttgatgcaaaaatcaaatgcttgaggagtgacaatggagagcaacaaggagaggaaagcattgagtcagctgaaatagatgcagaagaaaaaaataaatcaaaagatgcatactttatgagaattcaagatgaacaaaagcgctatctattgcgcacgaaactcctagtactttacagattaacagaagtggccaaaactgaaattcagctaaagtactatacagacgatatttccgatgctttggaatccagttcttcttga

SEQ ID NO: 52785 - DNA, 378 bp, Glycine max
  Peptide Sequence Number=SeqID_144470
atggctttccagatgtttaaatctatagcctctatgaagatttgcatacggatgtttacacttgttggacacattcagttctacaacactgagtcactagataaaatgaaaagcataggaaactctttgcaatatcttgtggtggtattttcaatttatgttggaaccttgttggttaatgttgtgcaccaactgactcggaagcatggtggaattgattggttaaatgatgacatcaatgctggaagattggactactattacttcctcatggctgggttagctttgattaatctcgtatatatcttgttctgtgttaaacattaccgttataaggttaatgtcgaagaaaaagttgtggagaaacttgagccttga

SEQ ID NO: 52786 - DNA, 384 bp, Glycine max
  Peptide Sequence Number=SeqID_144471
atgattatgaggggccaagacatttatagtagccaagatgaggctactacttcaccttcctctagtgaaagtgaagaagcaaaaggggaaaaatctagtgaagaaatctacccccaagaagatggacaaccattagtggttaaagagaagtgtaaggaggtaagtgtctcctccaagaggaacccattaggtagtgtcgcaacctacccttcggcgggagggcgacgcgagactcgcgggatgcgtgttccacgaaaggaatacgagcggagtcgccaccaacgtttatttgaggaaaacgtcggaaaaaccggaaaagacgcgatctatgaacttttaagtgaaaggttcgggagttgtatttacgcgcggggaaggtattag

SEQ ID NO: 52787 - DNA, 208 bp, Glycine max
  Peptide Sequence Number=SeqID_144472
gtcgactctagaggatccccgctttatggggatcccgaccgcgatcgacatcacccgcgtcggcagcagcggtattttaccggtgatcaacaccgctatcgcccacaaagacgccgggatcggcatgatcggcgccgggatcgttcatccgccgttcgcctgtttcgaaaaagcgatcctcagctggtgcgatcgttacgacgtttag

SEQ ID NO: 52788 - DNA, 1025 bp, Glycine max
  Peptide Sequence Number=SeqID_144473
tccgctatcgccagcgttatctggatctgatcgccaacgaagagtcgcgtcatacgttccgtatccgttcgcagatcctcgccaccatgcgtcagttcatggttgctcgcggctttatggaagtcgaaaccccgatgatgcaggtgatcccaggcggcgcttccgcccgtccgttcatcacccatcacaacgcgctggatctggatatgtacctgcgtatcgcgccggaactgtatctgaaacgtctggtggttggcggcttcgaacgcgtcttcgaaatcaaccgtaacttccgtaacgaagggatctccgtacgccataacccagagttcaccatgatggaactgtatatggcgtatgcggattacaaagacctgatcgaactgaccgagtcgctgttccgcactctggcgcagacggtgctgggcaaaaccgaagtaccgtatggcgaccaggtgtttgacttcggcaagccgtttgaaaaactgaccatgcgcgaagctatcaagaaacaccgtccggaaaccaacatggcggatctggataacttcgacgcggcgaaagcgctggcggaatctatcggtattcaggtagagaaaagctggggtctgggacgtatcgtgaccgagatcttcgatgaagtggcggaagcgcatctgattcagccgaccttcatcaccgaatacccggcggaagtttccccgctggcgcgccgcaacgacgtgaacccggaaatcaccgaccgcttcgagttcttcatcggcggccgcgaaatcggtaacggtttcagcgagctgacgatgcggaagatcaggctcagcgcttccaggatcaggttcaacgccaaagcggcaggcgacgacgaagcgatgttcttcgacgaagactacgtgaccgcgctggagcacggtctgccgccaacggcgggcctggggattggtatcgaccgtatggtgatgctcttcaccaacagccacaccatccgcgacgtgatcctgttcccggcgatgcgcccggtgaaataa

SEQ ID NO: 52789 - DNA, 462 bp, Glycine max
  Peptide Sequence Number=SeqID_144474
atggcgcctaccaggcaccctttggatccagataagtccaacagggccctgggatttccctcgctgatcacaggactctgccagtcgtttggagtccccgttgcacctaccaaggccgcaggcgcgccaccaccacctcatcaggctggccaggctgggtcatctgacatggagcagtatttacgacatttggttcgccagcaggcggccaaccactgggcacatgtacagacccatgattgtctgtaccagatgagcctcagcatgcagagccagggcttcgcttctttttcatgccctactccagaccagttcagggcagaggttgcatggcccagagattggcccgaggcccaagcaggagaggcgcccccagaagctcccgacggtggcgaggaggcccacgaggacgaggagatggccgatttgcttgacctcttgggagggagtggagctacatga

SEQ ID NO: 52790 - DNA, 383 bp, Glycine max
  Peptide Sequence Number=SeqID_144475
atgaatccaacctaccttctaaaggaggaagctacaggattgagccagatatatagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 52791 - DNA, 668 bp, Glycine max
  Peptide Sequence Number=SeqID_144476
atggacatcgctggttacccccatggccaagttcgacccagacatagtcctggaattttatgccaatgcttggcctacacaggagggcgtgcgggatatgcgatcttgggtgaggggtcagtggattcctttcgatgcggatgccctcagctagttcctgggataccctttagtgctggaggagggccaggagattttgcctggaccactgccgggagacgagtacaaatcatgcgtaccagcatgactactctgacccagatatggatgacgttgctgcttagcaatatccagccctgtgaccataattccgacctccccctgccgaagtgtcggttggtgtatgccgtcctgacacagatgagcattcatgtggctcagttgatcgctgatgccatttatttgtttgcaggtatggcgcctaccaggcaccctctagacccggataagtccaacagggccctgggatttccagcattgatcacaggactctgccagtcgttcggagtccctgtcgcacctagtaaggtgattcggccacccatcacccgggcttttattgagaagtattgcacgcagagacaggcccagagtgatgcaccacaggccacaggcgcgccaccaccacctcatcaggctgacccagctgggtcatttgacacagagcg

SEQ ID NO: 52792 - DNA, 369 bp, Glycine max
  Peptide Sequence Number=SeqID_144477
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagtcacgacgttgtaaaacgacggccagtgaattgtaa

SEQ ID NO: 52793 - DNA, 66 bp, Glycine max
  Peptide Sequence Number=SeqID_144478
atgccagttggtctacactatcttgacccaggtatcactcctccaagacacccagtggatccataa

SEQ ID NO: 52794 - DNA, 900 bp, Glycine max
  Peptide Sequence Number=SeqID_144479
atggaagagaacctctcgcctttccttgtgagagatttcggcgcgcaaagtctcgaggttgtacaaagagtccacaaggcgtggagaagtccgttgaggaaagataaagaacttaggggcatccgtaatggcgtcatcggtggttctcatgaatggctaagagctcatacgcgagggttagattggctctccaagttgaaatttatcgatgagaagaacttcgaagctccaaaggaagatgaagaagtccaagctctaaaattagagctagggaaggcaagactcgccaaagaaaaattcaagacagccgctacaaacatccggaaagagtgcaccgagttacgagaggaaaatgcggccactgcaagagcccttgaacaagaaaccaaaagggcccgcaaggaggaacatggccaagataaattacgaggatctttgtggggcagcaacaatgagcttaagctccagagagaggaaagggacaagtcacgggtgcatggcatgatcttaaaggatgagttagctgcttgctctagatccaaaaggagtttggctcaacacttggaagccacggagcaaagcatgctagctatcatagggcaatacaaggaagagttaaaccagtcgttgacccatgaacaaaagctagtagaggacttcgcacaagcgtacgccgagaaggaagcaagagggagggtgattgatgcattgcatcaagaagcgaccatgtggatggataggttcgccttgaccttgaatggaagtcaagacctcccgcaactattagccaaagcaaaggccatcgctgaagtatgtatagcccctgaggaaattcatgagctaatcaactactgtcaacacatgatagatttgatggcccatataattagaaactgttag

SEQ ID NO: 52795 - DNA, 147 bp, Glycine max
  Peptide Sequence Number=SeqID_144480
atgtttctcttaatcaatgctttgaagggattcaacgatagtcaaggaagtaaatccaaggctgctgctagatggattgttgttaaatattttactggtcaaagaccattggaaccagagagaatgatggcaattcgcattcagtga

SEQ ID NO: 52796 - DNA, 405 bp, Glycine max
  Peptide Sequence Number=SeqID_144481
atgaagcttagagctgggacaatacagtgtcatggggcatacgtacgcctatcatggctacaagagatttatcatagtaaatgtgaggccggacactggactgtagtagctcaagtttatttgctgcatttgttaggttgcattctttttgctaacaaaagtacaacacacgtgcatgtggtgttcttggatgccttccgagacctcagtcagagtggaagctacgcatggggagctgccgcccaactgcatatgtacgataatttgaatgatgcttgtaagagctacaacagacaacttgctggatatatcacactattgaagattatgatgaaaggtcaccatgtgcctactgctggacatctaagaaggcattaccaacatcgacatattggaagcatctag

SEQ ID NO: 52797 - DNA, 475 bp, Glycine max
  Peptide Sequence Number=SeqID_144482
gcaacaaaaactttatacggataaccactcgggtatttccggccgtcagcgtgactcaaaagtcagtatgatagatcttgtgagcgcggaagatgacgtcgaagaagacgatgttagtctctgcgtgttatcaggcttttcgtcttacagaatgcaaaacgtttatacggataaccactcgggtatttccggccgtcagcgtgactcaaagtcaggcgcagaagacgacgttagtctctgcgtgctatctggcttttcgtcttacagacaacaaaaagtttatacggataaccactcgggtatttccggccgtcagcgtgactcaaaagtcagtatgacagatcttgtgagcgcggaagatgacgattttcgtcatacagaatgcaaaaagtttatacggataaccactcgggtatttccggccgtcagcgtgactcaaagtcagtatgacagatcttgtgagcgcggaggatga

SEQ ID NO: 52798 - DNA, 615 bp, Glycine max
  Peptide Sequence Number=SeqID_144483
atgaccaccctgactcagatatggatgactttgctgcttagcaacatcctgcccatcgatcataattccgacctccccctgccgaagtgtcagctggtgtacgccatcctgacgcggatgagcatccatgtggctcagttaatcgctgatgccatctatatttttgcaggtatggcgcctaccaggcaccctttggatccagataagtccaacagggccctgggatttcccgcgctgatcacaggactctgccagtcgttcggagtccccgtggcacctaccaaggtgattcggctacccatcacccgggcttttattgagaagtactgcacccagaggcaggctcaggggaatgctccacaggccgcgggcgcgccatcatcacctcatcaggctggcccggctgggtcgtttgacatgaagcagtatttacggcatttggttcgccagcaggcagccaaccaccgggcacatgtgcagacccatgattgtttgtaccagatgagcctcagcatgcagagccaaggcttcgcttctttttcatgccctactccagaccagttcagggcagaggtcgcatgggccggggattggcccgaggcccaagctggagag

SEQ ID NO: 52799 - DNA, 219 bp, Glycine max
  Peptide Sequence Number=SeqID_144484
atggggtcctatgatggtcacagttcgaccggagagggtgctacgacagtttgggtacattcagagcatccatccgccgctgttagcgcttcgttgtcatatgatgatataaatgataggtggatgcatttctcggaccatgtagtagctgcaggtgaccagcccatacatgcacctgccccagaccatgaggactacatgcaggcggacatcccagag

SEQ ID NO: 52800 - DNA, 273 bp, Glycine max
  Peptide Sequence Number=SeqID_144485
atgcaagacaaaattgattgcaataacataaatgagataagggaagagagaaatgcaaactcgatttatactggttcagccacttcccgtgcctacgcccagtcctcaagcaacccacttgagattttccactatctctgcaaatcctttacagactttgaacacaccttgggatccctcacccttgtgttcaaagattctccaagaggcaacccgtctcttgattacaattctcactatccaagagacaatcagtctcttgattacaactaa

SEQ ID NO: 52801 - DNA, 46 bp, Glycine max
  Peptide Sequence Number=SeqID_144486
atgtcgtacaggatgtcacaacatcacgcttcagaacatgcagctt

SEQ ID NO: 52802 - DNA, 879 bp, Glycine max
  Peptide Sequence Number=SeqID_144487
atgggatcaagtcaaaagccttcgcttaaaaagaggttctatcaagtcaaaatcaagagcttagaggtcaccagtttaagaaagttggggcaattaatgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaagaaggaagccatatcttttctctgggttctatccttccacgacaagagttgccaagtaccaaggaagtgtttggaggaaagggcaaaggccttggcaaatcaaggcgaatgggctttcttttattgacatcttggcgcttttgatctttggagttgtcctctttccgaatatggaagggttagtggacctagcagcgattgacactttcctcgcctttcatcatggcaaggaaagcccggtcgtcgccattttggccatgtatgacacgttcgaccggggatgtgaaaagagcagcgcaagaattgtttgttgtgcactggctctctatgtgtggttagtttcacaccttttctccaagaaggggcatctgttaattggttccctcgctagaaggaaggaagaatcaggattgtatcttcatgcgaaggatgtcccaaatgttccctggatgggaacatggggttgtattaattataatcccgtcctcgccataagacagcttggcttccccattagaggagcgacattagacgaaagcatcactcctttcattacacggggtttcagtgaccccaatgcatag

SEQ ID NO: 52803 - DNA, 339 bp, Glycine max
  Peptide Sequence Number=SeqID_144488
atgtggttgcatcaaggtatttctaagagaagcttgtcccttaccgccaacaactttgttgtggtcaacatattgtcattatcatggtttagggttggtggtctaaggtttatggttggtggtctagggtttagtgatgtagctccatgtggagcttcggaatggagaaggaagagagagaggagatgccatttcaaggagaagatgagtctagaagaagctcaccactacaagaggccatggataagagcttggaggaagaaggagatgaatgaagggagaggaagagaagagcacgaaattttgtgctctaaaagtgctctgaaatctgaagtttaa

SEQ ID NO: 52804 - DNA, 293 bp, Glycine max
  Peptide Sequence Number=SeqID_144489
atgaatgcgtattgtgcaattaaaatattgatgttcccgaccaatgctaatgcaaatgtattgaaaaatataaccgacttgttaattattcgtttgagagatgctgagacattggccactgtgtgctattttagatggaccttcatcctttatgtgcaaggggaagttgtcattaaacaccccaaacacggtagcatcccacataacctgcaacagcttaagaaaaggttgtgggatggtcaatgtcatcatatacaagggatcatcgacgtcatgattcagcctatctggag

SEQ ID NO: 52805 - DNA, 315 bp, Glycine max
  Peptide Sequence Number=SeqID_144490
atggaggctcttttgtacgtgttttgcatgcatgcagcacccaaaccgccagaaccactggcgagtttggtctctatgaacaaatcgccatttccactggcgatatatgcatgcatagggaaccgccagagatcaggccgtgcagtgcaggttcagggtcagcagagcaaatcgtcatccatattggcggtttgcgtttcacaggaatcgccagtgtggctggcgggttgtgctttgttctttacgtggtttcgctccttgtgcgtggtttctctcctcttcatgttacgtgatttctgtgtttggtttagttag

SEQ ID NO: 52806 - DNA, 243 bp, Glycine max
  Peptide Sequence Number=SeqID_144491
atgatggtggcctgggtgatgttggggcacggctacgagctcggaatgggtttgggcaagaacaatggcggtagcaccggcctagtaagggtcagaggaaaccacgagaaatttggatccgacgatgagtcccgtgaaggtactaataccggggacccgaccgtcgatttcgagcaagaagtgagtcggacggaggatgaaaaagacgaagatataaggcttcccccagagctgaaaggataa

SEQ ID NO: 52807 - DNA, 468 bp, Glycine max
  Peptide Sequence Number=SeqID_144492
gagctcgagcaagagaatgagactttgaaggggaagatagcccaacagagccgtgagttttttatccagaaccagaggatgattgagaaggacgacttgcttcgtcggaaagacgctttgctccaccgagatgctagaaggaagaggaggtttatggatttgttctcccgtgcacattcagattccgaggatccatctactccgggagttgacgaccatgatgagtgcactcctgtcagcccagaactctcaagctgtcgccgctactgtagagcagcccttggtgagcacaaccccgctatctacagtgacttctccacccctctttttgcctccaagcccgctgtatctgaagttccacctccttttgctcagcagtcagcaccggttccgcaacccaatacctctttccctcaagctgcaatgacttattcagctccactgattcacactatcaacagaggttga

SEQ ID NO: 52808 - DNA, 367 bp, Glycine max
  Peptide Sequence Number=SeqID_144493
gatccccgatctggacaaggtagaacaggaaatagaattagctactacagccatggtactgcactctcctttggaaaaagcattgattaatcatgtggaatgtcttactaaagaggaggaacatgaagtgcagacttgtattaaagagttagatggtgcaggagaaaattctgagggacaaactacatttgaagaattgaagaacggtgggaaaattgaaaaaccaacagtagaattgaagaccttgcctgtacatttgaaacacaaagctgcaattggatggcacatatctgacttgaaaggaattagtccatcttattgcatgcataaaatcaatatggaagctgattataaactagtgagatag

SEQ ID NO: 52809 - DNA, 282 bp, Glycine max
  Peptide Sequence Number=SeqID_144494
atgttggaccaatttcatctgtgcatccatgattctattgaaaacaatattgatgtcaaagcggatggtaattgtgcttatcgggcaatagctgcgttattgggtatgggtgaagaatcatggtcattggttaccatggacaagtggatgaaaattacggatatgggatatgtcattgcttcacgatacaacgtgatcattgtttctctttcacgacaacaaagcatgacatttttcctcttagaagttagctgccaccatattcttctatgcatcgtgtaa

SEQ ID NO: 52810 - DNA, 267 bp, Glycine max
  Peptide Sequence Number=SeqID_144495
atgtggaattttgaggcttctatgttcgtgtatgaagaagggaaatatgagaagtcaagaaatgctgatgggacaataaccaacaaagggattataattgatggcagatatattgagctctatgattcacaattgaaaaaaatacaggaagcacatttaaatattgaatggtcaaaaatggagctatcatatgtaggaactggaattgatgtgtcgaaagctggcagctataattttgtatctaattgcatgttagagaatgaataa

SEQ ID NO: 52811 - DNA, 552 bp, Glycine max
  Peptide Sequence Number=SeqID_144496
atgggaacaaatcaaactggaaaaaggttttatcaagtcaagattaagggcctagatatcaccagcattaaggagttggggcggttgatgggacctctccaaatgcaagccttccgcaaggtgtatggaaagattttagatttgaccatagcagagatatccatggaagtcgttgtatcactcacccaatactatgaccagcctttgagatgcttcacgtttggagacttccaattagtaccgactgttgaagaatttgaggagattctaggatgtcctcttgggggaaggaaaccgtatcttttctcctggtttcttccctccttgagcaagattgcagttgtggtcagggattcggcaagagagttggatcgtgtaaagcaaactcgaaacggcgtagtgggcctaccacggaattacttagaaggccaggcaagggatatggtgaatcaagaggagtgggtcccgtttatggacgtattggcattgctaatctttggggttgtcctttttccaaacatggatggtttggtggacctagccgctaattaa

SEQ ID NO: 52812 - DNA, 576 bp, Glycine max
  Peptide Sequence Number=SeqID_144497
atgctccagaagctccttcttcaaagcgccccgcgtctggacaaagagcgtgcgatagatggcttcgtgggacacctgcatgctcctttgctctgggtaggtccgtttgagccaaccggcgatctgctcaggcgaccatcgatgctgcagtttgccagccacgatctgcgccagggctggattgctcgccagcttgcaaggcttggggcggtgcgcacgctcccaggctgcttcatcggcgcgcgcagcccggtagcaactcttgccaccgttgcggtgaagctcacggctgacagtggatgcagctcgccccaagcgcgcggcaacgcagtggatggattcgcccgcagccaatgcccgcgagatctcctcgcgctcagcgagacttgccgatctggtgcagggtatcgcccttgctccagcgatcccacatcatcgccttctgtgcttcggtgtagtagatccgaggtcgttgcttcatggccagcactccttgcgccaggtgcagtcattgtgttgcatcgaccggttgaattcacagctggtagcggtccttcgcagtcctgtggtggttga

SEQ ID NO: 52813 - DNA, 324 bp, Glycine max
  Peptide Sequence Number=SeqID_144498
atgaaggtgaggacgtgtagtcctctaaagatgaggatgtttggtcctctgaaggtgagggcgtgctgccctctgaaggtgaggacgtgtagtcctcagaaggtgagggcgtgcagccctctgaaggcgaggacgtgtagtcctctgaaggtgagggcgtgcagccctctgatggggaggacgtgtagtcctctgaaggtgataggaactagtacccaagggtacccttatgagaaagcaagagatcgactcatggagagggccggtcatcccaaattcaaaattttggacattagatgtaggaaatctatgcagttaacatga

SEQ ID NO: 52814 - DNA, 300 bp, Glycine max
  Peptide Sequence Number=SeqID_144499
atgtggtttaattcgatgcaaagcgaagaaccttaccagggcttgacatgccgcgaatcctctgaaagagaggggtgccttcgggaacgcggacacaggtggtgcatggctgtcgtcagctcgtgcctttggaaccctgagcagactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 52815 - DNA, 576 bp, Glycine max
  Peptide Sequence Number=SeqID_144500
atggtgttagagaataagttgaaggcttgtcaaagggcgaagagaagtttgatggaacaactgagaagaacggaagagaatatgttgacaattattcatcaatataagaagaaggtgaacctagctgctagtcataggcaaaggctggaggatgaacatgcgaaggtatcggctctgcatattgaaagggaggtaagagacagggtgatagaatcattgcacggggaagctatgaaatggatggataggttcactcccactctgaatggtagtcaagagcttccaaggttgttagccagagccaaggcaatggtcgacacgtactcgactcccgatgaagttcatggtcttttcgattactaccaacacatgaatgaacgcgctttacggcacccttaccaaacgcgcgctagagctagaatcatgagcgaggtagaggaagttcaagaacaaatgaaggccgacatggaggccatggaggaccaaatagccaccatgatggaggccatgttgagtatgaagaaaataatggaaagcaatgtggttgcagttgtcactaccagcgctgcagttgag

SEQ ID NO: 52816 - DNA, 545 bp, Glycine max
  Peptide Sequence Number=SeqID_144501
agggtgaggatgaaggagaagcccatgttgtgactgccattcctatatggccaagtttcccaccaacccgacaatgtcattacttagccaataacgacccatctccttacccaccacccagttatccacaaaggccatccctaaatcaaaccacactaccaatgctaaacaccacctttagcgcaaaccaaaacaccaaccaagaaatgaattttgcagtgaaagagcctctagaattcaccccaatttcggtgtcatgtgctgacttgctcccatatctacttgataattcaatggtagccataaccccaaccaaggttcatcaacctccatttctccgagaatacgactcgaacgcgacgtgtgcttgtcatggagaagccccggggcgttccattgagcattgtagggccccgaagcataaggtgcaaggtctaattgatgcgggctggctgaaatttgagaagaatcgcgtatgggtcccaacattgacaagcgacaccacacatggggcaattttgaaagctgctgttaggtgtctctaa

SEQ ID NO: 52817 - DNA, 351 bp, Glycine max
  Peptide Sequence Number=SeqID_144502
atggttcttgggacaagtcgtccctttatacttgtcgaagtccggtactttgaatttcggagggataacaacatcgggtaccaagcagagatccgtcatgtccgcgaacggatagtcaccaaatccttccacggccctcaatctctcctcaaggagatcgagtttcctcctttcttcagttgccgggggcggtccttccatggacaaaactattggctatgccgtggggttgcgctgaggcaacgtgttgggtgccggcccctcggggatcgggggatagaacttgacatcccttcgggcatagtcttgaggatctttgatgcaatcctaccccgcaagggcattggatag

SEQ ID NO: 52818 - DNA, 252 bp, Glycine max
  Peptide Sequence Number=SeqID_144503
tctctaccggatgatgctgacatctccagaaagggtgcagatgaacacattggtctctgcttgtcaatcggacttgggactctcgggtcgctggataacaaagggtgtttgcgggttaccatcgggtgtctccgcatgccaccagactcttgggtcatggtaacaaaaggtggggtggtcaacaaaagcagggcttttgctcctatgtatcctcaatttgtgatgaggaactcagacctacgtagttcttga

SEQ ID NO: 52819 - DNA, 444 bp, Glycine max
  Peptide Sequence Number=SeqID_144504
atgacattgctacttagcaacattttgcccagcgaccgcaatgccaatctccccctgcaaaagtatcagttggtctgtgtcgtcccgacgtggggatcgcacccacaaagacacccagtggacctgaagaagtccaacagggccctgaggtttccagctctggttacgggcctctgtcggccctacagggcgcccgttccccccagcaagttcatgtcgtcgtggcatagggatcgtgcccgcaaaacactgtggacccgggagaagtccaacggggtcttggggttgccagctctgattacgggcctctgtcgattctacggggtgcctgtcgcccccagcaaggtcatcaggccccctattaaccaggctttcatcaagaagtactgcgcccccaggcaggcgcagggcgaaacaccacagcagcattgggatggccggtag

SEQ ID NO: 52820 - DNA, 912 bp, Glycine max
  Peptide Sequence Number=SeqID_144505
atggggcagctcgagcggcaagcttttcgcaaagcttacggtaaaatctgggacctagccatggtagaagtctccacagaggccattgcctccctcgcccagtattatgatcagccattgaggtgcttcacctttgaggacttccagctatcacccatggtagaagaatttgaagagatcctaggatgttctctagggggaaggagaccatacctcttttcagggttctatccctcattagctagaatttctaagatagtccagatcttggcgcaggaattagaccacagaaagcaagtcgaaaatggggtggttggaataccaagaaaatgtttggaggtaaaagcaagaatcttggcaggtagaggcgaatgggccccattcatagacattctcgcgctgttgatcttcgaaggagtcctctttcaaaatgtggatgggtttgtggacctggcagcgatcgacgcttttcttgcctatcataaccacaaggaaagcccggttgtcgctatgctagccgacctatatgacaccttcgaccgaagatgtgaaaagaacaatacaaggattgtttgctgtactccagctctttatgtatggttagtctcgcgccttttttgcccagaagtgaggcatgcttgcccattagaaagccaccattcatgcatagagaaaggaagggcgaattgggatcaactcttagcaagcaaagaaggagcatctgtcaactgtttccctcgatggaaggaaggaagaaccgaagttcttatttcatgcggaggatttccaaatgttcccttgatggggacaaggggttgcatcagctataatcccgttcttgctataagacaacttggctatcctatgagaggaacaccactagaggaagagatcgtgcctgtcatttcatga

SEQ ID NO: 52821 - DNA, 264 bp, Glycine max
  Peptide Sequence Number=SeqID_144506
atgacattatttttcatggtttacccacaagaatggcgagcttctcaaactgttagtttttctaatattcaatgtgatgttcccaaattcaaaggagataactataagatatggaaagagagaattcttctgcaattggggtggatggacatagactatgctataaggaaagacaaatcacctgcaatcacggatgaaagtagcccaactgatgttgcgctatatgagcggtgggagccaatggctcagcgtgatgttcattaa

SEQ ID NO: 52822 - DNA, 363 bp, Glycine max
  Peptide Sequence Number=SeqID_144507
atgattgagaaccccttgaatcaagaaatagctccgaaaaagcttccagccaagaggtctaggaaagatgctgttggagagggttctagtttggccccacaggtagatgtggagtttgatggacataggttccgaagtgaggaacaccagcgaagctttgaggccattaaaggctggtcgttcctcaaagagagaagagtccaactaagggatggagagtatgttgagtttcaagaggaaattacccggaggcaatgggctcaacttgtatcaaccatggctaagtatgatcccgagatagtcatggagtttcatgccaacgcctggcccacggaggagggagttagagacaaatgctcctag

SEQ ID NO: 52823 - DNA, 919 bp, Glycine max
  Peptide Sequence Number=SeqID_144508
ggaatgtcctccaccaccgctgctgttggccatcgccgccacggaccttctgaagcaccccacagcaccaattcatccttccttatcatctccaagatcatctactctattttctttagatgatcaatgtctacggtacaactctcaattttcttctaggatcatcttagaccctaagtaccgagacacagatttctttaacgatgagacatttgactattatcaagtgtttcaaaactctggattggtccatggtatttctatgatcattgatcaatctctgttcctttcattgacaaaattactcagtcaaggtgcaccttttgagggcaccattgttgatgactggaaattcgattattctagtcatgatgcttgccgtatggtttgtaatgaccaggctgaaatgaccgcctttgaggaggacttgattttgatgtgggctttccttaccggtcgtcagatcgactcggctcacttggttaggtaccgaatgcataaggcattacgggccaatgaacctctcccttatcctcaattagtcactctgtttctctgtcattttcaaattcctctttatgatgaaccttttgttcaagtcaagcgttcctttgctataggtgctggtgttgtaacttcatttggttaccataaagatcgtgatggtcaatggctgaagaaggacgcgctacctcaacaagacgagcatactccttctcctccacctcaacgagatgattcctcagcccttatgaatgaagttctttcagagttacggggcctctgcacatatgttggtgaacgattcgattccttggatggtcgctttgaaggcatggatacctgcatcacccagcttgaagaagatgtgacttatcttcgtcggtgcttcgatcttccaccgccttctaagtcttag

SEQ ID NO: 52824 - DNA, 766 bp, Glycine max
  Peptide Sequence Number=SeqID_144509
atgtcgttccacggcgggctgatcggcgtgatcgtggtgatgctgctgttcgcgcgcaagaaaggcctgcccttcttcgccgtcagcgacttcatcgcgccgctgattcccctggggctgggcttcggccgcctgggcaatttcatcaacggtgaactatggggccgcccgaccgacgtgccgtgggcgatggtgttcccgagcagcggcgacggcatcgcgcgccatccgtcccagttgtatgaactggggctggaaggcatccaagccgcgcccgctggggcaggtgagcgcggtcttcctgatgggctacggaacgttccgtttcctggtggagttcacccgcgagccggacaacttcctgggcctgctcgcgggcggactgagcatgggacagtggctgtccctgccgatggtcgccctgggcgccatcatgttcgcgcttactgcaaaacgatcgtcccgttgacggcgacgctgaccgcggtagcccgaaaagccgaaggcgttggcggcagccagcgcgcgatccttgaaggcctgcgcggcttccttgagcagcttgcgttcctcggcctcgcgcacggcgcgcgacagcgagaagctgatgttggaaatggcggtcttgtcggacagcttggacgcgagcgcggcggcggccgtgaaatccttggattcgaggatgatctcgccctggccgcgccaggtggtgctggtcttgcctttgctgctgctggtggaattgggccagacgttgaagctgccc

SEQ ID NO: 52825 - DNA, 345 bp, Glycine max
  Peptide Sequence Number=SeqID_144510
atgccgatctccccctgtgaaagtatcagttgggatcacacccacaaaacactaagtggacccagagaagtccaacagggccctggggtttccagctctggttatgggcctctgtcagtcctaccgggtgcccgttccccccagcaagggatcgcacccacaagacacccagtggacccggaggagttcaacagggcccgggggtttccaactctgattatgggcctttgtcagttctacggagagcccgtcgcccccaacaaggtcatcaggccccctataaaccgggctttcatcaagaagtactatgcccctaggcaggcgcagggcgaggcatcacagtag

SEQ ID NO: 52826 - DNA, 902 bp, Glycine max
  Peptide Sequence Number=SeqID_144511
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgatcataatggaacatgtagaccatgtagttgaggaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 52827 - DNA, 330 bp, Glycine max
  Peptide Sequence Number=SeqID_144512
atgtgcaagtgccgttcacatggaacctttcccctcttcggccttcaaagttctcatttgaatattgctactaccaccaagatctgcaccgacgaccgctccgcccgggctcgcgccctgggttttgcagcgaccgccgcgccctcctactcatcggggcttggtccttgccccgacggccgggttagcgcgcagttgggcaccgtaacccagcttccggttcatcccgcatcgccagttctgcttaccaaaaatggcccacttggagctctcgattccatggcgcggctcaacagagcagccgcaccgtcctacctatttaaagtttga

SEQ ID NO: 52828 - DNA, 336 bp, Glycine max
  Peptide Sequence Number=SeqID_144513
atgaagaaaagagaaacccctaaggttcacacttgcacatttgagaagcaaactcatttggctaagagctcgtggaagatgcccaaacatttgacgttagtctctcatgcaaactctttgagattgctttcgaatccaagggtagctttgttacgtaaattctgtcaagatcaacccttgccatcaagtttcagtggggtcaatagacccctggcatcactctatgaccttaaatcaagaaagtttcaattggtcatacaccaaagtgtgacaatccattgccatccttcaaacggtgcatgcgatcgatcccgagccatctcgctcgatctatag

SEQ ID NO: 52829 - DNA, 222 bp, Glycine max
  Peptide Sequence Number=SeqID_144514
atggcgagggcgtgtagccctctgaaggtgaggacacgcagtcctctgatggcgaggacgtgtagccctctgaaggtgaggacatgcagtcctctgaaagtgaggacacacagtcctcttaagattgactgcccttttgaaaaaggtgataattcatgcaacctcatcctatccttttgcaaatctctccgggaactccctcagagtgtatgttctttttga

SEQ ID NO: 52830 - DNA, 252 bp, Glycine max
  Peptide Sequence Number=SeqID_144515
atggagaacacaagaacagccctaagcaataacattcatgtggctccgaaaaacgccctaagtgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaaggtattag

SEQ ID NO: 52831 - DNA, 426 bp, Glycine max
  Peptide Sequence Number=SeqID_144516
atggtgaaagtgggaacctcttacgtgccgatcaacgtgtcatcttcgccaaaagttggcccagggcttcccgtgtatgatggtgtttttgaggtgctccagtggcttccgtttctatcagctgtccctcctgttcagctacccacggggtggtgcgtaacggcaaaagcacccccggacatcagcgctggcaaagcagaggtcacgctgcgcgtaaccaccacacccgccgcaattaatgcgcctttacagggcgcgttccattcgccattcaggccgggcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 52832 - DNA, 519 bp, Glycine max
  Peptide Sequence Number=SeqID_144517
atgccaccgccgtcttccgggggcattcacattgtgcagatcctcaacattctcgaaaactttgatatgcacaagttcggcttcggcagtgcggatgccatgcagataatggcggaagcggagaaacgcgcctacgctgaccggtcggagtacctcggcgacccggacttcgtgaaggtgccgtggcaggcgctgaccaacaaggcgtatgccaaatccattgccgatcagattgatatcaataaggcgaagccgtcgagcgagatccgccccggcaagctggcaccgtacgagagcaaccagaccacccacttctcggtggtggataaagacggtaacgcagttgcggtgacctatacgctcaacaccacgtttgacctggctggtgacgggcagtccgggcggcagccggattatcaccaccgtactgcagatggtggtgaacagtatcgactttgggatgaacgtcgcggaagcgaccaatgcgccacgtttccatcaccagtggctgccggatga

SEQ ID NO: 52833 - DNA, 756 bp, Glycine max
  Peptide Sequence Number=SeqID_144518
atggccccgaggaagcttgcctcaagaggtccaggaaggacaaggcgaccgaaggaactagttccgctcctgagtatgacagtcaccgctttaggagcgttgtacaccagcagcacttcgaggccatcaagggatggtcatttctccgggagcgacgcgtcgcggcggtgggcatcactagttacccccatggccaaatttgatccagacatagtcctcgaattttatgccaatgcttggccaacagaggagggcgtgcgtgacatgaggtcctgggtgaggggtcagtggatcccgtttgatgcagatgctatcggccagctcctgggatatccgttggtgctggaagagggccaggagtgcgagtatggccagaggaggaaccggtctgatgggttcgatgaggaggccatcgcccagttgctatgcataccggggcaggattttgcccggactgctgcagggaggcgagtgcgaatcatgcgcaccaacatgaccaccctgactcagatatggatgactttgctgctcagcaacatcctgcccaccgatcataattccgacctccccctgctgaagtgtcagctggtgtacgccatcctgacgcggatgagcatccatgtggctcagttaatcgctgatgccatctatatttttgcaagtatggcgcctaccaggcaccctttggatccagataagtcaaacagggccctgggatttcccgcactgatcacaggactctgccagtcgttcgga

SEQ ID NO: 52834 - DNA, 219 bp, Glycine max
  Peptide Sequence Number=SeqID_144519
atgcctataggttggacctcccagaagagtggagctgatattgaaaaggaggaactaactaatttgaggtcaaatcctcttcaaggggaagggaatgatgcaatcctccctaggaagggaccagtcactagagccatgagcaagaggctccaagaggattgggctagagctgctgaagaaggccctaggattctcatgaacctcagggtagatttctga

SEQ ID NO: 52835 - DNA, 129 bp, Glycine max
  Peptide Sequence Number=SeqID_144520
atgttagtgaaaaacctcgtcgggcacccaggagtacaagacaagacagaccacacactggtaagtcaagtcactctcaccaggcttaaaggaacactcaaaccgggtatatttactcccaaggactag

SEQ ID NO: 52836 - DNA, 90 bp, Glycine max
  Peptide Sequence Number=SeqID_144521
atggctctaaccaatgttgaccgaaaaactctagtagatgtcgactctttggctgaagttggctggaaaaacctagctgacgtcagctga

SEQ ID NO: 52837 - DNA, 375 bp, Glycine max
  Peptide Sequence Number=SeqID_144522
atggagtttgacaatcaccggttctggagtgccgaacaccagcagcgcttcgaggccatcaagggatggtcgttccacagggagaggcaattccagctcagggaggatgagtaccctaacttccaggaagagatagctcacaggcattggaaacgactagtgacccctatggctaaattcgacccggagataggggttcaagacatgcgctcatgtgtgaggggtcactggatccccttcgatgcagatgccctcagccagttcttgggatttcgcccgaaccgctgcgcggaggtgggtgcggatcatgcgcaccagcataactaccctaacccagatatggatgacactggtgctcagcaacgtcttgcctag

SEQ ID NO: 52838 - DNA, 774 bp, Glycine max
  Peptide Sequence Number=SeqID_144523
ccgcgcatacagtggcagtacctcggtgttgcggtactttcgccgttccagcgactggtgcgcatcgcggatctcgcgctcgcccggcaggaagatcagcacgtcgccgcgtgcatccaggcgggtaatctcgtcgacagccgacacgatggcatcgttgacggtacgttcgccctggtcttcaccctcgccttccagcgcgcggtagcgcacctccaccgggtaggtgcggccctcaacgctgatcaccggcgcattgtcgaaatgctgggcgaagcgtccggtgtcgatggtggccgaagtgacgatcagcttcaggtcggggcgcttgcgcagcagctgcttcaggtagcccagcaggaagtcgatgttgaggctgcgctcgtgcgcctcgtcgacgatgatcgtgtcgtagttcgacaaccaacggtcgctggcgatctccgccagcaggatgccgtcggtcatgaacttgatgcggctgtcttcgctgaccttgtcgttgaagcgcacctggtagccgaccagctggcccagttcgctctgcagttcttgcgccacgcggctggccaccgcacgtgcggcaatccgtcgcggctgggtgcagccgatcatgccggcctggccacggcctgcggccaggcacagtttcggcagctgggtggtcttgcccgaaccggtttcaccggcgatcaccacgacctggtggtcgcggatcagcccgatgatcggcgtcggcttcacgcgcaatcggcagctgcgggtccagagtaa

SEQ ID NO: 52839 - DNA, 372 bp, Glycine max
  Peptide Sequence Number=SeqID_144524
atgccacctaccaggcaccctctagacccagataagtctaacagggccctggggtttccagcgttgatcacgggtctctgccagtcattcggggttcctgccacagctagtaaggcggccaaccacagggggcaggtgcagacccatgagtgtctctaccagctcagcctcagtctgcagagccagggtttcgctccttttgcgtgccctacttcagatcagtttagggctgaggttgcatggcccggagattggcctgaggcccaggcaggggaggcgcccgtagaggctcccggcgacgcggaggaggtctgcatggatgaggagatgtcagatttactcggtttcttgggagggagtggagccacatga

SEQ ID NO: 52840 - DNA, 366 bp, Glycine max
  Peptide Sequence Number=SeqID_144525
atggtagcacgggttatgctcaagcacggttatgagcccggaatgggtctaggcaaggacgaccttgggaatgccgacgtggtcgatattaggggaaacccatacaaatatgggttggggtatgaacccgggatgccgggaaggaggaatgcgccgtcaagattctgggcggatagggcatggcccggccatgttagccagtgtttcaccagtgctggaataatgtttgaggaagaggtggcagcaataggagaggagttccctcaagacccgccaaatttcgtgcggccatgccatcccgattcccaagtggggaactggcgcgtgataagccagtcagaggtctatactgctgattcaatgtaa

SEQ ID NO: 52841 - DNA, 159 bp, Glycine max
  Peptide Sequence Number=SeqID_144526
atggaggattgggggaattttctccaccaaatccttgaggaggattctgaggattccactccaattaaagtgttcctcttggtgtgggggttcggcagcaagcaacggcggctcgcggcggccattgatggtcttgggtggtggagaaatcttgcttaa

SEQ ID NO: 52842 - DNA, 1020 bp, Glycine max
  Peptide Sequence Number=SeqID_144527
atgtcgctggccgataaccctgtgctgcacacccaccttcccggctcgccgggaatggggaaaagcagcacgccgtttctggtgcgggcgcaggagatcatccgcctggaaaatcctgccatcaatgccgcgcaactggcagccgcactgaacgttaccgggcgtaccctgcagcgcagaatgaaagccctgtcgcaggagacgccaaaagagtttattacccgcatccgcattgaactggcctgtaccattctggccagcaccgacgtcagcgtgcgtcagaccgccatgcagtgcggctacagcgaagataccgcctttcgtaaagccttccatcaggtgatggcgatgacgccggcccagtatcgtgagtggatagcacaccgtaaggcgcagatgatgaatattactcaaagacttaccctggctttcattttgctctcagcttcactggtggtgacgggtattatttctgtgcgactgctgggcggttttcaggaccgttttgaatacgtacaggctaacgcaattccttctattcgcgatttatccgagctgatcgatcgcagcaataaactctctctgtcgctatataagcatcaaagccagactgacaatgcgcgcatgccgccggtcgagaaagagatcgcccagcgcctggccgatattaaaacgctggcagaatattatttagccaatgatatctccagcgacgaagacaagcagatcaccattaaaggcctggcgacgctgcggctggtggagtcgcggttgccggcgtttcttgctgcttcacatgctcatcaggatgacgtcacgctcggcatgctggaagccgaaagcggtattggcggcgccatcagccagttaaaaaatgattatcgccagcagatggcgcttaatttgtcgctgggtgacggcttgcgcgtggtgaaccaggagatttatcaccgcacattctggggattgagtgccggggtcgcggtgacactgctgttactggtacgctcaccgcgttaa

SEQ ID NO: 52843 - DNA, 961 bp, Glycine max
  Peptide Sequence Number=SeqID_144528
cacctatcaaggcggcgggcgcggtgcggcaggagcacttctcacgctttgccgggcgggttggcctgttaacaatcaggccggtgaccgcttgctccagcaggcggatttgattatcaccattggttacagcccggtggagtatgaaccggccatgtggaacagcagcaacgccttgctggtgcacatcgacgtgctgcccgccgagaccgataaccactatcaacccgacgccgagctggtgggtgatatcgccggtacggtgcgaaaaatcgccgcgcaaatcacgtcaccgctgcagctcagcgatgctgccgccaccattctgcaggatcgtcagcaacagcgtcagctgctggcgatgcagggcgccagcctcgatcagttcgccctgcatccgctgcgtatcgtccgggcgatgcaggacatcattaacagtgacgtcagcctgacggtcgacatgggcagttttcatatctggattgcccgttacctctacagctttcgggcacggcaaatcatgatttccaacgggcagcaaaccatgggcgtggcgctgccgtgggcgattggcgcctggctggtcgatccgtcccgtaaagtggtttcggtgtcgggcgacggcggctttctgcaatccagcatggagctggaaaccgccgtcaggttaaaggccaatattctgcacatcatctgggtcgacaatggctataacatggtggcgattcaggaagagaagaaataccagcgcgtgtccggtgtgaactttgggccggtggatttcaaagcttacgcgcaggcgtttggtgccgctggattttcggtgaacagcgccgctgaactggaacccacgttgcggcgggcgatagaggtggaaggaccggccgtggtggctatcccggtagattacagcgataacccgctgctgatggggcagctgcacctcagccagctgctttga

SEQ ID NO: 52844 - DNA, 641 bp, Glycine max
  Peptide Sequence Number=SeqID_144529
gatcagggcctgtggctggcgttccagccgaagatctgcctgaacagtggccggcccgttggcctggaggcactggtgcgctggcggcatccgcagcgcggcgaactcgctcccgatctgtttatcccgctggcggaacagaccgagctgctcagtgctttaaccagctgggtgaccgacaaggcgattggcagaccgagcagattattaacagtcccgccgcgctacaggggctggagatgctcaagctgcgtgggtttggcatctcgctggatgactttggcaccggctacagcaatatcggctatctgcgacggatgccgctggatgtgatcaaacttgatcgcgcgctgatcagcgaaatcgcctcagacaccgcgtcgcggattatcgcgcgcagcatcattaccatgctgaaacagctggattacaccgtactggctgaaggcgtagagaatgtcgacaccgttgccgcgctggcggagtacggctgcgatcaggcgcaggctcgcggcacaaagctgaggtatggttcagtgtacgccggggagcgtctggagcagattcagtggcaatacgatgagtctgttggcttaaagcagaatgatactttaaaggtgaaacagaaatacccggcttag

SEQ ID NO: 52845 - DNA, 2403 bp, Glycine max
  Peptide Sequence Number=SeqID_144530
atggcactgcccacatttgaccctgaccgtttttctgccgcgctggtgcgccagtggcaacgttttggccttccggatgcgcaggaaatgagccccgaccagtggtggcatgcgctgagcggcgcgctggccgaactgctggcggatataccggtgcagccggccgctggcggacagcgccacgttaattatctgtcgatggagtttctgctgggcaggctgaccggcaacaatctgctgaatctcggctggtacgacggcgtcaaagcgacgctggccgcagcaggcgtgacgctgagtgacgtgctggagcgtgaaaccgatccggcactgggcaacggcggtctgggacggctggccgcctgttttctcgatgcgatggcgaccaccggccagcctgcgatcggctatggcctgaactaccagtacggcctgtttcgccagcattttgtcgggggcgcgcagcacgaacagccggatgactggcagcgcgatcgttatccatggtttcgccacaacgcggcgcttgacgtgcaggtcggactgggcggcagtgtgaccagcattgacggcgtgacgcactggcagcctgcttttgttgtgcagggtgaagcctgggatctgccggtggtcggtttccgcaacggcatcacgcagcccttgcgtctgtggcaggcaaagcatgcccgtccgtttgatctccagcgtttcaataacggcgattttctgcgtgcagaacagcaaggcattgaggcggagaaactgaccaaagtgctctacccgaatgacaaccatcaggccggcaaaaagctgcgtctgatgcagcagtatttccagtgtgcctgtacgctggcggatattctgcgtcgtcatcaggcggcggggcgagccatcgaaacgttagcggattatgaagtgatccagctgaacgatacgcatccgacgctggccatcccggagctgttgcgcctgctgctggatgagcaccggctcagctggcaggacgcctggcgcattacccagcgcaccttcgcctataccaaccacacgctgatgccggaagcgctggagtgctggaacctgcgcctggtgcgcagcctgctgccgcgccatctgctgatcatcaatacgctcaatgcgcagctgaaacagcaggttgaggcacgctggccgggtaatcaggcgatctggtcaaaactggcgctggtgcacgatcagcaactgcgcatggcaaatctgtgcgtggtcggcagctttgcagtcaacggtgtggcggtgctgcactcgcgactggtggtacaggacctgttccccgagtatcacgcgctgtggccggagaagtttcacaatgtcaccaacggcatcacaccgcgtcgctggatcaaccagtgcaatccggcgctggcggcgctgatcaacaaaacgctgcagcgtccatggcttaacgatctcgatgcgctgcaggatctgacgccgttcgccgatgatgccgccttccgcgccgaatatcgcgccattaagcagcacaacaagcaggcactgacagagtggatcgcctcccgaaccggcattgcggtgcagcctgatgcgctgtttgacgtccagattaagcggctgcacgaatacaaacggcagcacctgatgctgctgcacatgattgcgctgtggcaaacgctggtcagtgatccgcaggccaatctggctccgcgcgtgatgctgtttggtgccaaagcggcgccgggttatgcgctggcaaaaaacatcatctacgccatcaataaagtggcggaaaccatcaaccacgatgcgcgcgtcggcgaccggctaaaaattgtttttatccctgattacaacgtgtcggttgccgagcacctgatcccggccgccgatctctcggaacagatctcgactgcaggcaaagaagcatccggtaccggcaatatgaagctggcgctgaacggcgcactcaccatcggtacgctggatggggccaacgttgaaatcgcgcagcaggtcggtgaagagaatatcttcatctttggccataccgtagagcaggtcagcgcgctgaaacaggccggttactcgccattgaactggcgcagtaaggatgcgcagctggatcgcgcgctgaccgcgctggaagatggcaccttcagtaacggcgaccgcacggcgtttagcgatctggtcaacagcctgggcgcgcaaggcggcgatccttatctggtactggctgattttcgccactatctcaacgcgcagcagcaggttgaagcgctgtgggccgatcctgaggcctggacgcgcgccgcaatcctcaataccgcgcgttgcggcatgttcagtgccgatcgcgccattcgtgactatcagcaacgtatctggcaggccagccgctaa

SEQ ID NO: 52846 - DNA, 918 bp, Glycine max
  Peptide Sequence Number=SeqID_144531
atgagtggacccttcggcgcacagaaggaaatcttggtgcgcgctgctgaccggcgtcattgcgccagtccaggccgacatcaatctggtgccgcagaatctttccgcggcgccgtccattcccaccgcgcggctgcagcagctcagctggcagccggtggatgcaacgcgtgcacaaaccaccacgctgacacaaagcgcaacgccgctggatgtacgtggcgtaacacgggggccattgcggcttacagcctgcctgccaatcagggcgagctgaaggttacgctgagcagcgaggtggtacacaatcaggtctttgcgccaaatgtgctggtactggatgaaaacctgcagccggccgcgtggtttccgagccgcttctttagctatcagcagcccggcgtgatgagcgccgatcggctggaaggggtgatgaagctgacgccggtgccgggccagcagaagatctatttgctggtgttcaccaccgaccaggatttaacccagaccaccacgttgctggatccggccaaagcttatgccaaaggcaccggccatgcggtaccggatattcccgatccggtggcgcgtcacagtcgcgacggcaaaatcaaactgaaagtggcaaccagttccggctcgtcgatactggtcggcccgctgtttggctcagccgcgcctgccgccgtgaccgttggcagcacccggccggccatggccgccacgacggcgcgcgcgccagcgcctgaaccggcaccgctggtgaatgagacggaaagctatttcaatcagagcattcgtcaggcggtgcaacagggcaatatcgataaagcgctgaagctgctggatgaagcagagcgtctgggatcgacctcggcgcggcaaacctttatcagcagtgttaaaggcaaggggtga

SEQ ID NO: 52847 - DNA, 1141 bp, Glycine max
  Peptide Sequence Number=SeqID_144532
atgagttcgctgcgccagttttccggcacgcggccgctgtatgtgctggacgcaccgggacagctgagaaatcagcaaaacggcgcccgctatcaggccaaccgggacacggggttctatcagcagatcaacgccgatggcagctgggccagcgaacagctcagccccggctttaccgttggcgcgggctggaaaaactttgcccgcgtgttcaccgacgagggcattcagaaaccgttcctggcgatatttggctggacgctgctgttttcgctgttgaccgtgctgctgacggtcgcggtgggcatggtgctggcgtgtctggtgcagtgggaagcgctgcggggcaaggccatctatcgcgtgatgctgattcttccctacgcggtaccggcattcatttcgatactgattttcaaggggctgtttaaccagagttttggcgaaatcaacgtcatgctcaatgcgctgttgggctttaagccagcgtggttcagcgatccgacgctggcgcgcgccatgctggtgatcgtcaatacctggctgggttatccctacatgatgatcctgtgcatgggcttgctcaaggcgatcccggacgatctgtatgaagcgtccgcgatggatggcgccgggccgctgcagaatttctttttgattacgctgccgctgctgctgaaaccgctattgccgctgatgatcgccagctttgcttttaacttcaataacttcgtactggtgcagctgctgactaatggtggccccgatcgactcggcaccactacgccggcgggctacaccgatctgctggtcaactacacctggcgcatcgcctttgagggcggcggcggtcaggacttcggcctggcggcagccatcgccacgctgatcttcctgctggtcgaagctgcgtctgctgctgacgcatctgctgctgctgctgtttatcgcggcaattctgttcccgctgctgatggtgattgccatctcgctacgcagcggcaatttcgccaccggcagtctgatcccggaacagatttcatgggaacactggcggctggcgctcgggttcagcgtcacccatgccgatggtcgcgtgacgccgccgcccttcccggtgctgctatggctgtgggattcg

SEQ ID NO: 52848 - DNA, 480 bp, Glycine max
  Peptide Sequence Number=SeqID_144533
atgcagtgtggggacatgaatcccagtccaatgccttctcatgcctccttccttttccagaaaaccagggaaaattctggcttgctttcttcttcctaccttggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 52849 - DNA, 222 bp, Glycine max
  Peptide Sequence Number=SeqID_144534
atgggggtgcaaatagcacccaggcccacttgggccctccagaatattcctccagaaggctgttgcttctggaggaagcaacctggctcgcctggaaaatctaagccgaggcgcttccgaaacgtttccgtaacgttttccgtgaggaatttcgcaaaggttttgaccgttcttcgacgttcttcattcgttcttcatcgttcttcgatcttcaacgggtaa

SEQ ID NO: 52850 - DNA, 240 bp, Glycine max
  Peptide Sequence Number=SeqID_144535
atgactgcaaccacattgtggagatcgtgtttgtggagatcgccttatccattgaggtcgaagaaaagtaggaaaggaaagagtcctggaaagggtactccctgggcgtgtttctccttctgcatgagttcgtgtttgtcgcaaattgggctgcgcttccgtcactgcaaccacattgtcgagttcgcgtttgtggagttcgtgtctgcgcttccatcgaagttaggcacaaagggttaa

SEQ ID NO: 52851 - DNA, 468 bp, Glycine max
  Peptide Sequence Number=SeqID_144536
atggcaccagctgattctaaggacattgtggcagacattcctgcggacacaggcgcggaggctgctgaggctgagcatgagggatttccgggtggtccgagcgacccatccgtgttgacccagtatgcggatcacgttgcttgcagcgtatggacgagagaggagtgtcctgagttgaagttatcctctcacgggaggaaggtccatagtttaggcaggtctgtccttgccattgagggactcgttgttgggacagaactaagtcctctgatcatgtgttcggtagacactggcgatcgaggacttttgtcctcgtttgtggagcggtggcaccgagaaacatctagtttccatctcccggtgggagagctcacgatcacgctagacgacgtctcctcgcttctccatttgcccgtggttggcgacttgcacgcctttcagcccttgcacgtggacgatacggtttag

SEQ ID NO: 52852 - DNA, 231 bp, Glycine max
  Peptide Sequence Number=SeqID_144537
atgtcgaagaacggttggaaatcttcgcgtaattactcacggaaacgttacgaaagcgcctcagcttggactttcttcacggaaacaattttcctcagcaatttcgagagaatcagaagtgccaagaaggctgaaccccagctctctcaggcgagcaaggttgcttcctggaggatgaaactggaaagcccaagtgggcctgattgctatttgtacccccctttttactaa

SEQ ID NO: 52853 - DNA, 825 bp, Glycine max
  Peptide Sequence Number=SeqID_144538
atgggatcaagtcaaaagccttcgtttaaaaagaggttctatcaagtcaaaatcaagagcttagaggtcactagtttacgagagttggggcaattaatgggtcaacttcaacggcaagccttccgcaaagcctatggtaagatttgggacctagctagggtagaagtctccacagagtccattgcctcccttgcccagtattacgatcatccgttgaggtgcttcacttttggggacttccaactatcacccatggtggaagaattcgaagaaatcctaggatgtcctctagggggaaggaaaccatacctcttctcagggttctatccctcattagctagaatttctaaaatattccaaatcttggcgaaggaattagaccatcaaaagcaagtcgaaaatggggtggtcgggataccgagaaaatgtttggaggcaaaagcaagaatcttggcaggtagaaacgaatgggccccattcatagacgttctcgcactgttgatctttggaggagtcctcttttcgaatgtggatgggttggtggacctagcagcgatcgacgcttttctcgccttcatcacaaggaaagcccggtcgtcgcctttgcatgtagccgacctatatgatacgttcgaccggggatgtgaaaagagcagcgcaagaatttgtttgttgtgcactggctctctatgtgtggctggtttcacaccttttttctccaagaaggtaggcccgtctatccgctacaaggtcaccgctcgtgcgtcgaaaagggaaagggtaattgattcattgcaccaagaggcaacaatgtggatggactga

SEQ ID NO: 52854 - DNA, 269 bp, Glycine max
  Peptide Sequence Number=SeqID_144539
gactgacaaaggcccgcaaccagagctggaaaccccagggccctgttggacttctccggtcgctgggcagaatgttgctaagtagcaacatcatccatatctgtgtaagagtggtcatgctggtgcgcatgatccgcactcgtctctttgcagtggcacaggtgaaatcttgccccggtatgcatagtagctgtgtgatagcctccctctctggtggtgctcgcacagttgaccctcttccaggatcagggggtggccccaggaactga

SEQ ID NO: 52855 - DNA, 139 bp, Glycine max
  Peptide Sequence Number=SeqID_144540
ccagcagtatcagcgcgtggcgcagcagaacaatctcaccaccgccgaggtggcgcgcatcgccggcgagaagctggttaaccgtgccggcagcggcgaatatgtgcgcgggataaatggtcagtgggtgcagaaataa

SEQ ID NO: 52856 - DNA, 244 bp, Glycine max
  Peptide Sequence Number=SeqID_144541
atggaggaagactcactccacgtgccagtgatggaaaggagttgtacaactgatggagatatattacacttagttagggatgcttttgaaaatgagaatgagataaatgtttattttcatcatgaagtagatccaattttagaagaagtcccacagatgttgtacttggaatgtgatccaattccaaaagctattgagaatgaggatgatttagatgatgtacctgttgctggccatgaggaag

SEQ ID NO: 52857 - DNA, 189 bp, Glycine max
  Peptide Sequence Number=SeqID_144542
atgacagatcttgtaagtgcggaagatgatgcaaatctccgcgtgtcatcgggcttgtcggccgcgattgacgaaggaatgaccataatttgtctccgcatgtcatcgggcccgccgcctctggatgaaaaaagggtgcagaatgaccataatttatctctgcgtgccatcggacacgactgtgtctga

SEQ ID NO: 52858 - DNA, 327 bp, Glycine max
  Peptide Sequence Number=SeqID_144543
atggccagtgatagtgtggaacactgtcgttttaaattagacactatgaaaaggggcgagtttttgtgggtcccttacttcgaagaagtccaagcattgttgagtcatttatgttttgttggatctgcaatctggagatgtgtagtgtcgatgatttgtttcaatgttgttgaatggcatcatccagatagagtcatgaggcaatttggactacaacaacctatacatggccctctattgcaacctagcaatatacatggcctaacactaaaaggaaaaaatggacataattggaggcgactacagcagccagtgcttaatgaatag

SEQ ID NO: 52859 - DNA, 496 bp, Glycine max
  Peptide Sequence Number=SeqID_144544
cacacaaccaatgaacaacataataagggtcacaatccaagcacttgccgccgttctcggtggtacgcaatcgttacatacaaacagctatgacgaagcattagctctaccaaccgaagaatcagcaagaattgctctcagaacacaacagataatcgcctacgaatcaggtgttgctgatacaattgacccattagcgggttcatacgtaatagaagctatgacaaacgagatagaaaagagagccatggaatacatcgaaaaaatagaccaacttggtggaatggttaaagccatagaaatgggatatgtacaaaaagaaatccacgaaagtgcatacaaacaccaacttgcagtagagaaagaagtagcagcaacagatgaaaatctcttcccatacgtacttgaagcagtaaaagcatatgccaccgttggagaaataagcaacgcattaagggaagtattcggagaatacactgaaacagtcatagtttaa

SEQ ID NO: 52860 - DNA, 203 bp, Glycine max
  Peptide Sequence Number=SeqID_144545
ttcctcatttgaggatacgtaggagcaaaagcctcgcttttatcgaccacaccgctttttgttaccatgacccaagagctgaggccaattatggtcattctgcacccttttgtcatccagaggcggcgggcccgatgacatgcggagacaaattatggtcattccgcacaccttttgccattcagacacagtcgtgtccgatg

SEQ ID NO: 52861 - DNA, 99 bp, Glycine max
  Peptide Sequence Number=SeqID_144546
atggtgataataggccttgcatctatactgcagaatcctggaattgaatacctcacatgtgttgttgcatatgttgtccactttgggtattgtattgaa

SEQ ID NO: 52862 - DNA, 707 bp, Glycine max
  Peptide Sequence Number=SeqID_144547
cctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggatgatcatgggatccttttctatcagataggaagggctgtttcacaaaatgtacttctaagtaattgctccatagatcctatatctatctatatgaagaagaaatcatgtgacgggggggattcttattgtacaaatggtactcgaactggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgagtgacattgcttcttcggtcatttcgggacaagcggatcatttatgatgaagaggatgagcttcaagagaatgattcagagttcttgcagggtggaaccatgca

SEQ ID NO: 52863 - DNA, 948 bp, Glycine max
  Peptide Sequence Number=SeqID_144548
atgaggtcctgggtgaggtgtcagtggatcccatttgatgcagacgctatcagccagttcctgggataccctttagtgctggaagagggccaggagtacgagtatggccagaggaggaaccggtccgatgggttcgataaggaggccatcacccatttgctatgtataccggggcaggattttgcccggactgctgccgggagacgggtgcggatcatgcgcaccaacatgaccaccctgactcagatctggatgactttgctgctcagcaacatccagcccaacgatcataatttcgacctccccctgctggagtgtcagctggtgtacgtcatcctgacacggatgagcattcacgtggctcagttaatcgctaatgccatctatctatttgcaggtatggcgcctaccaggcatcctctggacccggataagtccaacagggccctgggatttcccgccttgatcataggaccctgccagtcgttcggagtccccgtcgcaccaagcaaggtgattcggccgcccatcacccgagcttttattgagaagtattgcacacagagacaggcccagggggatgctccgcaggccgcagatgcgccgccacctcatcaggctggtccagccggatcgtttgatacggagcagtatttgcggcatttggttcgccagcaggcggccaaccaccgggcacatgtacagacccatgattgtctttaccagatgagcctcagcctgcagagccagggttttacttcttttctgtgccctactccggaccagttcagggcagaggtcgcatggcctggagattggcctgaggcccgggcagtagaggcacctgcagagacaccagcagaggctcccgacgaggcagatgaggcccgcgaggacgaggagatggccgatttacttgatttcttaggagggagcggggccacatga

SEQ ID NO: 52864 - DNA, 240 bp, Glycine max
  Peptide Sequence Number=SeqID_144549
atggcagcggaatggagaaggaagagaaagaggaaacgccgcttcaaggagaagatgagtctagaagaagctcaccaccataggaggccatggataagagcttggaggaagaaggagatgaatgaagggagagagggagaagagcacgaaattttgtgctccaaaagagctctgaaatttgaagttaatattcaaataatcaaagttgaaaaaatgcacacacatggcctctatatatag

SEQ ID NO: 52865 - DNA, 602 bp, Glycine max
  Peptide Sequence Number=SeqID_144550
tgtgtgcatcccaagtgagcgtgagacacttttgaagtttaagaataatctcatagatccttccaataggctttggtcttggaatcataatcataccaactgttgccactggtatggagtcctctgccacaaccttacttcccatcttcttcagcttcacctcaacacttcagattctgctttctatcatgaccatgatggctatctctactcagacttcgatgaggaagcttatgagaaatcccagtttggtggagtgataagtccttgtttggctgatttaaagcatttgaattacttggacttgagcggcaatggatttcttggagaagttcgtgtttctgccaacggaacagtaccctctcagatcgggaatctctctaagcttcgatatcttgacttgagctacaatgattttgaaggtatggcaattccttctttcctttgtgcaatgacctccttgactcacctcgacctctctcatactggattcatggggaagattccatctcagattgggaatctctccaatttggtctatcttgacctcggaaattatttttccgaacctctgtttgctgaaaatgtagaatgggtatcaa

SEQ ID NO: 52866 - DNA, 54 bp, Glycine max
  Peptide Sequence Number=SeqID_144551
atgtcggggcgttcctccactcgccaattccccaactggaatcaggagggcaag

SEQ ID NO: 52867 - DNA, 330 bp, Glycine max
  Peptide Sequence Number=SeqID_144552
atgacccctgctaaagccaggaatttaattgagaagatggtttccaactcccaaggagtgcatgaagtagccacgaattcatcttcatcagctgaaactaagaagcttgaaggtaaactagatgccttggttaacctagtaacccaaccggccttgaatcagaaatctgtacctgtcgcaagagtctgtggtttatgctcctctgccgaccaccatacacacctttgcccttttatgcagcattctggagcaactgagcaacgtaaagcttatgctgcaaatatttacaatagacctcctcaacctcagcagcaaaagcaaccacaatag

SEQ ID NO: 52868 - DNA, 273 bp, Glycine max
  Peptide Sequence Number=SeqID_144553
atgactttttttcttgggagaccccattgttccttctttcgaggacagggatggaaaattctcatcctgggtcaaggtttatggtggtttgaggtcttgggtcaaaaggcttgcagaatggccggacatgatgtgtcgcaacatgcccttttgcgggcgagcgaaggcgaggctcacgggtgcgctttccaaaggaggaaagatacgcggagtcgccaccaacgtttgtttgtggaaaacgtcggaaaaaccgaaggaaaccggtcgaaatga

SEQ ID NO: 52869 - DNA, 666 bp, Glycine max
  Peptide Sequence Number=SeqID_144554
gggagttgtgttgatccctcaggaaacgatcctgagacggatgactctgataggtgcagcttgtacatagaagcagatcctgcccgcctagttgccatggggagagtttatgagggatccactgttgttcataacactcatttgttgcctggccaagtaaaggtgagtgtggaggaggttacagatgcagatgctccaatgcctgtacccactaatgaggtttccttagtggggcaggcacttcacaccttccttgcttggccgacacatctggtcaagtctttatcacagcaggatgccaccgtgttcgggatctttcatccagatttcccgctctacataaagcacgaagacctctccgaaatcgcacacaatggtcaatgtctcagcatatcagtgttacagttgtggattctgcatctcactgaaacatgtatgcgagcggggaattctgatatctatggatttctcgagccacaatccattcagagcggacactggcagatggtggtcatcgtgcccaaggaacacctagttgtctggttttgttcattgcataacaggccagacaactaccttaaggggataattaacagtgttttaaaaggtcttcatgatgctccacagcctaaatcaaaggctcctgctaggtggattgtcttcaag

SEQ ID NO: 52870 - DNA, 420 bp, Glycine max
  Peptide Sequence Number=SeqID_144555
atggatactccaattgcatcgcctcctccttctccttgtcctagtcctccccttcctcctgcgttagcatcagagtctacatcttcgttgaagcgtacacgcaaacccacacgggtaagatcctttgccactagaacatctgtgatagagagaccggtggtccacgtggatcctgcgacctgcaaggcagagggtccccacaggaagaaattaaggacatatttggggattgtgactcgtgataaggtggacgtgacattcgagaattggaaggaagtccctactactcagaaggatttaatatgggagaatattcaggcaaattttacaattaggctgaattggatatccttgaagcatgtgatggtaggacaaagaagaaaatacttcagactgtcgggagcagtggagacagtttaa

SEQ ID NO: 52871 - DNA, 210 bp, Glycine max
  Peptide Sequence Number=SeqID_144556
atgaattgcgttttcgttcaagcgtcctccacccacgaatttggagccatgcgtagtgattgcttactgcaattctccattctcaaccctttttcggagccaatgaattgcgttttcgttcatgcatcctccacccacgagtttggagccatgcgtagtgattgcttagtgcaattctccattctcaatcccttcttcgaacccccatga

SEQ ID NO: 52872 - DNA, 573 bp, Glycine max
  Peptide Sequence Number=SeqID_144557
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtaccttttgctcccgacatcttccgcttcaacacccgctgcgcgcctctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaa

SEQ ID NO: 52873 - DNA, 579 bp, Glycine max
  Peptide Sequence Number=SeqID_144558
atgggtaaagcagaggaggtacaagagcagatgaaggccgacatgaaggccatgaaagagcagatggccacaatgatgaaggccatgatgagcatgaagaagataatggaagccaatgcggttgcagttgccgctactagcgctgttgctaaggtgaacccgatgcccccatctgacctcaaccaaatgaatcatccaacctcagatatgcacgcctttccgccatatggcttgcctcccaactatacgccacccaatgtggcgtacactcccaatgagaatgtcaataactccactcctatacccattgagagccgacaacctcatcgtgtacatgtctctcaacccatgggggagacacatgaaattcccaaccacaatctagccgacttcgagccttgcctcggatatgccactgaagggcaagtagttggtggtatacccctgcaaaacactttggaaggccctcagtatcacccacaaacacaccccttgcattccacagcgggtaaaaaccctcatgctatggcagaaatgggagaagttggatcatctagaggaaaggctcatggtcgttga

SEQ ID NO: 52874 - DNA, 798 bp, Glycine max
  Peptide Sequence Number=SeqID_144559
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacatcggattccccttgtccgtaccagttctgagttgactgttccacccccggggaagaggccccgaagggcccgttcccaatccgtcccccgaccggcacgcgacgacccgctctcgccgcggaagcagctcgagcagtccaccgacagccgacgggttcgggactgggacccccgtgcccagccctcaaagccaatctttttcccgaggttactgatccattttgcctacttcccttgcctactttgttccatcgaccacaggctgttcgccttggagacctga

SEQ ID NO: 52875 - DNA, 87 bp, Glycine max
  Peptide Sequence Number=SeqID_144560
atgcaggctccaggcggtccagccggaaaccagcaggcgagggtcgagaccaccagggtggtcagcagcagcgcacggggcatcggg

SEQ ID NO: 52876 - DNA, 239 bp, Glycine max
  Peptide Sequence Number=SeqID_144561
atggctcggctctacaaaggcgaagcaacgtcgagcatggctcgacgctacagagcgaacaccgccgccaggtcatccgccagctgccgcagctgcgctgcccccagcgcagcgcaggtgatgcgcaggccatgccccggcgctgccaccgagaacacttcgcccgcgcgcacatgccatccacgcgaagccagggccagcacctgcggatggctgtcggccttgcacggcagccacag

SEQ ID NO: 52877 - DNA, 327 bp, Glycine max
  Peptide Sequence Number=SeqID_144562
atgaccggccctctcgatgggccgacctcttgttttctcataaaggtggacccttgggtactagtgcctatcttcttcagagggctacatatcctcgccatcagaggactacacgtcctcgccttcagagggccgcacgccctcgccttcagaggactacacgtcttcaacttcagaggactacaagtcctcgtcgtcaaagggtcatgtaccttcacctttgtagggctacacgccctcaccttcagaggactacacgtcctcgcctttagaggactacacgtcctcgccatcagggactacatgtcccccattttcaaagggtga

SEQ ID NO: 52878 - DNA, 470 bp, Glycine max
  Peptide Sequence Number=SeqID_144563
caccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccccggatgacgccgattga

SEQ ID NO: 52879 - DNA, 489 bp, Glycine max
  Peptide Sequence Number=SeqID_144564
atgttggggaagcttgggaggattgatggggacccggtgttgagagaaacgaggatatgggctacgtgggagtacgtgagctcagttggaggtgggcaacaggggatggtgggtttatgtgcgatttgtggatgtggaaaaacttgttgtgcaccatcgcccgaccgccacctagtaccacatgtgatggagtggtacctggagatatgtcgcgggggtcaggagaccttggggacgtcaggtggggtgctattgcccaaaaccaagcttgaccaatcccgacccaacccgggcatagtcagtcagcttgaaaacgaagtcaggaagctaggggagcttctggtaatcgattaccaggcttcaaaagggaattggaaggctgtggaggcctctggtaatcgattaccagtctgtgtaatcgattacacagaggaatgggtcactggtaatcgattaccagatcgtgatggcggcgcagctaatccatga

SEQ ID NO: 52880 - DNA, 811 bp, Glycine max
  Peptide Sequence Number=SeqID_144565
tgaagtcgccgagatccgcgcgccggaagtcgttgaagagcagcgctccagcgacggcaccattaagtgggcgattgccgttggcgatcagcgcgttgaaacggtatacatcccggaagaagaccgcgccacgctgtgcgtctcttcacaggttggctgtgcgctggaatgtaaattctgctccaccgctcagcaaggcttcaaccgtaacctgcgcgtttccgaaattattggccaggtctggcgcgcggcgaaaatcgtcggcgcggtgaagactaccggcgtgcgtccaattaccaacgtggtaatgatgggcatgggcgagccgctgctgaacctcaacaacgtcgttccggcgatggaaatcatgctggatgatttcggttttggtctctccaaacgccgcgtgaccttgtctacctccggcgtggtgccggcgctggataaactcggcgacatgatcgacgttgcgctggcgatttctctgcacgcgccgaacgacaccatccgcgacgaaattgtaccgattaacaaaaagtacaatattgagaccttcctgaactcggtgcgcggctatatttcgaagtccaacgccaaccagggtcgtgtgactatcgagtatgtcatgctggatcacgtcaacgacggtaccgagcacgcccatgaactggcggcgctgctgaaagatacgccgtgcaagatcaacctgatcccatggaacccgttcccgggcgcgccgtatggccgtagttctaacagccgtatcgatcgtttctccaaagtgctgatggaatatggtttcaccaccatc

SEQ ID NO: 52881 - DNA, 551 bp, Glycine max
  Peptide Sequence Number=SeqID_144566
agcaccctggccgggtccgtgctgctggagctggtgttaccataaagcaatacttcggatcgacttcacgaacatcccacaattcttcctttatgcctcctgaagacctacaactactgacccaacaaataagggaccagcttgaggagtcgatcacagaaaaaggatttgcactacctccagagccagaggttggtccttcaggtgctcatgttagcacaaaggagagttgtgttgctctctcagggaacgatccagagacgggtgactcagacaaatgcgggctatacattgaagaaaattcttcccgcctagttgccctaggaagactatatgagggatccacagcagttcacaacatccctttgttgcatgaccaagtcaaggttggtgttgaggaggttaaagatgcggagactctcattcctgtacccactgacgaggtagttgtgtctccagcaaaacctccagaaagtccggatcatgatgtcgatgatcccctgcacctgatgacattgaccatcccacaactatttttgaagcctctctag

SEQ ID NO: 52882 - DNA, 436 bp, Glycine max
  Peptide Sequence Number=SeqID_144567
tccatgatgattggatgtggaatttcttggatgtcgtgggagcttgagaggattgatggggacccggtgttgagaggaacgaggataagggctacgtgggagtacgtgagctcagttggaggtggacaacaggggatggtgggtttatacgtgatttgtggatatggagaattgtcttgcaccatcgcccgaccgccacctagtaccacatgtgatggagtggtacctggagatatgtcgcgggggtcaggagaccttggggacgtcaggcgagctcctggcagtcaacagataaaaggaacaaagaccacaaagcaaggaggcttgtgtggtggctggccagggaactggaagattgtggaggcctctggtaatagattaccagtctgtgtaatcgattacacagaggaatgggtcactggtaatcgattaccag

SEQ ID NO: 52883 - DNA, 405 bp, Glycine max
  Peptide Sequence Number=SeqID_144568
atggcatccttcagccagatgcagtcccagattcagtctctgggacttgcagtgcctcccgagcctctggttggtccctctggtcctcgagtaagcacaaaagggagttgtgttgatccctcaggaaatgatcctgagacgggtgactcagataggtgcggcttgtacatcgaagcagatcatgcccgcctagtagccctggggagagtttatgagggatccactattgttcataacactcctttgttgcctaaccaagaaaaggtggctgtggaggaggttacagatgcagatgctccagttcttgtacccactaatgaggtttccttagtggggcaggcacttcacaccttccttgcttggtcgacacatctggtcaagtctttatcacagcaagtactttag

SEQ ID NO: 52884 - DNA, 280 bp, Glycine max
  Peptide Sequence Number=SeqID_144569
atgtcggttgctgcagctgaaaaactttgtccttgttctccaaacgaatgtggtgcatcaaactgttataaagaagctaaatatgatgctgctgaatttggtgtattgaaatcgatgccaaataaatcggtcatccattcatggatggttgcagtgactgactcgccagagacgtatttcaagaccgcacaactctttgctattagaggtcgactaactcaggcaatgatcaactccggctcacagtattctgaagtcatctctgatgcaatgaataacg

SEQ ID NO: 52885 - DNA, 438 bp, Glycine max
  Peptide Sequence Number=SeqID_144570
ggatacaaatgctttcaccctccatcaagaagattctatgtgtcaagggatgtcaccttcaacgaacaagaaagctacttcaagcaacctcatcttcagagggagaatgtaattgaggaagatgagcctctaatgcttccgaatatgacatttggacctgaaattgggacaactagcactgctgtacctgaaactgaaagaagtccagattcagcagaacaatccacagattcaacagcaggacctatacctcaacctaagattaatggtgggaaatttgggaaaaatctggtatattcaaggagagaaaaggctattccagattctatccatgtccaagaatctgatccaccatcattacatgaggtaacatcttctaatcctataaataattctaatgagtttgttgctgaaatttcagaagtacaagtgaactaa

SEQ ID NO: 52886 - DNA, 522 bp, Glycine max
  Peptide Sequence Number=SeqID_144571
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccaatcgaaaccactgcgaagggtgctgatgaacttacgcccgcaaatactgttcgagggtccgattaacaacctcggttttgccgtccatctgcgggtggtacgccgtgctcatacggagcttcgtacaactgagcttgaacagctcacgtcaaaaatggctgacaaacaccgggtctcggtccgacacgatactacggggaaacccgtgaagcttgcagacgcaatctaa

SEQ ID NO: 52887 - DNA, 417 bp, Glycine max
  Peptide Sequence Number=SeqID_144572
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggtctttccaaagcttgttctacaggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 52888 - DNA, 288 bp, Glycine max
  Peptide Sequence Number=SeqID_144573
atgcgtgatagcctccctctctggttctatgtgctcgcacagttggtcgccctccaatatcagggggtggcccaggatctgataaaaggaaactactggccccttaaccaggagtgcaacacactgaaaatgaggatgcgtggccctctaaaggcgagaaacgtgcagtcctctgaaggtgagggcgtgcagtcctctgatggtgagggcgtgcagccctctgatggcgaggacgtgcagccctctgaaggcgagggcgtgcagccctctgaaagcgagggcttgtag

SEQ ID NO: 52889 - DNA, 660 bp, Glycine max
  Peptide Sequence Number=SeqID_144574
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccgtccagattttagaaacaactatgagatatgttctttcgtggactttatggactcgcttattgaccatcctggggatgtgaaggagctgagatcagcaaagattctccttaatgcccttatgagtaaggaggtggcaaagatcttcaatttcgtaagcacttatttggtgtccaacatgaaaggtaacccttgggctatcattggtttcattgttgctatttttgcgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 52890 - DNA, 321 bp, Glycine max
  Peptide Sequence Number=SeqID_144575
atggctactcagttgaaccaagctcaatcccagaattctgataaattgccttcacaaactgtgcagaattcgaaaaatgtgagtgccatcaccttgaggtctggcaagcaaattgaagtgcctccaccagtagcagcacctgcacctgaacctgtcaagcttcattctacacctgaaaaagaggatgatttagctgcacaaaagagaaagcttcctgatcatgaaggagctaacaaaaattttcatgcaggtggaccttcttctagtagttctgacatgcagcaacctcctatccctcttccaaacaaaggactaacataa

SEQ ID NO: 52891 - DNA, 561 bp, Glycine max
  Peptide Sequence Number=SeqID_144576
atggaaggctcatcaaccattgaagaatctaagctgagaagcgatctaaaactgcatatcactaaattggcttcaacacaaagtgtcctggatagattgaggcaagaaaatgaaaaacttgtttcaagttacaaagctactggttgtgtttgtgcatctatctctcttaacatggaggattacaaatatttacaaactgagtttgaaaagttcaaagaggattactgtgcagaacgtatgaagttgcaaactgagttttcctatcttaaagatctttctagaaaaatgaacaaaggaaagagtgatcttagtcacttgctcagtgtgcaaaatcatacctctaataaaactggtttggggtataataagcaaactaccttttctaacaaaactaagtttgcatcctccaaaagggcgaacccaaacaaagtctccaaaaagaagaacacaatgcattctaagcctaatgcaaagacctatcattattgcatgaaaagaggacatacatcttataaatgctatgttatgagatttgacgttcctagaggcaagtgtgtctag

SEQ ID NO: 52892 - DNA, 370 bp, Glycine max
  misc_feature (53)..(53): n is a, c, g, or t
  Peptide Sequence Number=SeqID_144577
cgccacgcttcccgaagggagaaaggcggacaggtatccggtaagcggcaggntcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcaggcgagttaagttcagaggatgtgtgcaaaggagtggaatgtggatag

SEQ ID NO: 52893 - DNA, 53 bp, Glycine max
  Peptide Sequence Number=SeqID_144578
atgggtgaagtagaggaggtgcaagagcagatgaaggccaacatggaggccct

SEQ ID NO: 52894 - DNA, 396 bp, Glycine max
  Peptide Sequence Number=SeqID_144579
atgggatttttgcaagatgataaagaattcattgaggcaatcaaggaagcaaaagattggggttcaacacattatataagaaagctatttgtgttgttacttttaactgcaacaatgagaaaacctgaacaagtttgggaccaaacttggcattggatggctgatgacattgtctataattataaaaaatcatcaacaagtccagcattacagtttgatgatagaactcttcaaaatctggtcttgcttgaaatggaagaactgctgcaagcaaatcaaagatcgcttaaagactatccttcaatgccatattcagaggatgcgaattgtacaacctatctagacaatagccttatattagctgatctgaattacaacaatcaagaaattagataa

SEQ ID NO: 52895 - DNA, 339 bp, Glycine max
  Peptide Sequence Number=SeqID_144580
atgttggggcacggctacgagcccggaatgggtatgggcaagaacaacggcggtaggaccagcctggtaagcaccagaggaaaccgcgggaagtttaggttaggctataaacctacgcaggctgacataaggaaaaatatctcgaaaaggaagaacaaaggccagggcccgcagtcgggacaacgagccaaagaggccccgccatgccacatcagtaggagcttcataagtgcgggtttaagacgcaaaggtcaagtcgccgcgatatgcgatgatgactccctaaggagatcggatttggtacggccatgccctgccggtttccaactaggatattag

SEQ ID NO: 52896 - DNA, 1099 bp, Glycine max
  Peptide Sequence Number=SeqID_144581
ggcttaggttggctctccaaattgaaagttgtcgatgaggagaacttcgaagctccggaggaagatgaagaagtccgagctctaaagttagagctagggaaggcgagactcgccaaggagaagttcaaatcagctgctacacacatccggaaggagtgcaccgagttacaagaggaaaacgcggccactgcaagagctcttgaacaagaaaccaaaagggcccgcaaggaggaacatggccgagaaaaattccgaggagcattgtgggatagcaacaatgagctcaagctccgaagagaggagagagatcggtcacgggtgcatggcatgatcttaaaagaaaagttagttgcttgtgcgaggtccaaaaggagtttggctcaacacttggaagccacggagcaaagcatgctagccatcatagggcaatacaaggaagaattgaaccagtccatggcccatgaacaaaagctagtggaggattttccacaagtgtatgccgaaaaagaagcaaaagggagggtgattgatgcgctgcatcaagaagcgactatgtggatggatagattcgccttgaccttgaatgggagtcaagacctcccgcgtctattagccaaagcaaaagccatggccgaagaacagatgaaggccgatctatcggccttaaaagatcaaatggcttccatctcggaggtcatgttaaaactccagaaaaccatagaggataaagccaccgcaaccgcctccagtacagttagggaaacgaagccggtgctgtatagtccgcaagcttatccttatggcctgcctccggacttcaccccccgtgccactccgaaagatttaagccaagcccctacttttgaagggcaactcccaccttatgaagactatcccggacaagacgatggggaaggagatacccatcttggccccctgctccacctcaaagatccatccccgcatgaactaccccagccgaacatagtctgccatatcccggcctcacccacacccgtaaaagaatctgttccctttgcagaagataagggaaagattgaggcgcttgaagagaggttgagagcagtcgagggcctcg

SEQ ID NO: 52897 - DNA, 615 bp, Glycine max
  Peptide Sequence Number=SeqID_144582
atgaactcaggggcagtagcaatgggcccatcggtggctattgagaatgccgaactgagagatataaatatagctaccaccaaagccttggaacaagaaaccaagagggctcgtagggaagagcacagtccaaacaagttccgaggggctctgtggagcagcaacaacgagcttaagctccggaaagaggaaagggaccaatcacgagtagacagtttaatcttgaaagatgagttgaaggtttgctcaaggtccaaaagaaacttgtctaagcggttatgcgagacagagaccaacatgttagctatcgtcagcaagtaccaagaagaattaaatctagccacggcccatgagcacaaagtggcggacgagtatgcccgagtgtacgcgaaaaaggaggctagaggaagggtgatcgactcgttacatcaagaagcaacaatgtggatggaccgatttgttcttaccttgaacgggagtcaagaacttccccgattgctagccaaggccaatgcaatggcggacacctactccgcccccgaggagatccacagacttcttagctattgtcagcatatgatagacttaatggcccatataattagaaactactag

SEQ ID NO: 52898 - DNA, 186 bp, Glycine max
  Peptide Sequence Number=SeqID_144583
atgagtaatgcaaagtatccacaagaatcattgcattcagtctcaaacgggaatggtagcaaaggatcattaaattgtaaacatcatgagccacatgatgagggaagcaatatcaaatcaatgctttacaagcttttggtcaatctaaggagtggtgtcttcatgctgcaaattgatggtttctga

SEQ ID NO: 52899 - DNA, 444 bp, Glycine max
  Peptide Sequence Number=SeqID_144584
gatgtgcgcaaaaaggcacaggccatccagaagcagaacactaccccgcacgttttgtctcgtgggggttatgactatttggagcagaagctcctggctgagaagaccaagaagaagctggaggaagttgcacagacaggaagcgttgatggcatcatcgaccctccatccccggtgagatgccacgtgaagtggaagatggcccgcacgaagaaatcaggggacatgacgactgaggccgcaaaggaaatcgttgcgaagatcgcgacacagggatccttcgtcccccatggacgtcaggatgttctcgccgctgctattggacgtccagagtaccctggacgtgtccgtgctgttggagccggtgtcaccatcaagcaatactttggatcggctccacggacgtcctgcagctcttcctccctgatttctgaagaattgtag

SEQ ID NO: 52900 - DNA, 219 bp, Glycine max
  Peptide Sequence Number=SeqID_144585
atggatagtgtcgcaacatgcccttttgcgggcgagcaaggcgaggctcacgggtgcgctttccaaaggaggaaagatgcgaggagtcgccaccaacgtttatttgtggaaaacgtcgggaaaaccgaaggaaaccggtcgacaaaagcggggctcttgctcctacgtaccctccatcaaagaggaaatcagacctacgtagttctttcttatgcgtga

SEQ ID NO: 52901 - DNA, 684 bp, Glycine max
  Peptide Sequence Number=SeqID_144586
atggacctcatcaaggctgctggactgctgaaaactgttaccaagttgggagattgttatgaaagtctagtcagggaattcattgtcaacattccctctgacataacaaacagaaagagtgatgagtatcagaaagtgttgtcagaggaaaatgtgttagattctccctgctgtaatcacaagtacctgggcagaccaactgaaggagtggtggatattgctgtttctgagcatcaaattgccaaggaaatcactgccaaacaagtccagcattggccaaagaaagggaagctttctgcagggaagctaagtgtgaagtatgcaatcctgcataggattggcgctgcaaactgggtacccaccaatcatacttccactgttgccacagacattgtctcgacatcagggaaagctgctgcttcaggtgctgtgtccaaggatgctttgattgctgaactcaaggacacatacaaggtgctggaagcaaccatcaaagccaccacagagaagaagatggagctggaacgcctgatcaaaagactctcagacagtggcattgatgatggtgaagcagctgaggcagaagaggaagcagatgaggaagaagaagaagcagctgaggaagaagaagatgcagcagaggatacagaatcagatgatgatgattctgaggccaccccatga

SEQ ID NO: 52902 - DNA, 666 bp, Glycine max
  Peptide Sequence Number=SeqID_144587
atgaggggagcaccgacggaagagagcctcttgcctttccttgtgagaggtttcggtgcgcaaagtttcaagattgtacaaatagtccataaggcgtgggaaagcccgttaagaaaagataaagaacttaggggcatccgtaatggcatcatcggtggttatcatgaatgggctaaaaagttcatacacgaggctccagaagaggatgaagaagtccgagctctaaaaacagagctaggaaaggcaagactcgccaaagaaaaattcaagttagtcgctacagacgtccggaaagagtgtgccgagttacgagaagaaaatgcagctaccgcaagagcccttgaacaagaaaccaagagggcttgcaaggaagagcatggccgagataaattccgaggagctttgtggggcagcaacaatgaggtcaagcttcgaaggaaagagggagaccaatcacgtgtacatagcatggccttaaaggaagagttagctgcttgctcaagatccaagaagagtttagcccaacacttagaagccacggagcaaagcatgctagctataatagaggacttcgcacaagcatacgccgagaaggaagcaagagggagggtgattgatgcattgcatcaagaagcgaccatgtggatggttagtgtcataccctaa

SEQ ID NO: 52903 - DNA, 516 bp, Glycine max
  Peptide Sequence Number=SeqID_144588
atgttaggatttacacgcaattctcctcaaatttcagccagcccgtatcaattagacttcacactttatgcttcggggtcatacaatgctcaatggaatgccccagggctcctccacgataagcacacgttgcattcgagtcgtatcctcagaaaagtggaggttgatgaaccttggctagggttatggctaccattgaattatcaagtagatgtgggagcaagtcagcataggacactggaattggggtggtgttcgtcattggaagtgcagacagactttgtggtagatttagggatggcctttgtggataactgggtggtgggaatggcagtcacagcatgggtttctcccttatcctcaccctctttatttgccccagttttctcagtcgtcctaacccacatcgatcctttcactggcaaagaccaaatcctcaaagctttgaagaacaccggtcacgtgtctactatcattgtgataatctcttactctgtttttgggggtgctacttga

SEQ ID NO: 52904 - DNA, 423 bp, Glycine max
  Peptide Sequence Number=SeqID_144589
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaggtattttcaacaagcacatgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 52905 - DNA, 345 bp, Glycine max
  Peptide Sequence Number=SeqID_144590
atgcatgagaacgaattgcacggagcgtgtttgctctttgcccctatttgggaacctataggacaatatctaggggtctctaataactactccccaacaattcataactcacacggctgttttctagagaataggcctaactcacaaaaaggtccccagtggagtcgccaactgtcgcaacatgcgcttttgcgggcgagcgaggcgaggctcatgggtgcgctttccaaaggaggaaagatgcgcggagtcgccaccaacgttgttttgtggaaaacgtcggaaaaatcgaaggaaaccggtcaaaatgaaaattctaagttcgggagttgtatttacgtttga

SEQ ID NO: 52906 - DNA, 202 bp, Glycine max
  Peptide Sequence Number=SeqID_144591
atggcacgcaacgtgcttgctctgtgcccctattttagggacctatatgggagagagctaaaagggattttaacgataattcccaacgttgtcatatctctcttgatggtctctagaggtatcatcccctttgaagaacgtattgcagcaatagggactactagcaacaatatgttgtcaaagagaaaaactctagatgagg

SEQ ID NO: 52907 - DNA, 347 bp, Glycine max
  Peptide Sequence Number=SeqID_144592
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgctaaaggcccaagtggagaaggacgaaggcccaagtggagaaggacaaagcccccgagtggagaaggatgaaggcccagaggcagagacactatcaagactattggtaccgagctcgaattcgtaa

SEQ ID NO: 52908 - DNA, 394 bp, Glycine max
  Peptide Sequence Number=SeqID_144593
atggctacctcaccaaaagaaacttccgctcctggttcacccgttgtaccatcatctccatcatccaccaaagcaccatcaaaccaggaacgacttgaattcaatatccagcccatacagatgattcctggtcaagcccctgttcctgaaaaactggttcccaaacgacaacagggtgtgaagatttctgaaaaccctagtcttgcaacaagtcctagggaagtagacacagagatggacaagaagatccgcagtattgtgagtaacattctgaaaaatgcgtatgctgatgaagatgtcccaacatcttccaccccaaatgtttctgtgcctgatgttgataaagatgttccaacatcttccgctccaaatgctgaagccctcccttcaccca

SEQ ID NO: 52909 - DNA, 741 bp, Glycine max
  misc_feature (31)..(31): n is a, c, g, or t
  Peptide Sequence Number=SeqID_144594
atggacattctggaactcttgatcttcgggntggtcctctttccaaatgtggatgggttggtggaccgggcagcaattgatgcttttctcgccttttacgaccgcaaggaaagcccggttgtcgctatcttagccgatctatacgacacattcgaccgaagatgtgagaagaacaatgcaaggatcgtttgctgtacgccggctctctacgtgtggttggtttcacacttctttcgccaaaagatgggacacgtttgcccgctagaaggccaccactcatgcaccgagaaaaaagaggcaaactgggaccgactcttagcaagcaaagaaggagcgtctatcaattggttcccccgatggaaggaaggaagaattgagattcttatttcgtgcgggaaatttccaaatgttcccttgatggggacgaggggttgcatcaattacaatcccgtcctcgccataagacaacttggttaccctatgaaaggggcaccatcagaggaaggcctcacaccttttattacacaaggtttcaatagcaccaatgcgggggtgcttcagagggtccacaaggcatgggaaatgtcgcaaaggaaggacaaggaacttaggagaagtagcaacaggcccatcgacggttaccataggtggttgaaagcctacgcacaagatctggattggctcccgggtttgaggaccactaaggggatggagggtgaagcttcgaaagaagatgaagag

SEQ ID NO: 52910 - DNA, 213 bp, Glycine max
  Peptide Sequence Number=SeqID_144595
atgacaagcaggggtaccgtatggttatccacacctttggtcatccagagacggcaaatagaggaagcaaaagaacatcacctagatgaagatgctatgataccacatgatgtaactccatgtagagcttgtaggccttggatcttcttcatcaatgaattcttttgcttcttgaagatcaatggaagtggaatggagaaggaggaaaagtga

SEQ ID NO: 52911 - DNA, 473 bp, Glycine max
  Peptide Sequence Number=SeqID_144596
atgggaggaactaaaaggcttttagtgataattcccaaggtggtcatatctctcttgatggtttctagaggtatcatccccttcaaaaaacatattgcggtagtagggactaccagcaacaatatgttatcaaagagaaaaactctagatgagggttcactgttatcaagcaagtcgaagacccaacatgaccacagattcacctccactccttatgttcccatggacccgggaaaaccaacaaaagaggaagtcatgatattgcacgagattagaaggcctaactctctaaaaacagtccccagtggagtcgccaactgtcgcaacctacccttcggcgggagggcgacgcgagggctcacgggtgcgtcttccaagaatggaaaatgcgcggagtcaccaccaacgtttattcgaggaaaacgtcggaaaaaccggaaaaggatgtggtctacaaactttaagtgtgaaag

SEQ ID NO: 52912 - DNA, 306 bp, Glycine max
  Peptide Sequence Number=SeqID_144597
atggatgtggccagtaatggcagaaacttcaagaccatcgtaaagaagacggagaatgttgtcattgtcgaagaacagagagtagaaacccgaggacccaaaggaatatgcatttcgccatcagcaaagaaaccagtagagaacatgccatttgaaataacaagtgatgaacctttgaagtgcatgtcattgtcatcatcaagcaatgcctacaacgtgccatgggtagaaaagtatcgtcccatcaaggtcgccgacattgtcgtcaacgaggacgccatctccaggaaactgttctcaaactaa

SEQ ID NO: 52913 - DNA, 229 bp, Glycine max
  Peptide Sequence Number=SeqID_144598
atggcagatgaacaccagcagagagttacccttgagaactattcaagcagttcaatgccacaattctttaccagcattgcacgtcttgaagtgcaagctcacaacataaactaccctcattctttgattcatttaatacaggggaacttattccaaggattaccaaataaggatccctatgcatatttggcaacattcattgaaatttgtaacactgtaaagattgcag

SEQ ID NO: 52914 - DNA, 210 bp, Glycine max
  Peptide Sequence Number=SeqID_144599
atgggggagatgcttgccacccagctcgcccagacgagctgggttgcttcctccagaagcaactgccttctggaggaattttctggaaggcccaagtgggccagcttccggcatgtcacggaacttcacgaattgcctaacgatgggtgccaagtacctcgaagtggtcaaacgagggtcgcatcccaacaacggatggtccccgggtga

SEQ ID NO: 52915 - DNA, 411 bp, Glycine max
  Peptide Sequence Number=SeqID_144600
atgacttccaaggttattttgatgatgccaaagaatcaagagttaagaaaagtttcaagcaaagattcgagaatcaagcttcaagtttcaagattagagattcaagaatcaagattcaagtatcaagatcaagattcaagactcaagattcaagaatcaagagaagactcgatcaagataaggtacatcctttgtggtacaagtagagggtacatctacttggggattgttatgctgagaacaagagagggtacatctcttgtggatcagttcaagtggagggtacatccacttggttattcaaagagaataagggagggtacatcccttgtggatctttggcttgtaaaggattttacaacgttgaaaagaaatctcaagaaccgcaggttgcttggggactggatgtag

SEQ ID NO: 52916 - DNA, 228 bp, Glycine max
  Peptide Sequence Number=SeqID_144601
atgtcccatgctgtcaaggacaatcgagggaaatgggccccgaactacgaagggccttttgttgtgaatagggctttttccggaggagccctggggcaggatcatcttgagctaccttctggggtggggacaaaacatggacagcagaaaccaatcaaggtacttaggaacggatgcaagtggggatggggtcacgaccgactgatcgttgccctttctctgcgctag

SEQ ID NO: 52917 - DNA, 447 bp, Glycine max
  Peptide Sequence Number=SeqID_144602
atgccagctaagctgaattttgcagaagcagaattttctgcaacatccgctaagtggccctacgtgtcgctaagcggtaataatgtattggggagaaacatcttgacagagaggaaggtggagatctaccacactaagtttgatgattttaaggctgagttggagaggcatagtctccataaacacctcaccaatttggttgatgggagcatagatgtgtcttcggtgaaagagttctacgcaaacctatacaactctgaaggtccttcaccaaagcaagccagggtcagaggccatctagtgaagatcgacgctgacaacctcaacacattcctagagacacctatggtgttggcagagggtgagactttgcccacatactccagatactgcaggctgccttcagatcctagggagattgaggctaccctatgcagaccaggctga

SEQ ID NO: 52918 - DNA, 717 bp, Glycine max
  Peptide Sequence Number=SeqID_144603
atggcgtttaacggcagatggttggccgacacgccgaacggatcttccagctcttcggccagtgagtcccaggataagaagatcggtcaccagggcaaaaggcaacaggctgcagaacaggtaaacggtgcgctgcaggatcagggtataggcgaacggcaccggcgtgctggcgagccgttcacagccgccgagggcgtgggacagctcgctcagcttgttgtcgagcagctcgaaggtgatgtcgctcagcagcccccgtcggcgcagcttgccgatctcctggcccagcatcagcaggatgcggttggtcggcatcgggctggcgatcacctccgccagctctttgctgctgaggttgtggtacagatcggcggtcggatcggtggcgcgcagctgatgcttcaggctccagctgaaggcgatcagcagcttggcgaccttctggtgcaccgccggttcgtccggcagcaggctttttatctggcgcagcagggatcgctcggtaatcagcagcgagccccacaggttgcgcgcttcgacaaagcggctgtagccggcgttattgcgaaagccgagaaaaatggcgatggcgatgcccagcaggctgaacggcgcgatggtcaaatgcacgccgagctgttcgtaccattgatagctgatcaccgccactatcgacatcagcacgttcagcgacaggcgaaaggtgatctttga

SEQ ID NO: 52919 - DNA, 402 bp, Glycine max
  Peptide Sequence Number=SeqID_144604
atggcagcgcaattaatccatgaccgagtggagatggagtgcctagagagagtttgggagacccacaaaggcaatgcaaggtgccgattccggggcacgattcgattcacggctacttcattggtacatccagaggaaccagcacgcacgcttcagcgcactgtggagtggatattacctacaccaactccatatcgactagtggagctagtccaagtgatagaggtgacgtcatctgaggaagaccctgaggaggacccagaggagctacctcctgagcctgctatggatgctctcgactttccagagggtgatgaggacgtcatgtcggcatctgaggcagactctatggaggagagcggtcctgagggaatagcgactagtggaggttcttcatcatag

SEQ ID NO: 52920 - DNA, 567 bp, Glycine max
  misc_feature (553)..(553): n is a, c, g, or t
  Peptide Sequence Number=SeqID_144605
atggtcattgaccaatccctattctatgacttgacccaattacccaatgaaggtgtaccatttgaaggtacactgattgattattggaaatatgaattctctgtgcatgatgcccgccggttggtttgcaccaaccaagcggatatgaccggaaggcttcttgccggttcattggcttttgaaagccgcatccttcattatctcattgtgcgtatcttgcttccaagatcttcaaaccttgcacagaaatcctttctaataggcactgcagtgattgcatcctttggttatcgtaaagtgcatgatggctcttgggtgaaaaatggtgctcaacccattgatgaagaaggacacttacatggtggagaagattcctttcttcttcaaacgattctggacaggtttgatggtcttcaaacctttgttggtgaaaggtttgatactttggagttacaagtggacatgcgattcaatgagatggagtcaaggatcaccaaggtcgaagaagatgtctcttacatccgtacaaactttgatctaccaccaccaccgncaccatcatcttag

SEQ ID NO: 52921 - DNA, 162 bp, Glycine max
  Peptide Sequence Number=SeqID_144606
atgggctcaacaatcaaccctaaggttcatgagaaccctagggccttctttagtagctctagcccaagcctcttggagtcttctatccaatacccttggggggctgaacttagtctaagcttggttcccaacgctcttttcaggctctcccaaaatctagag

SEQ ID NO: 52922 - DNA, 101 bp, Glycine max
  Peptide Sequence Number=SeqID_144607
atggccggtgtcggtcgttatatggccccgactgatatctttcagccgacattgcgcaatttcttttacaaacgctggccgataatgtttatccatttacg

SEQ ID NO: 52923 - DNA, 258 bp, Glycine max
  Peptide Sequence Number=SeqID_144608
atgggcccgaaatctaccctaaggctcatgagaaccctaaggctttctcgtgcatctctggcacaatcttcttggagtcttctatccaatgcccttgcgggaaaaaaaaagaaaaacagtcctttcgctaagcgcaagcctcgccctaagcgcatctctgttcatgcgctaagtcccgagtctcaagcgcttagcacccaacccttgcatctgaggctgatttggtccactaagctggccaaggttgagctaaggtaa

SEQ ID NO: 52924 - DNA, 777 bp, Glycine max
  Peptide Sequence Number=SeqID_144609
atgggaaacccgttaaggaaagatcaagagcttagaggcattcgtaatggcatcattgattggctcgccaagttaaaagtcgtcagcgaagagagttttgaagcaccggaagaggacgaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaggagtatggccggaacaaatttcgcggagctctatggggtagcaatagtgaactcaagttgcgaagggaagaaagagaccagtcgcgagcacatagcatggttctgaaagaggagttaattgcttgttcgaggtccaaaagaagcttgtctcagcgtttatgcgagacagagaccaacatgctagctatcatcgctaagtaccaagaagagttgggtctagccatggcccacgagcatagaatcgcggacgagtatgctcaagtatacgcggaaaaagaggctagaggaagggtgatcgactctttacaccaagaggcaaccatgtggatggatcggtttgctcttaccttgaacgggagtcaagaacttccccgcttgttagccaaggccaaggcgatggcagacacctactccacccccgaagagattcatgggcttctcggctattgtcagcatatgatagacttaatggcccacataattagaaatcattag

SEQ ID NO: 52925 - DNA, 375 bp, Glycine max
  Peptide Sequence Number=SeqID_144610
tcgttcggagtccccgttgcacctaccaaggtgattcggccgcccatcacccgggcttttattgagaagtactgcacccagagacaggctcagggtgatgctccacaggccgcaggcgcgccgccaccacctcatcaggctggcccggctgggtcgtttgacatggatcagtatttacggcatttggttcgccagcaggcggccaaccaccgggcacataccagttcaggggtagaggtcgcatggcccggggattggcccaaggcccaagcaggagaggcacccccagaggctcccgacgatggagaggaggcccacgaggacgaggagatggccgatttgcttgacttcttgggagggagtggagctacatga

SEQ ID NO: 52926 - DNA, 477 bp, Glycine max
  Peptide Sequence Number=SeqID_144611
atggctcctcctaaagaaattgtgaccatcatttaccaaaatggtcacattgtagacaacctagttcaaggatcgatgtacacatctgcaaacccaatatttttttacatcaatcgttctattacgtttacacaattcattcaaaaaattaacaatcgtctccctgctcgagcaactgaacaagttgctcaattgttatttcgtatccctatttcatttcatctcggtcagacacattttatttcagctcaactattcgacaatgatgatctcagaggagcgatcgaaacaattttccataatccacaattgaattttgccgaattctatgttgttactgaccttattcatcaaccacacccattgtctccacaaccctcaagtccacaactacaagtaccgcctccacaacaattaccgtacaacaacatagacctcaataatccagtatcttcatacaacaaccttgaatcataa

SEQ ID NO: 52927 - DNA, 510 bp, Glycine max
  Peptide Sequence Number=SeqID_144612
atgtccaaatcttgtggatttgggatgaccggccctctcgatgagtcgatctcttgctttctcataaggaggactacacgtcctcgccaacagagggttgcacgccctcaccatcagagaactacacgtcctcaccatcagagggctgcacgccctcacctccagaggactacacgtcctcgccttggaggactacccgtcctcaccttcagagggctacacgctctcgccatcagagaactgcatgtcctcaccttcgtagggctacacgccctcaccttcagagggctacacgccctcgccatcagaggactgcatgtcctcaccttcgtagggctacacgccctcacctttagaggaccacacgtcctcaccttcagagggctacacgccctcgccatcagaggactgcatgtcctcaccttcagagggctacacgccctcgccattagaggactgcatgtcctcaccttcgtagggctacacgccctcacctttagaggactacac

SEQ ID NO: 52928 - DNA, 267 bp, Glycine max
  misc_feature (186)..(186): n is a, c, g, or t
  Peptide Sequence Number=SeqID_144613
atgaagaagatcctaggcctactagctccaatggagcatacatcagttttcctcccccttgaaaaggatttgacctcaaatccagaggttcttgaaacttcatggattctttcctctacacctgtaaaaagaataaaaacatatgtattagtgatgttgggtatattagagtacgatattggaagnccccaaatttcccttatacttggtggagtaggccactcaggaatgacatttattctcttagggtccatgagaagcccttga

SEQ ID NO: 52929 - DNA, 645 bp, Glycine max
  Peptide Sequence Number=SeqID_144614
atggtggaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatggggtggtcggaataccgagaaaatatttggaggtaaaagcaagaatcttggcagataaaggcgagtggaccccattcatagatattctcacactgttgattttcgagggagtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaagaaaggcgaattgggaccaactcttggctagcatgggggggcatctgttaattggttccctcgctagaaggaaggaagaaataagattctatcttcatgcgaaggatgtccaaatgttcccttga

SEQ ID NO: 52930 - DNA, 396 bp, Glycine max
  Peptide Sequence Number=SeqID_144615
atggcaatacaaaatatgcagtttcagcaagagacaagagccttcattcagagtttgacaaatcagatggggcagatggccactcagttgaaccaagctcagtcccaaaactcagacaagctgccttctcaagctgtgcagaatccgagaaacgtgagtgccatcactttgaggtctggtaagcaaactgaagtgcctatcccagtagcagaacctacacctgaaggagagaaggagatagatgcacaaaagagacagcctcctgaccaggcaggaccttcttctagcaattctgatgtacgacaacctcctattcctctaccatttccacctagaccaattcctaacaagaagatggaagagatagataaggagatcttggagactttcagaaag

SEQ ID NO: 52931 - DNA, 345 bp, Glycine max
  Peptide Sequence Number=SeqID_144616
atgactacaggtgcagaagacgacgttagtctctgcgcgtcaacgggctcgtttcccctggttgacgaaaggatgacagaaactgtttgtatcgataaccgcttgggtatctccgcatgtcacctgacttcacgggtcatgatgatagaaaccgtttgtacggataaccgcttgggtatctccatacgtcacctaaattcacaggccaggatgacagaaaccgtttgtacagttaaccgcttgggtatctccatacgtcacctgacttcacgggtcaggatggcagaaagcgcggaagacgacgtaagtctccacgtgtcaacgggtttgttggctcctgattga

SEQ ID NO: 52932 - DNA, 1425 bp, Glycine max
  Peptide Sequence Number=SeqID_144617
atggcgaatcaagaggagtgggtcccgtttgcggatatactagctttgctaatctttggggttgtcctctttccaaacgtggacgatttggtggacctagctgcaattgatgctttccttgcatatcaccatagcaaggagagcccggtggttgctatcttggcggacttatttgatacatttgaccgaaggtgcgagaagaacagcgcacagattgtctgctgcttacccgctctttgtgtgtggttggtttcgcacctattccaacaagacataaggcacccgtgtctgcttcaaatttatcgctcgtgtgtcgaaaagagaagagtagattgggaccaatacttggctgggataggaggcagcacaatcaactggtttcctcgatggaaggaaggaaaagagggagttctcttctcatgtggggactacccaaatgttccgttgatagggacgagggtttgtattaactataatcccgcacttgccataagacagttagggtaccccatgaggggagcaccgacggaagagagcctcttgcctttccttgtgagagatttcggcgcgcaaagtctcaagattgtacaaagagtccacaaggcgtgggaaagcccgttaaggaaagataaagaacttaggggcatccgtaatggcgtcatcggtggttatcatgaatggctaagagttcatacacgagggttagattggctctccaagttgaaaattatcaatgaggagaactttgaagctctggaagaggatgaagaagtccgagctctaaaaaccgaactgggaagggcgagacttgtcaaagaaaaattcaagttggtcgctacagacgtctggaaagagtgtgccgagttacgagaagaaaatgcagctaccgcaagagcccttgaacaagaaaccaagagggctcgcaaggaagagcatggccgagacaaattccaaggagctttgtggggcagcaacagtgagctcaagcttcgaagggaagagagagaccaatcacgagcacatagcatggtcttgaaagaggagttagctgcttgctcaaggtccaaaagaaacttgtctcagcgtttatgcgagacagagaccaacatgttagccatcgtcagcaagtaccaagaagaactaaatctagccacggcccacgagcataaagtggtggacgagtatgcccaagtgtacgtgcaaaaggaggccagaggaagggtgatcgactcgttacatcaagaggcaacaatatggattgaccgatttgctcttaccttgaatgggagtcaagaacttccccgattgctagccaaggccaaagcaatggcggacacctactctgcccccgaggagatccacggacttctcagctattgtcagcatatgatagacttaatggtccatataattagaaaccgctag

SEQ ID NO: 52933 - DNA, 225 bp, Glycine max
  Peptide Sequence Number=SeqID_144618
atggtagacgcctttcaccgaagattctattcagtagcccgcaaagtaacctatatggagcttgcggcgactaagcatatgcgggaaccacacacctggctcgagctagcgaacaaccttgctctagcaaatacagcgactcccgcgggtataggcactcaccctaatctgcagctactaatcgaattgcagaatcaagtctacatcgagggtgctcgaatctga

SEQ ID NO: 52934 - DNA, 261 bp, Glycine max
  Peptide Sequence Number=SeqID_144619
atgggggcatacgcaaaagatgaggaattgctgatacattccttccaagaaagtcttactggggtagctgttacctggtggagggatctggcagctcaagtggcacctccaatgatggagaaagagatgatcacaataatagtagacacattaccagtgttttactatgaaaaaatggtggcgtacgcaccttcgaagctttgcggatttggtcttcaccgggaaaaggatcaaagcgggcttgaaaagaggaaaatttaa

SEQ ID NO: 52935 - DNA, 126 bp, Glycine max
  Peptide Sequence Number=SeqID_144620
atggaagagaagcttgcttgtgaagcttctatggaggctggatctttgagcttcaatggtgattttccaccatggagatgcagcggaaggcaaaggagaagaggagaggggaggcaccatccataa

SEQ ID NO: 52936 - DNA, 393 bp, Glycine max
  Peptide Sequence Number=SeqID_144621
atggcctttcagatcggcgacggttttgatcgggctgttttccggcaccaggatcacctccgccttcggtttgggcggctcaacgccgacatacagcaggtccgcgccagcggcctgcgcgaagatcggcggaatatcgccggtgctgcccagatcgatgctgccgacgttcaaggcctcgagcatttgcgggccggcgggaaactcgatccagctgatgcgggtagcggggaaacgttcctccagcagccggtggctcttcgccagcaccaggctgaccgatcctttttggtagccgatgcggaactgcgccggatcctgcgcggcggcggcagtggcccaaaccaacgacagcaggccggtgagggtagcggcgctcagccagcgccgtaa

SEQ ID NO: 52937 - DNA, 141 bp, Glycine max
  Peptide Sequence Number=SeqID_144622
atggacacccgtctccgtgggattgatgatcccatgaatggagttcaacagagtgggggtcacaaacaactctttgaggattcacctagtgagtgtggtggtggggccgccactgtgagatatgagctaatttctaagtga

SEQ ID NO: 52938 - DNA, 1134 bp, Glycine max
  Peptide Sequence Number=SeqID_144623
atgagagtcaaaatcaaagctgtagacgaggatgtcatcaaagaataccatgacatatttcctcggaaatgggtggagtgcatcgttcatggcagcctggaaagtagaaggagcattgcaaaggccaaatggcatgaccctgaacttatagtggccttggtgagttcggaatgccattttatggacatctgcctcggccattcgtatctggtgaaatccttggctcaaatcgagcttcgaaaaccaggatgcttggcccaaatcatcaagcaactcatcaatggtaagcatagggaaatagtctttaatggtgacggagtggtgtgtgggaggagatggaaggtatttgttaggggtgaagatggtgaagagtgggctggtgttatggtgatatggagcagagctgagatgctctgggtctgggctagtcttttgagttggtgggctgaggcagatgaaggaagagagggagcatcgacacttaagggcgaggaatttggccacgcgcgactagatgaatttatgggtgttgttgccatcgacgaggatgacaacctgatggcggcacagagagcccagaagacgaaatgtttgtggagcagggacagggtccgaggagaactcaaggtcctcgtccgcgataagaaggcaacaagggtgaatagggagtcgaaagactgtgctagccacgatggcggtccaacatcttatcctcttggaggcgagcgagctcggtcgcctgaggcaaagaaagagggcgcagagcctgaacttcccggcgaagttccagaattaaccttgagacgaagcaactcagcaagaaggaaggggcaaggcccacaatttgattcgccaatccaaaccgcgattctagagcctgaagcatggccggctaagaagggaaaaactcatttcgagacatccactggtaccacgacaaagcgggctcatccatccgagggggttgtggccatcaaagcggggcacatcgagcttcatgtgaggacgatgaactggagaatgaggcggatgagtgggggaagtgggagagggtggagtgacaatgatggcggcaaggcgatcaataatcgagtctatcttggaggtgagggagagaaacttggccttgggtga

SEQ ID NO: 52939 - DNA, 693 bp, Glycine max
  Peptide Sequence Number=SeqID_144624
atgtggtataatgaaagaatttcaaaagataaaaatacagcaagcccaaagttcagcttatgttgtggagatgtcaaagttgaacttccattattacaaaatccactaaaatatcttgaacgacttttgtttgatgataatgcaactgatagtaaaaattatcaacataacatacggacatataacatgatgttttcctttacctctgttggtattaagctagacaaaacaattaatgaaaccagagaacctcctacaattagaattcagggccaaccatgtcatcgaataagcagcctattaccaatgcctggaaaacaacccaaatttgcacaattatatatgtttgatacacaaaatgaagttgaaaatagaattaataccatgagccaacatgctgcaattcagccacacattgtttcaactttgagtcaaatgctggatgaccacaatgtccatgcaaaaagttttagaatggccagggatagattggcagatattcaagtagataatgtgaaattgagattgatagccgttcgtgaaaaggatggtcgtacatacaatctcccaaatgtttctgaagttgctgctctcattgttggtgattttgatgcaaactcaagaagggatattattgctgaaactcaaaatggagaattacaaagaatccatgaattaaatctagctatctag

SEQ ID NO: 52940 - DNA, 1191 bp, Glycine max
  Peptide Sequence Number=SeqID_144625
atggcaagtgttcctgataagattaagtcgatagacggatcaagggaaactcttaagctttctgtaaggatcattaatctttggttcattgggatccctgaaaagtctgaacaagtcgaaatggttattgttgattttgatggagatgaaatccatgttgtttgcaaacaagatcagctaaagtcttggaaggctgatttgaaggaaaatttaacttatgtgatgcataattttaaagttatgaagaatgatggtcaattcagaatttgcgatcatgaatataaattatcttttactggagttactgttgttagtgggcaggtgctatcctgcccactctgggaaaattactgcttacagtttttatcttacttgaatgaggttgaagatgaaaggcgtattgttattcttttgacacatgccaggatcaaggaaggccagggatcatatccacccttagtcagtaattctttgaaggcgtctaaactaatgatcaacgagcttgtgttggaaattcaagaattcagagagaggctttcagatttatggattgaggtcagatcagttttgacgcctattagacaagggagttcacaggtttcagggtcatctcaattatcatcaaaagatgtgtttctttcaaaggctgaagcaaaaaaatatgtcagattaatgccatttccaagtcaatgtcacataaaaactgacatagaaactatgccattcatgtgtccatgtggcaaagataatcatcaacctgtactaaggtcattggttcactgctcaattggtataaccttcattaactactttttcttacactggctactgggttgtttccttgcattcaaagtcaaggtacaaccaaggtttaggaatgatgttgttcttaaatattcagatgaattagacttgatcaatgttgtgctagatatgcttcctgatactgaggtggtcttttgtcaaccatgttgcaagatcgagagttcaatgcttgactcgaccgaccctacagagcttgaatctcaatctgtgtctgttaccgtgaatcatgacccccttttgaggattccattaacaccaactaagcacctatcctctgatgaattggatgatgaacccaaaaactttgagatttcacctgcacaagtttcctcaaacaaattacccacgcattatcaggccgaatga

SEQ ID NO: 52941 - DNA, 161 bp, Glycine max
  Peptide Sequence Number=SeqID_144626
ctagtggtgcgaggattattggtgggagaggacgcgtggagccacgcaagacaacgatggcagtgtgggatttaaggacgaaggtggagatgggagtggaggagggttggtggatgacggtgtttgtggttgtggtgggtggtgatatgagggtgccatga

SEQ ID NO: 52942 - DNA, 567 bp, Glycine max
  Peptide Sequence Number=SeqID_144627
atggaagtcacgaatcggtcggtgttccccatatgggatccaacaaacatctggaatccagagtcagtccaagcgctccctgtacgccgatgtacgcacgcggtgaatcctcgtcgtagtcctgatcagtattggactctgcgactgagggaaagtgctcatatatccagcactacagagcagtgtgatgtaaccgtcaagctgtcggctgctgctgataaagacatcattcaggtggtcgtacatatgcaccagcgcagctactccctaagcgtacctcccggtctgattgaacaaacagagtacaacccagaagatgaagaagatacgcgagagtcgcaactgtccaatgacctgcctggcatcgacgctcgtagatatcatgtacccattacatgcgtatgtacggtccacgacactatcctgtctcagccctgtcagcctctgcagagaccatcaataagtccaccagcatctgaaccgcataatccacgtgcaagggatgacaggcgtgcaagtcgccaaccacaggcagatgcaatagcgacgagacgtcgtccaacgtga

SEQ ID NO: 52943 - DNA, 1962 bp, Glycine max
  Peptide Sequence Number=SeqID_144628
atggaagactcagattcagttgctacgctgatagattccacaacttctaagatacagcagctgcaaaaggcatttgctgaacttgaaagttaccgagctgttactctgaacttgaaatggaaagaactcgaggaacattttcatggtctggagaaatccttgaagaggcgctttcatgaattggaagaccaggaaaaagagtttgagaacaaaacaaggaaggctcaggagatactggagaagcggcaagcagctgtttatgccaaggagcaagccacgttgcagaggcttcaggagaaaagggatgctgctgtatttgacattgtgaatgctcgagaaaagcagaggaaggtcacgataagtgatttggctattgtctccaatgggggtaaggggacatttcatgtggaggacaaaccagtggatgctgtgtcctttgcagctaatggtaatgtggaagaggtggtactttctcctgaaaatggaaatgtggagttgtcttatccagacttggtaaaactttgtaaagagatggatgctgctgggcttcacaaattcatatctgacaaccgtaagaaccttgctgctgtaagggaggaaataccacatgcattaagagcagctcctaacgccgcctgtttagttttagattctctgaaggggttttactgtacagaagtgtcaaatcaggacgtaaagaaggatgctaacttactgggtgttcgccgaacatgtatcatgctgatggaatgtctatgtgatttcctgagcaactcaggttgtgtttctaatgtaatttcagaagatatcaaggaccgggctaaggcagttgctgaagaatggaaacccagattggatgctcttgacatggatgctagcaatgtgaattccttggaggctcatgcatttttgcaacttctagccagttttggtattgcctctggttttaatgaggaggagttatctaggctaattccaatggtatctcgacgtcgccaaactgctgatttatgtcgttgccttgggttgtcagagaagatgcctggtgtcattgaagttttggtgaatagtgggcggcaaattgatgctgttaacttggcttttgcatttgatcttacagaacaattttcacccattcctttactgaagtcttacttgaaggatgctagaaaaatttcttctcctgtcagaagtgttaactcatctcccactgcacaggtgaccgtttcaaatgatagtatgatacaacaacttttcagtttacatacttcagaaccaaacctttatcaaaaccctgtggaggctccatgtagactctctcttcaagggcatttaggaatgcgttctagatatgtagatgttatattggacaatccagatttgcagcaatctagagaagcactatcagtactgagtttatctagaggtgtgaagttggaaatgcggtgcacatggttctatgcaaatccaacggataaaagtacgttgaaagtaaaaatatatattttttctatgaatattcctaattacttgctattgcctcagattgatgttaatgatcgagaactgattgcacttaaagctgtaattaagtgtattgaagatcacaaacttgatgaccagtaccctctggatcctctccagaagcgagcgacccaactcgagaaggccaaggctgacaagaaaagggtaactgaagcaacaaagcctcaacccaagagaccccgtgctaatggtgtgggatatggcccgcgtgtcactaacattctatctgacaaaacttcttatgctagagttgctgacaggtatcctcaatacgtgtatgaccgaccttacatgtaccctgcaccaactgacaatcactgccctcctctcatgggttctgcaacttataacatctctcctaatcctggcaactactttggaaatggctatcagtaccaagctacatatctccactag

SEQ ID NO: 52944 - DNA, 294 bp, Glycine max
  Peptide Sequence Number=SeqID_144629
atgaagtggaagatgacctgcatgaaaaaatctggtcaaatgacgtatgaggcagcaaaggaaattgcagggaggattgtatgtgactctcatttgacagtggtcatttttaataataattgttggatgagtaaaccaaatgtgtttcatttgttgactacaagattccctagaagagcaggcctcacggggaagctttgtcgctcatggacatcaggatgtactgactactgtcattgggcgaccaaaacaccctggtcatgttcgtgctactggagccaacgtcacgattaa

SEQ ID NO: 52945 - DNA, 504 bp, Glycine max
  Peptide Sequence Number=SeqID_144630
atgaatctggtccctagtctacgaagaaactcgtggttgttgaatcttataacgagattgttttccctgaaccctcagaggtttttcttgcacgtgtacagaatcatcctactgttaatgtgcctaggcttcttgctgtaccaagcaatgctgtggatgataaggagaggtgacaccaaagatcatcctctaacccaatggttcttgaacttctctgaggctgatgagctcttaaaacttgcagcagctcgccagcagccaagccaactttggactggccaacaaggaaaaaaaatagctttaggagctggaagaggcttgctatatttgcacgaacagtgtgatccaaagattattcatagggatgtgaaggcaaaaaatatcttgcttgatgattattgtgaggctgtggtgggagattttgggttggcaaagctattagaccacatggattcatatgtgacaacaacagtgagaggcactgtgggggcacatagcccctga

SEQ ID NO: 52946 - DNA, 240 bp, Glycine max
  Peptide Sequence Number=SeqID_144631
atggacgaagatcaatggacgcatgactatacgatgtcacaagaagttcatatggattatgattatgataatgaagaagaatgtggtgtgaatgaaccacatgttgattgttcaaatgctttgaatacgtctcaggtatttggaataaagaattcgttagaagagacactgggagtaggaaatgtggttgtcccttcaggtttcgtgggaaaccagtgcatggaggggaaggttggatag

SEQ ID NO: 52947 - DNA, 264 bp, Glycine max
  Peptide Sequence Number=SeqID_144632
atgattcttccggatgaccctttgtttcatccgaaagaaccctacttcaggaaattttctggaagaacttcttctggaagtttcgaaagaagtcttcacgattcttccggaaacagccaccgtaacaagttcgcgctttccccatttttttcggcgtcttctaccctaaggttccactatcctaggctaaatgctacaacaataatagatattaaaagcaatggggagttagggaggccaacctcaaaggcaaaacacgtctga

SEQ ID NO: 52948 - DNA, 237 bp, Glycine max
  Peptide Sequence Number=SeqID_144633
atgcaggagacaagactcaaggaactttttgatagtattcctaccttggacgagcttcatgctctgggtggagagggttttaaggctaatatcattcttgtggattcaaagaaagataaaaagctatccatagtgtcacatagtgaacccaacattgccattgcatttggtcggcatagtcgaagaaaggtcattgttgaacagaggacaactagttcaagattttcacaaaagtaa

SEQ ID NO: 52949 - DNA, 438 bp, Glycine max
  Peptide Sequence Number=SeqID_144634
atggagaatgtgtttatgcaattcatggaatcccaagctagatttaaagccaatcaaaactcaattcaaaatctggagattcaggttggcaagagttactccatggaaaattgtcagtgggagcaagagttacaacctcacaatcaatatgaagaagaaataatttctaatcttgataatttgttgatggaagaaaactttgtagaggttgaagctcatgatgaatgtcttgtagaagatcatgattcaagagaaaaagatgaaaaaaggcatggagaatgggataaatctttaagtgtcattctctccttgatctctagcacttctcttgcaatgatatgggaggattttccgggatacatgagtttcatgaagtctctagctaagaggcaaaaatgcaaggaagatgtgttttatgtgaccttcatgctaccttga

SEQ ID NO: 52950 - DNA, 531 bp, Glycine max
  Peptide Sequence Number=SeqID_144635
atggagcactaccattgtattattgatctatatagccatgcagggatgctagaaaaagccatggatatcataaatgagatgccattccccctggatgcaactccatggcgcattatcttggcaggttttcgagtacactacaatatagagcttggaaaacttgctactaaaaaagttgtctcacttgttccacaagactcagctgcctatgtcctattagctaatatgtatgctgcagcaggaagaggtttgattgaggagaaaaacaagacatacacattccttgccggtgattcatcaaatcctttgtcaggccttatttactcaaaacatcaatcagagttaaatatctggttaagagatgttggttaccagccggataaaaaatgtgtggtttgtgatattgatgaagatgaacaaaaagaaactattctttctcatcacagtgaaagactagccattgtaaatgaaagagttctagcagatcttatgcaaattctcattttttttcttttaatagagttttattga

SEQ ID NO: 52951 - DNA, 834 bp, Glycine max
  Peptide Sequence Number=SeqID_144636
atggcttcttcttactgttgttcccgtttgttgttgcaatcacagagttcgcgactaatgttacgattctcaccttttctcgctactccccctactccttcttccctctctttctcctccaactgccacgtgtcctcttccgctcaagcaacactacaacaacaacatgaacaacagccccttccgcaaagctcacagctggtggcattggaatatgctgacctcaacctctcttacaacttggatctgggtcacgtcaggataaggcagcatgttaatcccctaagctcttctttctcggttcctgcacaagtaccagactggaaccatgcctttgcagacccaacattgccgctcatggtggacattggatgtggtaacctgaatctcaatgataatttatttgatgcatttagtgtgtctgttaaggactggcacagatcatgcagtggcaggtttctaatgtggctggctaaaagaactcctaaagagagaaactttttgggattggaaatacgggaaaggatagtcaagcgtgctgagtcatgggcaaaggatctggctcttgataacatgtactatcctaaaactacatatatagatggtggaacttttcttgtttgcaaacgcgacaatttctttcaagcagttggtagaatcatatcccgggcccttggtcttagtttcagtattggatgtcatctacatttttatagtactaagctggtaggccccattgagcaacctaaggctgttcaacaggagggggagtgctttctggggcaattgagacccctatggagcattgcaaggcaagaagggcttgttgactaa

SEQ ID NO: 52952 - DNA, 390 bp, Glycine max
  Peptide Sequence Number=SeqID_144637
atgtattttgaaggttatgataatgacttagagtatggtgtaaatgatgcttttgactgggactttggtctagataatggtcaatcatctgtgaagcagaaagcaaagaaaaaggtggctaatgaggatcctcttgagatgtctggtgacaatgaagtcgacccaccgcatagactggttatgacactaggcataatggagttttctgtgttgaatggttatcaagtaaactatcctaaaaatgattgcgtaaagataggtagtggggtgtttaacaaaggctgcaagaatgaaagcaaggacactaagaagttaatacttggcatgcaattaggtgattggttactcattgtcgaggcaaaggtggaagtgcaccttggtgaaaaataa

SEQ ID NO: 52953 - DNA, 249 bp, Glycine max
  Peptide Sequence Number=SeqID_144638
atggttttgcttttgctaggcaggtcgtcggaacagaagccgttgccagaacggaacagagtcgaaacgacgtcaccggaacgaaatggagtcaccgaaacggaggatgcaggcgtcgcaatgcttcaaagtagcggcgcgaaaaaccgctccagaacctgcgtcgctccgccccgtgccaccgcgacacaaaaccgctccgctacagaggtgcccatcgcggatgggggccgctacgacctctattga

SEQ ID NO: 52954 - DNA, 534 bp, Glycine max
  Peptide Sequence Number=SeqID_144639
atgaggtcctttaatggtgattttccaccatggagatgcagcggaagacaaaggagaagaggtgagaggaggcgccatccactagggaataagccatggaagaaggagcttcaccaccaagatgagccttggataagaaacttggaaggatgcttcaatggaggaaaagaaagagggagagaaagagagagggaggagcacgaaattgaaggaataaaagagggagagaagtggaactttgaagtgtgtctcacaagactctcattcatcaaagttacaacaagtgttacacatgcttctatttatagactagcccatgggctcgaaatctaccctaaggctcatgagaaccctagggccttcccttggatctctggcccaatctacttggagtcttctatccaatgcccttgcggggtaggattacatcattccctccaccttggaaaggatttgacctcaaatcttgaggttcttcatactctgggcatcaaaacacagacacattgttactggcttccttgtgtttactaa

SEQ ID NO: 52955 - DNA, 869 bp, Glycine max
  Peptide Sequence Number=SeqID_144640
atgcaggagatccaaaactacaatgactgcccccatttactttctcgtggggggtatgatttgcttgaaaagaagatattggacgagaaaatgaagaaaagacaacatgaagcaatgatgactgagaatacaccacaccttgaagaccccctatctcccattgaaagacatgttaagtggaagttggcacgcacaaagcgatatgggcagatgacatctcaggcggcacaagaaatatttgataaaattggtacgtttgtcccacatggtcatgacgacatacttaacattgccattgggcgactggatcatggaggtcctgttcatgcaatagcctttggggtcacaataagtcaatactatggaaggacatcacgtgcctctagtagctcatccacatccatcagccaacaacagggatcacagttctcaacacctattaagggagatatacatgtgttaggtgcacgagtgagcacaaaggggagcaatgttgaaactgctgtcaacccatctggggaagaacatgttgcttatgtgatactgactatggggtttgtggcttatgcagatgatgtcgtaagggttagtgttgataaagttattaacggtgacgctgaagtcccattgtcgacatcagaaattaagtatgtttcagccattgctccaaataaagtgactgaagatgttcaaccagtgaatgatgttgctgtagatgaccccttgggtatatggatgaatggagcaatagcttgggtcatggatcggtgtatggattccttgagccgcagtcaatactcaatgcaaaggatagatgtggctaatgtcaagattacatcaagaaatggcttaaggaatctcactgagag

SEQ ID NO: 52956 - DNA, 534 bp, Glycine max
  Peptide Sequence Number=SeqID_144641
atgcaggagatccaaaactacaatgactgcccccatttattttctcgtggggggtatgatttgcttgaaaagaagatattggacgagaaaatgaagaaaagacaacatgaagcaatgatgactgagaatacaccacaccttgaagaccccctatctcccattgaaagacatgttaagtggaagttggcacgcacaaagcgatatgggcagatgacatctcaggcggcacaagaaatatctgataaaattatgagttggttgttcaatttttattacaattatttgaattttggattaattggtacgtttgtcccacatggtcatgacgacatacttaacattgccattgggcgactggatcatggaggtcgtgttcatgcaataggctctggggtcacaataagtcaatactatggaaggacatcacgtgcctctagtagctcatccacatccatcagccaacaacagttggttgaaatcataggaagccttaaggaagaatggaggaatgaatttccagaagaaaacaaatga

SEQ ID NO: 52957 - DNA, 981 bp, Glycine max
  Peptide Sequence Number=SeqID_144642
gtccttggcaacttaacagcagttcactcatactttgatttattcacaaggaaaatcgaccaagatgatatggagcttgaggaggctgagttggagctagacattattcagaaggaacatgcattaccaggacgaatggatgattccaaagattggaatcagattccaggtcttccctcctacagaaaggatgtctcaaggcttcagcaaatcagagagtgcattcgttccctagaaaagtccaaacttaaagaagatatcatagctcgtaggcaaaagaaactacttatgagacatgcccgtcaaaaacatttggaagaagcagctttacgggaagcagatcttctgcaagaacttgatagggagagaacagctgaaatggaaaaagagctggaaagacaaagattgctagaaatagagcgtgctaaaacaaaggaactgcgtcacaatcttgatatggagaaggagaggcaaacacagagagaacttcagcgtgaaatagagcaagcagaatcaggacttcgaccatctcggcgtgattttccatcctccactcacactagtcgacctagggatagattccgcgaaagagaaaacggaagatctggtaatgaagggagcacaagagctggcagtggaagcttacagtctgaaattccttccaccagttcatcaatggcacccttaccaactatagttctttctggatctcgaacgttgtctggacagctgcctactatcttacagtcacgtgacagacaggatgacactggcagcatgtatgaagaaaatgtcgatggaagcaaggattcaggggataccggcagcattggagatcctgagctagtatcagcatttgatggccagcctggtggatatggttctcaaaggcatagttcaagaggaagcaagtcgaggcaacttggagaacgtagagacagagacagcagacgtgaagggaagtgggaaaggaaacattaa

SEQ ID NO: 52958 - DNA, 615 bp, Glycine max
  Peptide Sequence Number=SeqID_144643
atgcaggacatcttaataaaaggtttgactgatggtgctgaggatgaaaaacaaagcataggagaccaccttcagctatatagagatttattgacttttctggcaaatgcagaccccttcttaagagaacttcagcgtgaaatagagcaagcagaatcaggacttcgaccatctcggcgtgattttccatcctccagtcgacctagggatagattccgcgaaagagaaaacggaagatctggtaatgaagggagcataagagctggcagtggaagcttacagcctgaaattccttccaccagttcatcaatggcacccttaccaactatagttctttctggatctcgaacgttgtctggacagctgcctactatcttacagtcacgtgacagacaggatgacactggcagcatgtatgaagaaaatgtcgatggaagcaaggattcaggggataccggcagcattggagatcctgagctagtatcagcatttgatggccagcctggtggatatggttctcaaaggcatagttcaagaggaagcaagtcgaggcaacttggagaacgtagagacagagacagcagacgtgaagggaagtgggaaaggaaacattaa

SEQ ID NO: 52959 - DNA, 93 bp, Glycine max
  Peptide Sequence Number=SeqID_144644
atggattgttgctacagcaacatcaggcgcatatcgttcgctggttcatgcttgtgctggttatctgtcttcatactcaccatctcatgttag

SEQ ID NO: 52960 - DNA, 864 bp, Glycine max
  Peptide Sequence Number=SeqID_144645
atgaagaaggcccttgagccagaaaccatgaccatagtcataaatgctgaccaaaccaaaacctgccacaaaacctacaaggactcagtcagcccgaatgtccctgaaccaataaacagcttgagcctagacaacttcaagaaaatacaaaaactactatttaggaaatttggatgcaccaataaaacctcattctatgaagacaaaactaattgtccttgcaaaataaaattccttttcagaaaagccagattagacctggaccagttcaagtccttcagatatgaggacttggcaatttccacaaaaagtcttctggactttggatgtttagaatcaatcctgattcctccattagacagatttgaagggtttaacccctcaattaatgaagctataaacctaatacagacatatataatggattacatttccatcaaaataataacctgcccgagcaatttttctgctcaaaattatccatgccatgttatgaaactcttactagaggaccatagaggttttctctgtctattcaatgatgaatatgagacttgggatgtacatggtaacatacagtaccaatacatcctcatgagggcacaaatacaagggtaccaatggttcttctcagattcagacaaaagagagtttgacctgataagagaaacccatgacacaaagctcttccagccatcatacaatgagaagttttcattcctttcccagttgatcaaaacaataaattggttcaatttttccaaaaagataagaaagataaagagatctatgaagctagcggatgtcatggatagcaaactcctctttttccatccactgatctttctatggaagactcattag

SEQ ID NO: 52961 - DNA, 231 bp, Glycine max
  Peptide Sequence Number=SeqID_144646
atgtactgtggtcaaagcaggacggctagatttcagttatctaagaccatgtttagatcctcacttgctgcaaatgaaaagatgagttgtgacttgcatgaaatgcttaatctgctaattgattatgagaatcaaattgctactgagaagaagaaaggaactgtcattgcaattaaaaaagagctccaagaagaaaggcaaagtaccaaaaaggaagcatctttgacctaa

SEQ ID NO: 52962 - DNA, 165 bp, Glycine max
  Peptide Sequence Number=SeqID_144647
atgaagaaagagtgtcccaagtatgccgcatggcatgtgaagaaagatacttggtgggtagattctggtgctactactcacataagtatgactatgcagggttgcctgtggagccgaccgccaagtgatgatgaaagattcatctttgtgggtgatggcaagaag

SEQ ID NO: 52963 - DNA, 912 bp, Glycine max
  Peptide Sequence Number=SeqID_144648
atgttgcaagagaatttgagcagtttcaggcttgtctcaacaccaccatcaccatcatcaacaagttcatttgacggcagaaaagtgtacatcattgaccatggccttgcaaaaaaatatagggatcttcagactcctaggcacataccatacaaggaaaacaagaaccttacgggcacaactcagtttgcaagtgtcaaaactcatcttggaattgaacaaagcagaagggatgatttggaatctcttggtaaattatttgctcatgtacttcttaagaggaagggactaaaggctaccaccaaaaaacaaaaatatgataaaatcagtgagaagaaaatgtcaactccaatagagtatgttaaatggttgcaaatttatctggacattgttagtgcaggctatcaatttgactacattttttattggactatatggaagtatccacagattggtggcagtagctctaaaggacggtggaaagctatgcatgcaagaccatctgtacgaaagccagaaaaagtatcagttgggaaagagattcgagaaaaattctctggtgctgttgaagctttctcccggaggaacccaacaagtcctagtcctcgtggtgatcactccaaacataggagttttgaggaagtagcagtacacaaggatgtgtatcatgatcaagagaagggacgcaattcatctcgatatggcagtagttcaagaagacccataatcccatcgtcaactaggccaagttcctctggtgatcatactgatagtcatactggccaactaagttcaagtggaaaccgaccatctacctcacatagaaatattcaacctatgtatgagacaaaacaaccaacttacatgcactctagatccactagaggcaaccgcgatgcagcagtaaaatga

SEQ ID NO: 52964 - DNA, 219 bp, Glycine max
  Peptide Sequence Number=SeqID_144649
atggaaatttaccaacagcaaactcctcggtcatattgtagcagttctatactcatgcagcacaagattgttgaattcttgttcatgaaggcatccaaggagagaagcttcgagataatcgttattattgttgccgtgaaagttgccgaagttggatctgcgacaggaggaatcataggaaatgaggaaggatttgcggcagtgataccagagcggtga

SEQ ID NO: 52965 - DNA, 1098 bp, Glycine max
  Peptide Sequence Number=SeqID_144650
atggaagatagtgtccatatcactaatctttgggaagttagaaagcaaaatagtaaacaagcaattgagatggtgttgatggaccaaacgggtacaaatattagtgttactctctggcaagaattgttcgctgagttccggcacacgttacattgtggttcttcgtatttgattcaaaacctaaggattgttgacaaccagtctaaatacagagtcacccagttccacttttggatgacagtcaagcttagagataacaggttagcaacaactaatatggactatgctattcagcttcatcatgttattgacaaaaaccttttgcttcaggaaccattgattgttatgttgagcctgggtaaaatcaaagatgctacagacaagtatcctctaagcgtccaaaatatcaagtatgggactagattgtatgtcaacactgacattgcagagatacaacaattttgtgatagtttgtgtgtcccattttactctggtggaataatcgatgatagaggtggttctcagtcccaatctagccaaagtaatttggtggagaagtttttgcacaatgctcaggtggattgttactatttgactgttgggacagttgacgaaatcatcattgatgctccatggagttatgacagttgtccttactgtaccacaacatttgatccatcaaaagtaggctcagcttgtcgttcttgccagaaccgagtgaacgacacagttccaaggtataagttaaatgttaggatggagcataatgggaacaaaggaaacttcattttttgggatgcaacatgtatcaagatgtttggtaagactgttgcaaaatgtcgagatgaattgatagcggctggggacgacattaaggtgtttccatcgtgtgttgatgaaatattgtctaaaacttgggctatcagatttaagtaccattcacaattgcgccaatcatgtgtgttggatgccagtgaagaaccctatcatattcaaacattgacaaccacccttgggttgaaaggagaagcaaggatgggaaagacaatagttgttgagcctgaaagttcaccgccaatttaccatcctacggattga

SEQ ID NO: 52966 - DNA, 276 bp, Glycine max
  Peptide Sequence Number=SeqID_144651
atggctttaatcttctttacttgttttcccttactcgatttcacatggatcaaaattgagttcaagcttcccctatttctctgtgcagcatttcaaccccgttctggagctgatagtgaagttgcaggaagctctatacaaaattcagagcattggtcagaggcttatacataccaccaagtgcaagaaaatgagtattcttgcaaaacagacaaggaattgtgcttgtgcacctatatattttctggttacataggccagattcaggaaaattga

SEQ ID NO: 52967 - DNA, 984 bp, Glycine max
  Peptide Sequence Number=SeqID_144652
atggaagatagtgtccatatcactaatcttcgggaagttagaaagcaagcaattgagatggtgttgatggaccaaacggttattgttgtgttctttctgtttgttgttattagtcatttctattgatataatctttggggtggcgccacaccatactttagtgggcaagacattgttggggtggtcgctgatctcattgatgttaagacagttaatccccctcacaagatgacagtcaggctcagagataacaggttagcaacaactaatatggaggactatactattcagcttcatcatgctattgacaaaaaccttctgcttcaggaaccattgattgttatgttgagcctaggtaaaatcaaagatgctacagacaagtatcctctgagcatccaaaatatcaagtatgggtctagattgtatgtcaacactgacattgcagagatacaacaatttcgtgatagtttgtgtgtcccattttactctggtggaataatcgatgataaaggtggttctcagtcccaatctagccaaattaatttggtggagaagtttttgcacaatgctcaggtggtcagtataggtgaaattaacaacctcaaacaggattattactgtttgactgttgggacagttgacgaaatcatcattgatgctccatggagttatgacagttgtccttactgtaccacaacgtttgatccatcgaaagtaggctcagcttgtcgttcttgccagaaccgagtgaacgacacaattccaaggtataagttaaatgttaggatgaagcataatggggacaaaggaaacttccttttctgggatgcaacatgtatcaagatgtttggtaagactgttgcaaaatgtcgagatgaattgatagcggctggggacgacattaaggtgtttccaccgtgtgttgatgaaatactgtctaaaacttggactatcagatttaagtaccattcacaattgcgctaa

SEQ ID NO: 52968 - DNA, 1095 bp, Glycine max
  Peptide Sequence Number=SeqID_144653
atgacccaagtgaggaacaagcaagtggttctaagagactatgtcaccggattccctaaagaatccgacatgaacattgttgaaggcaccataatattgaaggttccagaaggttccaatgatgtccttctaaaaaatctctacttgtcatgtgatccatacatgcgactcctcatggccaaggaccgttctttcggagatggctccttcacccttgcctctccattgaaaggatatggtgtgtctcaagtgctggaatctggacgtccagattacaagaaaggtgatttagtgtgggggattactaaatgggaagagtatagcttggtcccctcatctctcatacatttcaaaattgagcacactgatgtcccactttcctactacactggaattcttggtatgccaggaatgactgcttatgctggtttctttgaggtaggttctcccaaaaaaggagacactgttttcgtttcagctgcctctggtgctgttggtcaacttgttggccaatttgctaagttgactggttgttatgttgttggaagtgctggaagtaaagagaaggtggatctgctgaagaataaattaggatttgatgaagcttttaactacaaagaagagccagacctcaatgcagctttgaaaagaagtaaagttaccgtgcctagtaacatgatcaagcaactgaaagtggatatcaacatacaaatcaggtactttccagaaggcattgacatttactttgagaatgttgggggcaagacacttgatgcagtactcccaaacatgaaatttcatggccgcatacctgtctgtggaatgatctcgcagtacaatcttactcagttcgatggtgtaacaaatttggcaaatctcatatttaagcgggttaaaatggaaggttttattgcaactgatttctatcatttatatccaaaattcttggagtttgtcctgcctcatatcagagaagggaaggttgtgtatgtggaagacattgctgagggccttgagaatggccctgcagccttggttggcctctataccggtcgcaatgttggtaaacaagtggttgttgttactcacaagtaa

SEQ ID NO: 52969 - DNA, 279 bp, Glycine max
  Peptide Sequence Number=SeqID_144654
atggttaatccaactcagtttcaggccaaagaagaaaaggttaaagcaactgatgactcacttagcaaggtagatccgctcagcaagatgcatccacttagcgaggcatccagctcgcttagcggatgggaaaccctagaagaggataagccagagatctgcatgcctagcacgcaaccagcctgcccagtgaggacattgtctcttctcacgctcagtgcgcccattctcgctaagcaaaaattcactaactctcgcttagtgagccatgctcgctaa

SEQ ID NO: 52970 - DNA, 267 bp, Glycine max
  Peptide Sequence Number=SeqID_144655
atggtggtagtaacaataggaagaaggactcagggaatgctgccattgttcaagatgatggctaaatctgcagaggcactagtggtgtctgaaaagaatccagaaactaaatggataatggattcagagaatggcattgcaaggcacaggatagttgcgggcacccctcaacaaaatggtttagctaaaagattcaacatgaccattttggagagagtgggatgtatgttgctgagtgcaggactacccaagatttttttgggctga

SEQ ID NO: 52971 - DNA, 177 bp, Glycine max
  Peptide Sequence Number=SeqID_144656
atgtcaggggaggccaatgatcacggggtgacgtggagttggagatggcgaagagctctatttaagcgggaggaggtggtggtacaacagatggaagccttactttctatggttgatcctggaaaggctacctactcgtgtggctctagtgaggatgggggttatggtggaggataa

SEQ ID NO: 52972 - DNA, 939 bp, Glycine max
  Peptide Sequence Number=SeqID_144657
atggcggaagtgaggaacaaacaagtggttctgagggactatgtgagtggttttcctaaggaatccgacatgaacatagttgaaggaaccacaatattgaagcttccacaaggttccaatgatgtgcttctaaaaaatctctacctttcctgtgacccttacatgagaatgctcatgaccaaggtggaaggcctcgacgtgtttggcacctatacacctggctctccattaacagggtatggagtgtccaaagtcctagaatctggacacccagattacaagaaaggtgatttagtgtggggatctacaaaatgggaagaattcagcttggtgtccccaactcaaatacttttcaaaattgagcacaccgatgttccgctttcatattatactggtattcttggtatgccgggaatgactgcatatgcaggtttctttgaagtaggctctcccaagaaaggagagaatgtttttgtttcagctgcctctggtgctgttggtcaacttgttggccaatttgctaaattgactgattgttatgtggttggaagtgctggaagtaaagagaaggtggatcttttgaagaataaattaggatttgatgaagcctttaactacaaagaagagtcagacctcaatgcaactttgaaaagatactttccagaaggcattgacatatactttgagaatgttgggggcaagacacttgatgcagtactcccaaatatgagagttcttggtcgcatacctgtttgtggaatggtctcacagtacaatctgacacaacctgaaggtgtaacaaatttggcaaatcttatatttaagcggattcgaatgcaagatattgctgaaggtcttgagaatggtcctgcagccttggttggcctctatagtggtcgcaatgttggtaaacaagtggttgttgttgctcgtgactga

SEQ ID NO: 52973 - DNA, 336 bp, Glycine max
  Peptide Sequence Number=SeqID_144658
atgtacctagctgcaatagctgattctcaaccacaaccatctccattggctggtcagcctttctcagtgcttcaacagcagcaaggcatgcacaaccaacttggcatgagttccagtggaagtcaaggcctccatatgctgcaaagtgaagccactaatgttggaggcaatgcaaccataggaaccggagaagggtttctagactttgtacgcatcggtagtggcaagcaagatattggaatctctggtgaaggcagaggagaaaactctagtggccactctggtgatggtggtgagacacttaattacctaaaagctgctggtgatggaaactaa

SEQ ID NO: 52974 - DNA, 558 bp, Glycine max
  Peptide Sequence Number=SeqID_144659
atgaactggtcagatccttgtctgcaagatttgagggataaaattttcccatttgaagaacaaaatgcttcagtcaaattgaacatctacagaaagaagaatttctctcagaacattaagatcagtggaacgattcatccacagatggctggtgcaaaaggatcttcatgtgcaattcttggttgtgattctaaggtgatgagcgatgaacgtggtgttgatattcttccattaaaaataggaggtgggatatgcccaggatgcaaggagccatataagaacacaaaactagatgaagtggctgtagataatgggcgtccccttccacttcctccaccaagtggaatgtctaaaatggagaggagattgtccatgatgaagtcaacgaagtcagcactggtgaggagccaaactggagattttaatcataataggtggctctttgaaacaaagggaacctatggctacaacaatgctatatggccaaaggaaggtagttttggaaatgaaaaagaggatgattttgttcagccaaatgaattgatgaacaaaccctag

SEQ ID NO: 52975 - DNA, 336 bp, Glycine max
  Peptide Sequence Number=SeqID_144660
atgggtgatattgatgttttacatgaattatattacaacgaatgtaaaaagttctcccaagaaaggaaagtgttttcatttcagctacctctggagcagttggtcaatgataagcataagcataagccacacatcaccaaggtgtacacctgcaaacacccaaggggtgcaaaccacccaacagttacaacccacccaaagggtgcaaggtcagaagatgtgaatcaaggggacatgacccttgggaacagtcacaatcaaccgaaaggggacatgacccttgagaacagtcacaaccaatcgaaaaaatgtgaatcaaggggacatgacccttag

SEQ ID NO: 52976 - DNA, 1722 bp, Glycine max
  Peptide Sequence Number=SeqID_144661
atgacagctgatacattcactattgttagccaaaaacttattctcacattggttgtagcaccaacagttgcagtggcaacaaagaaagctactgaaggtgttccaggtgttgggagactggtgcaaaagataccgaattcagtttatgcttccctcgtgacaattgcagctgatgctcaagtcaggaagaacaagcttcagtgctatgctgatattgacagtgggttgtggggttggtcatgcaaatcaacgatgatagcaagggagaattgtgctctaagatgcctttcaccagcttgttacgagctcatctacgagagtgacccgctcgaagagggagaaaaggactttattcgaagccaagagtacaaatactgcatgcacaaaaagctagatgataagaacttcttgttgtggcgacaagaaatcgagccagcgatcattgcgctcggactcaatcacttcgttgcgaaaacaagatcagtttctccttgtttggcttcagtctatgctttcgagctcaatgcttgcttgagttcttggatcgaaacactcgtatcagagctccgtcacacgatgctggactaccgtccagtttccgatttcctctcttggataaaagcgcttattgatgcgcttgcgtcagtagtcatctaccacacatcaccgttgaagaagttgaaggatagattcttgagtgggagctatgtctttgcaaatacaccagacttgaatcttgaagtaacttcttcacgccaacatattcttcagattcgcgaggttctagtggccataatggccgtggcggaggcagtttcaaccgtggtggtggtcgtggcggtcggagctcagtcctgtgtcaagttagtcaatcataatcacacggctctgacttgctacaatagattcaaccctcagtatcaagctgccaatggtggtaacaatagcaattatgggaacaacaacaatggcaattatgggaataacgaaaatcataataactggtctcacaatcagaatcagaatcaaaattgggaaaaatcagaatcacaacttcagaactctaattctaggcctcctcaagctatggtggcaaatttactaggagactgtgcaggatcaggtgactgtgagacagcaatgtcagaactgggagactcaatagaggaaaaggatgcagtaggaacagaattggaagaagtgagatttactgttggcatgaagcaattacttgaagattcaagtctggtgtatttgcgaagccgtagctcctgtgcaagaatgtatcctttagcttcttcaatggtgatgtgtggtagacgactttcaattagaggcaatggtcgagtcaaaatccctaggaagtccttcctgaatcccatccatatgcttgcgatagcgtcgtgtgacagagctctgatcggagctgtcacgcctatgcttgcgtctagtgatgaaaatacgtgtgtattttgtctcatacctgatacgagtgtgtcgatccaagaactcaagcaagcatcgagcttgaaacgtagactaaagccaaacaaggagaaattgatcttgtttctgccacatcaagaaaagaggattgtcgcgatcttcgtcggaaaggtatcacggagggatttgaggactcgcaacaaagtgattgaatccaagcgcagtgatcgctggctcgatttgctgtcaccacagcaagaagttcttatcatttag

SEQ ID NO: 52977 - DNA, 465 bp, Glycine max
  Peptide Sequence Number=SeqID_144662
atgattttgaaccctaagggaggaatttgggaatttcaaaccctaaaggaggcacttgggatgatgggtgaaagaatgaatggaaagggtgggttatcatcgtcgtcttcatctcctgcgatggtgaagtgcaaatgtgaggtacctactattatgctcatgttacgcggtgtgaaccatttggggagaaggttttggagatgcccatactgtaacgaagctaaaacaaatgcaaaagaaataacagatttgaggggaaaaattgttgcacaagaggaagaatgtcatgcatcatcagttgaagttgtgcagttgaagagtaaaattggaaggaaaaagaaaaatcttgttgctgaaaggaatagaatgaagttgttaggttttgtagttgtagttctttgggtgttcatttctttactcagcattgtaattgcaatgaatgttggtggtcatagaaggaattga

SEQ ID NO: 52978 - DNA, 558 bp, Glycine max
  Peptide Sequence Number=SeqID_144663
atgcaggtcatagcagaagcagaaaagggagagtcagttgctatgctcctttctccaagctgttcgcctgctttgtctgattgctcacataattcaaatgggagcctattcaccatgtttcttacagctccactgcaagctttctgtatgctgttaggactttcaggcactgatattgatttggacacattcaacaaagctgaaatgctgctctcatcttcattaaataactggggactagcattggcaacatcagacacacttaatcctgtttggggacagattttaggtgatcccttcataaggaggcttcttttgagattcatattttgccaggcagtgttgaccctatatgcaccagtttacaatgacaacaaattccttccaacatgtgtcccttctcttccgacacctgtcctgcccccaagttactcatatcagagtgtaattctgaatctagccagcatgtttggtgcaactaagagattcatcttctcagaggatgttcttcctgaaagttttgtgcctatgacaagaaaacctctaacttggatataa

SEQ ID NO: 52979 - DNA, 690 bp, Glycine max
  Peptide Sequence Number=SeqID_144664
atgcattataaaaataaaaagagaatgcaaaagaaaggaaaggtggtatacgtgtgttgctcaagagtatacgatgaagttgggtcattgttcatcgccgaagaagaaaaggtgcataagaaaaatttagaaacctacgaattgttgatccgtttgactcatacagatcatcaatctgtatggccatatgaattggcaatccgtatgcaagcagaaagaagaagcaatgtgcgtgagaagcagaaagaagaagcagaggaacaagaagcagaggacgaagaagaagaagctgatgtggcgcaagtgactcatatggacaagtcactgttgctttttatattaaacaggtgtctaagcaaaaatgctgggtgcccaaagcaacactcccacatcaaaggaagtagtgagctcctagttttaacatcagctactagacctacatgcatatgcatgccacctccacaagcgttgagcgcagcggtgaaggtgaaggtaccggcgtcgagcgttacggtggtcggtggcggcaaacgaggtacgcagatggtggtatctgtcgcagacatggacgaagatgagtggatgtatgaaataatgtctgaacgagcggatatggattatgaaaatgtagaatcatgtggtgcgaatgaaccacatgttgattgttcgaatgcgttcaagacttcttag

SEQ ID NO: 52980 - DNA, 695 bp, Glycine max
  Peptide Sequence Number=SeqID_144665
atggagaccctttcacaaatgcttgtacattccaaattttggtcgttgcctaccatcatgcgcaacgacgatgtggcccagcaggaaagccccaactgggtgattagccggtgttggacgaagttatgggtgtttcccccgttgacaaggagcaccacgtggtggttagagatgaggcccactaaccgtattgcttctggtgccaagtggcccgctaagaaattcaggctgatttgggccggggtcttctgcctccgcgatgagaaggaaaaccctagaggcacaacggtgacctctgtgggggagtcggtaataatggtggaaggggtgttgcgcgaagaggagactcagtggttggactgggtgtcatgcgaagaggaaacaaaaggggtggcggagcgcgtggccacggcaactgacgaacatccgagagcttctcttcctgcagcctcgccagtccgacagcttggactagagtcaggggctggtgagcctgcacctctcgacgaatctccgggcttaaacaaggcacttgtggggtcttcgtactgtgacggagcaaaacgggtttgcaaggcctgtaggaatcctggccaggaggagcagagggcgggtgatggtggtctggtggtggttgtgcagtggaagatggagttaacggagaaactctgtgaaggagctcatccatttttaag

SEQ ID NO: 52981 - DNA, 273 bp, Glycine max
  Peptide Sequence Number=SeqID_144666
atgggaagaacatctacttgggttgttgtgattaacacattggagggtacatcctttgtggtacaagtagaggatacatctacttgggttgttgtgactgagaacaagagagggtacatctcttgtggattagttcaagtggagggtacatccacttggttgttcaaagagaacaagggagggtacatcccttgtggatctttgcttgtaaaggattttacaaggttgaaaagaaatctcaaggaccgcaggtcgcttggggactggatgtag

SEQ ID NO: 52982 - DNA, 243 bp, Glycine max
  Peptide Sequence Number=SeqID_144667
atgagtgaccaagtgggaaaggagggagcctctgcttctaaccctttgcgggattggggcttagggtttccgccaatgagagagacaactgttaaagaatgtgggtgggcacgagtgagaggcgcatgccttttcaataaatgtatagcgaaggagaagatgagtgaccaagtgggaaaggagggagcctctgcttctaaccctttgcgggattggggcttagggtttccgccaatgagatag

SEQ ID NO: 52983 - DNA, 227 bp, Glycine max
  Peptide Sequence Number=SeqID_144668
atggcgatagtggaatcatggacatggggatcccttgaattaaaagtctttctagttgatgattccatgcatggaggcctagtggccatcatgtggaagaggctcataattgaaggggagattgttggagtacaatttgacttggtgaccggcttggacgagtatgatgcagttggtggtgtatctatggacatggggatttgttgtatcgaaagtcttcttggcag

SEQ ID NO: 52984 - DNA, 366 bp, Glycine max
  Peptide Sequence Number=SeqID_144669
atgggtgaccttctaggaagttttccagaaagcgtgacgaaccaggcaaaagctggtggacatgtaatacccaagacaccggaattagatggatccggaggctatgcaggcatggacagtatagttgatgatgacttaaaggaattaattggtactacctataccaacaagatgcatctactttttagtagcatattacataagaactccatagttaagcatgtttggcatggagtagttatgggatgggtgactttctgggaagtttcccagaaagcgttcattgatcctgaaagtatgagaaacatattgtttaggtctcagaaaggactatctaggagggctttgactggtgaaagattctga

SEQ ID NO: 52985 - DNA, 1275 bp, Glycine max
  Peptide Sequence Number=SeqID_144670
atggagggaaagaggtatttcgtggcggttcacgtcggcgccggttaccactctccgtcgaacgacaaagccctcaggtccgccatgaaccgcgcttgcctcgccgccgcgtccgttctctctaacggttcgggaacgcgcttagacgccgtcgtagccgccatccaagtgctggaggacgatccctgcacaaacgccggcagaggctccaatctgaccgaagacggtggcgtggagtgcgatgccagtgttatagacggaaaatctggtgcttttggcgctgttggagcagttgcggtttattatgctaggggcacacttgctaaggcgaatgcattgtttctaccacttcttttattatcaggtgtccgaaatgctatacaaattgctgctttattggccaaagagcaaatgatgggatctccattgttgggtcgaattcctccaatcttcttggtgggtgaaggggcttgcaaatgggccaagtctaaggacattgcattgccaccaagtatagaggaggccaatgagtggctggtcacagaaagggcaaaagcacaatggataaaatacaaatccatggttgaatctgctagatctaagacagagaacactcctgagggcgattcttctgtctatcaaaatgccacagtaccagattgtgctttggaagatcgcgtaatggacactgttggggttatttgtatagataatgaggggcatgtagcatcaggagcctccagtggtggtattgctttaaaggttagtggacgcattgggttggcagcaatgtatggttcaggttgttgggcatcatcaaaaggtccctttggggctccattcatggctggttgttgcgtatcgggggcaggagaacacctaatgaaaggatttgcggctagggagtgctgcgtttcattgtcactcaaaagtagggaatatattatagatgagtaccagagctcgcagtctggtgctgcctctgcttgcacgaaaattctacgctctgttgttgaggatggcaggcaatgtggtactgatagcagtgcagggatcttggttgtgcagtcagatgcatctttgacagatcaaggaaaatcatcaaggctgaaagctgtagagattgctgctgcatacacttccttgtcttttggagtagggtattttggaagctctatggaacggcccaaggtttcaattcttaggagtacaaaacaacaaagcaagacagcaatagatcaatttggagcacgaatagatctttcaaatggatag

SEQ ID NO: 52986 - DNA, 936 bp, Glycine max
  Peptide Sequence Number=SeqID_144671
atggtgaccaagtatgttctagtgcaggattaccttctggatgctccagtttctgttggagatggattctctttcagtggagggaagtattcagatggccctagtccaagtgatgaatggtttaagcaagggaaaaaggttaaagcctattcaatacctggcactggtgaaaaggcaaaagatccaatttttggacttgctatgggttccggttctcaagctactggcgatcgtttcagatggttttgtgttgaaagcggaagtgctgataatccttcagtgatattaatccatggtttcccttcacaggcatattcttaccgcaaagttcttccagtactctccaaggactatcacgtcatagcctttgactggctaggatttgggttttctgacaagcctcaacccagatatgggtttgactacacactggatgagtatgtctcatcattggagtcacttattgatgaactggctgctactaaagtctcacttgttgtccagggatatttttcgcctgttgtagccaagtatgccagcattcaccaggaaaaagtcagaaacttaatactccttaatccgcctctaacagcccaacatgccaagcttccaccaacattgtccatattcagcaactttctactaggtgaaatattttcacaggatccattaagggccagtgacaaagctctaacaagctgtggcccctataaaatgaaagaagaagatgcaatggtctatgaagaccctatcttacatctgagatatgtggaggatatgcaaacaatactgaaggacaaaaattggaaagttcaaaccacaatatgttggggccaaagagaccgctggttgagctatgatggagtggaggatttctgcaaggattccaatcataaactcattgatgttcctacggcaagaagtatgcattcataa

SEQ ID NO: 52987 - DNA, 780 bp, Glycine max
  Peptide Sequence Number=SeqID_144672
atggacttaaaagatgatgctgttaagggcatagtcccttgggatgggactctctcttcatttgatttttccctttctgctcatacattttctgacaagtggaaaaggttcaatccttcatttcctgcttggcagtggatcacatgtccaaaacaacatcatttggttgcttctcataaggtggaaggatacttatccctggagaacatgtgccatatcaaatcaagtcaggaacaagagagtgatagaagtctcacatggaaagaagagtccaacatctcacagagagaagagccctttgataaagcaactttagtatgtccagagcatgaagtaaaccactatgattttcatattgtctacagtgcttcatatagagttccagtcttgtacttccgttcgtaccgtagtgatgtggatactagaaatgctagttacataaataatcctgcgcagtttatagcttatgatgggcaacttttgccgtttaatgaaattgaaaaggaccttcctggtcactctgcaaagttacggtcagaatccaaatggacatttataactcacgaggaacatccatatttgaacaggccatggtacaaattacatccatgtgggacaagtgactggatgaagcttctctttcatagtgactcatctttgaacaaaaatggttttgttattgaacagtatttgatttcctggttctcggtcattggacaagttgttggtcttaaaattcctttggaaatgctggatactgtagtttctaatgattcttag

SEQ ID NO: 52988 - DNA, 582 bp, Glycine max
  Peptide Sequence Number=SeqID_144673
atggcgacgtcgtcaccggttccatcaccatcctctccaacaccagactccattcaaatccaaacaaaggtcgttgctggcgagctcattgctggagagggcgaggtactggaggtgctgccaggtgctgtactcgggagggatctggtcggagaagaagttgccgacgaggtgaaggtggcggaggaggggcatggcaagaaattaagggttttgtttgagttgaaattgaaacgaaagacaatgttcaagggtaacaacaacaaggagtttcagtttctaggcggtgatgagaacttcgcccctaaggattttcccttaccgatgttgtcacccgtgaaggacattgagcttgacataggtcttggctgggatggggagaagaaaaccattgcagctagtgatgaatggtgggaagccaaaattcaggcagaggcttctagaacctgccttcgaacatttgctagctcctctgacattctttgtgcacgtagtgctattaggtataaactagcagccaagaaaattgtggctaatgcaaacacaccagcaacagagaacaacccttctctaatgctgtag

SEQ ID NO: 52989 - DNA, 444 bp, Glycine max
  Peptide Sequence Number=SeqID_144674
atgactagagacaatccatctaacttacaaccctttgatcctgagatagataggaaatttcatagattagttaggcatcattttgtaccttttgagcatcctgagcattctgttattggtgagactgagcattttgtggttggtaattttgaacatcctggttttgagcattatagttttgaatattctgattttgagcattctgagaacatgaccaaacctccaccccgtgagaggactctaagggaaatggctgcacctgatttcacctacgaaagcttgtgcatccaatacccggatgaggatgtcccatatgttcttaaaactggactgatccatttgcttccaaagtttcatggccttgcaggcttttcctcattctctggagggagtggcaaaggattggctatattaccttgctccaagatccatcacgagctgtga

SEQ ID NO: 52990 - DNA, 273 bp, Glycine max
  Peptide Sequence Number=SeqID_144675
atggacgaagatcaatggaggtatttggtactcgagatgatgttttgcagtgggcttgcccatgaaaatggatttgttgcagtgattatgaggtttgacacagagaccggtagcaaaggaagaaattcatttgtcttaattgggtgtgaaaggagtggtacgtacaagtgtaggaataaagaattcgttagaaaagacactgggagtaggaaatgtggttgtccctttaggcttgtgggaaaccagtgcatggaagggaaggttggacggtga

SEQ ID NO: 52991 - DNA, 213 bp, Glycine max
  Peptide Sequence Number=SeqID_144676
atggagtcaggtggcaggcggagataccttatggtcatccgcacctttcgtaaccaggggcaaaagagccagttggtttttgctctcgttgtccaaaagacattcaagcccaacgacgcacgagattcttctctgatgggcggggacgatcaagttcgatggcgtagggaagtatcgtggttgtccccgctttatcgctttcaaagacactga

SEQ ID NO: 52992 - DNA, 295 bp, Glycine max
  misc_feature (4)..(4): n is a, c, g, or t
  Peptide Sequence Number=SeqID_144677
gaancggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccccaggagaacttgaacaagaagcattggctcaaaatgaatctaacgcaaatgctccaaccagacctgaaaaatacaagccagaaggaaagaaggcagttgggtgtatatgtgtgcacatatacacccaggggatcctctag

SEQ ID NO: 52993 - DNA, 321 bp, Glycine max
  Peptide Sequence Number=SeqID_144678
atgccaatctccccctgtaaaagtatcagttgggatcgcacccaagagacacccagtggacccggaaaagtccaacagggccctggggtttccagctctggttacgggcctctgtcagtcctacagggtgctcgtacccccccaacaaggtcacatcatcatagggatcgcgcctgcaagacacccagtggacccgaagaagtccaacagggtcttggagttgtccgtgacctacaagccatcatgcgtccagctaaagacgttaaagaagcgctactaggaggcaacctagtaccttttgaatctgtgcttgttatttga

SEQ ID NO: 52994 - DNA, 282 bp, Glycine max
  Peptide Sequence Number=SeqID_144679
atgggtaaggatcgcacccacaagacacccagtggacccggaaaagtccaacagggccctggggtttccagctctggttacgggcctctatcagtcctacagggtgcccgtacccccccagcaaggtcatgccatcccgacatagttctacggagtgcctgtcgccccaacaaggtcattaggccccgcattaaccgggctttcatcaagaagtactgcgccccagacgggcgcagggcgagacaccacagtagcattgggatggccggtagcgggcaatag

SEQ ID NO: 52995 - DNA, 213 bp, Glycine max
  Peptide Sequence Number=SeqID_144680
atggaggttgatgaaccttggctagggttatggccaccattgaattatcaagtggtgttcgtcattggaagtgcggtagaagactttgtggttgatttagggatggcctttgtggataaatgggcagcaggaacggcagtcattgcatgggtttctccctcatcctcaccctcttcatttgccccagttttctcattcgtccaagcaggatga

SEQ ID NO: 52996 - DNA, 324 bp, Glycine max
  Peptide Sequence Number=SeqID_144681
atgcctgcagtgcgtggcgagaaagttgctagtgcacaggattttggttggcaatcaaagggagacggccactttgggtcgtggtttcctttcttttttgtttacttggtgacaattctgtattgttcagatattgtctggtctgaagacctttctggatggcaaggattgacattctcaccctgggtcaaggtttatgataagttgggattttggctcaaggcttgtagaacggttggtcatcatatatgtcagggtttcgccagcggttcggggataaaggggatgtcctacattatttccatgatacacatgcaacaatga

SEQ ID NO: 52997 - DNA, 581 bp, Glycine max
  Peptide Sequence Number=SeqID_144682
acttccaattagtaccaaccattgaagaatttgaggaaattctaggatgtcctctcgggggaagaaaaccatatctttcctccgggtgtctcccctctttgagcagaattgcaactgtggtcaaggattcagcaagaggtttggaccgcataaaacaaactcggaacggcataacgggcctaccacagaagtacctagaagacaaggcgaggggtatggcccatcaaggagactgggtcccgtttatggatgtgttagctttgctaatttttggggtcgtcctctttccaaacgtggatggtttgatagacctagcagcaatcgacgctttccttgcctaccaccatagcaaggaaagtccggtggtagctgtcttggcagatctatttgacacatttgaccgaagagtcgacctgcagggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 52998 - DNA, 246 bp, Glycine max
  Peptide Sequence Number=SeqID_144683
atgctacaatgcgaagggttttcctctaagctcagatatgattttgaaatttccaacggtgagaatgttcagaatttggttgttaacatgatactcaaatttcacgacgatccaacggtgaacgagttcgagattgttgtttttctgagacaggtttggtgggctgcgggaaaaagaaagggttttgagaggagaaggggaaaaacgaaaatgaggcaaaaaaaagaggcaactgacttaacataa

SEQ ID NO: 52999 - DNA, 495 bp, Glycine max
  Peptide Sequence Number=SeqID_144684
atggatcttattgaaaataaggctgcaagtgacattgctattctcagagatagagcccacataccaacaaagaaaagtcttctcgaacttacatcacaagatgcactgttggcacataacaagttgttgtccaagcaattggaagcattgatcgaaacactaaggtgtgccatctgtggtagagctcacaattctggctgttgtatccccaatgaagaacaagctcatgaagtcaattatatgaggaaccaaccaagactaaatttcaatgcaggtggatattccgaatttcagcatggccagccatataattcacaacagagacaatggcaaaatcaccctggtaaccaattcaaaaaagaccagggtggtccatctacaaggccacaacagcaaaggcctagtctctatgatcgaacaacgaagctagaagagactctagctcaatttatgcagtatctatgtctaaccagaagagcatggagtttgccataa

SEQ ID NO: 53000 - DNA, 894 bp, Glycine max
  Peptide Sequence Number=SeqID_144685
atgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaaccaaccacgaggcgggtgctcgcgggaggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 53001 - DNA, 549 bp, Glycine max
  Peptide Sequence Number=SeqID_144686
atggcccctaacaacaacagaagagccccagtagtgggcgcgaggaaaaaggaaggagatgcccacgcggtcaccaccgccccgaccccccggcgcgacccttataaatacgcacagcacccgaaagacaacttccctcctattcccatggcatattccgagttatggccttcattattggagaatcacttggtggtggccatacccgggaaggaggaaggcccaaatgttaaaaccaacccgctagctagtcatggaggggctagcgtgaacgtcatcgaagaggacgggccatcacggacaaagaggttaggagacgtggctacttctagacgcttcatctatcaatcactgcaagcggcatgcatggtctcccgaggtggaggcgaaagggacgaatgtttatttcacctcggggagtcgcacgacatggaaacctgtcccgcagtagaagaattgcttcagcggctcatggattgcgggcagcttgaagtatccataggggggagggaagaaccacaaatttgcatgcagtcggaagagaagaag

SEQ ID NO: 53002 - DNA, 177 bp, Glycine max
  Peptide Sequence Number=SeqID_144687
atggatacctcaaagccttacactggggcaatgaggggcaccattagaagttctcacccaataggttccctgctacatggtcatgacgaaagacaacgattggttacctcaaagccttacaccggggcaatggagggcaccgtgcatgaacctcaagcaaacctagaggcagattag

SEQ ID NO: 53003 - DNA, 210 bp, Glycine max
  Peptide Sequence Number=SeqID_144688
atgaaagtgagcaaagactatttgaattttcaaccctatactttagaaggtgcggaagcaaacaagtggagatggtttgagggggtctatttttacgttgatgccgccagcagaattggcgagatagctgtgccgccatctgcattggtgagaatgctgctgacgtgcactgatgccgccattcacaatagcgagaagcttgttgactag

SEQ ID NO: 53004 - DNA, 184 bp, Glycine max
  Peptide Sequence Number=SeqID_144689
atggagaattgcactaagcaatcactacacatggctcctaaactcgaagaaatcaatacgcatggctccaaactcgagggtggaggacacatgaacgaaaacgcaaattcatggggctccgaaaaaagattgagaatggagaattgcactaagcaatcactacgcatggctccaaaactcgaag

SEQ ID NO: 53005 - DNA, 522 bp, Glycine max
  Peptide Sequence Number=SeqID_144690
atggcagagccatcgaagaagagaaagagatcatcctctaccgccgctgttgctgcccatcgccgccacaaaccatctaaagcatccacagcacctattcatccatctttatcatctccaagatcatccacattgttttcttccgatgatcagcgtctacggtacctctctcaattttcttctaggatcatcttagaccctaagtacctagatgtagagttctttaatgatgaaatgtttgattgctatcaagtgtttcaaaattctggccttgttgatttcatgtcattaaaactgccacattatcctgaacttgtaaaggtcttctactgcaatttgaaaattcaggatggcattatttcctctgaggtgcatggtattcctatgatcattgatcagtccttattcttttctttaactcatttacccagtcaaggtgcaccttttgagggcaccattgttgatgactggaaatttgattattctagtcatgatgctcgccgcatggtctgcgatgattag

SEQ ID NO: 53006 - DNA, 927 bp, Glycine max
  Peptide Sequence Number=SeqID_144691
atggtattagctgagggagaaactctactcgcatattccagatactgcaggttgcctacagacttcagagagatagaagctgctttatgcatacctggccgagggttcatcttgaactctgagggccatcctgggaggattctcaagaaggatttgactacactagctcaagtgtggagtgtcctctcatactccaacttggcccccacgtcacatacctctgatttgacagtgaacagagctaggctgatctttggcctagtctctcacttggatatgaacataagagcgctgatttctggccagataacttctatagctcagtctaacacctctagacttgggttccctgctctaatcatcgcattatgcagagccaggggggttgtatctgacagccttaccttcaagcgcctgagcccggtcattaacctggcctacatcaggaagaacaattggaaccctgaggatctaacagtctctatccgaggggctaggagggcgagggcaaggctagctaagcttccttctacttctgcagcccctactccaacatccacttcagcagccccttctatcccagctcagacaaattctcagtgctttgaagccatgctccaaagcattcatcagggaaagatcattttactacagagtttgcaaatgatggcacctccagactctattcctacagtagagcagtttaatgagatggtagtctggactgggacccaatcttctcttcataaggaagacaaaggtcccacagcccaggtacctcagcatatggaggatgagtcatctgaggccaccatcccaaagccatttgatataggagaagaggtagaagagacacaggtgagacaggtagctactaccattcctgagcgatcccttgaggctacttcagagcctttttcaccagtg

SEQ ID NO: 53007 - DNA, 696 bp, Glycine max
  Peptide Sequence Number=SeqID_144692
atggacataagtatgatagatgctgccaatggtggagcccttggagacatgacccctgctgaagccagaaatttaattgagaatatggcttcaaactcccagcaatttagtgctagaagtgatgctattgtcattagaggagtgcatgaagtagccacgaattcatcttcatcggctgagactaagaagcttgaaggtaaactagatgccttggttaacctggtaagccaactggccatgaataaaaaatctgcccctgttgccagactcggtggtttatactcctctgccgaccaccacatagacctttgcccttctgtgcaacaatctgaagcaattgaacagcctgaagcttatgctgcaacatctataacagacctcctcaacctcagcagcaaaatcagccacacaaataattatgacctctccagcaacaggtacaatcccgggtggaggaatcatcccaaccttagatggttgaatccttcacaacagcagcaacaacaaccttattttcaaaatgctgctggcccaagcagaccatacgttcctccaccaatccagttgcaacaacagcaacagccccagaaacaacaaacagttgaggcccctctgcaaccttcccttgaagaacttgtgaggcaaatcactatgcaaaacatgcagtttcaacaagagaccagagccttcatttag

SEQ ID NO: 53008 - DNA, 1124 bp, Glycine max
  Peptide Sequence Number=SeqID_144693
aaggagggaccgatgtgcgctgttgtgatcttagacccctgggtaatatccaggcagacgttacacccaaagaaaagtcaaaaggcactgtagaaggtatgctgggctctagctttggtaagctcaacctaggggacagcttcgcaggaacagaagaggaagctgctaacaccaaagaggtaacctgctataataccctacatgatgatcgaaggcacaggaatcacatagagggaaagtatttgaatggtggagcgaaagtagctgctgaccagacctttatcggggaagaagagggacatgtcacgcagtctctctctccttctttatcggggcagattcaacaaggaattgggccaggttgcattaagggcccaatttcgactcaaggagggtgtaataaagaagacatccacccagttgagcttttgggggtgcaagctgtgcagaataaaaaagagggtgggctaagtaatgatttaggcccaattttgaaaactgacgggtgccataagaaggaatccctacctattgaggaaaagcatcctcaacttcaagatggcatccaggctctagcagatcaacttgccaatcaggataaggtcaaaaatcagagttacgtggactcagaaaggaggttaaaaagcataattgagtgcagtgataaggtgttgcaagaggctcaacaattatggcatctcggagaaaacttaggcatggagacagctctgtggggtcagtcagactttgattggaaatggtttcctgcggtcaatacagctggggggcttttctgtgtcaggaataacaataacttccagggggtatggctggtagaaagtcagagggtagtggtggctaatatctatgcttcttgtgagctagaaagcaaaagacagttatggcagaggctatatttaatgaagaatcagtcccaggttcagtgctggtgccttgtaggggacttcaactgcattaaacacccagctgaaagaatgggaagcactctttgtaatgcagacactaatcttatagctgaatttaatgagtggctcgctgaaatggaggtagatgatattccttgcttgggcaagccctttacttgggttaggcctaatggttct

SEQ ID NO: 53009 - DNA, 936 bp, Glycine max
  Peptide Sequence Number=SeqID_144694
atggccccgaggaagcttacctcaaagaggtccaggaaggacaaggcagtcgaaggaactagttccgctccggagtatgacagtcaccgctttaggagcgctgtacaccagcagcgcttcgaggccatcaagggatggttgtttctccgggagcgacgcgtccagctcagggacaacgagtatactgatttccaggaggaaatagggcgccgacggtgggcatcactgatcctgggtaaaggggtcagtggatcccgtttgatgccgacgctatcgccaactcctaggatatctgttggtgtggaagagggccaggaatgcgagtatggccaaagaaggaaccggtctgatgggttcgatgaggaggccatcgctcagctgctatgtataccggggcaggattttgcccggactgctgcagggaggcgggtgcggatcatgcgcaccaacatgaccaccctgactcagatatggatgactctgctgctcagcaacatcctgcccaccgatcataattccgacctccccatgccgaagtgccagctggtgcaccctttggacccagataagtccaacagggccctgggattccccgcactgatcacaggactctgccagtcgttcggagtccccgttgcacctaccaaggtgattcggccgcccatcacccgggcttttattgagaagtactgtacccagagacaggctcagggtgatgctccacaggctgcaggcgcgcccccaccacctcatcaggctggccaggctggggcatttgacatggagcagtatttacggcatttggttcgccagcaggcggccaatcaccgagcacatgtacggacccatgattgtctgtaccagatgagccttagcatgcagagccagggcttcgctcctttttcatgccctactccagaccagttcagggcagag

SEQ ID NO: 53010 - DNA, 204 bp, Glycine max
  Peptide Sequence Number=SeqID_144695
atggccaagaattatgaaagcgatgaagaggattccttgaagaagagttggtacatagatagcggatgctctaaacatatgacgggagatgcatcgaaattcactcatatttctcccaagaaaagcggacatatgacttatggcaacaataataaagtaaagatgatgatccttggttatggcataaaaggattgcccatataa

SEQ ID NO: 53011 - DNA, 1065 bp, Glycine max
  Peptide Sequence Number=SeqID_144696
gctgtcaaagtgtgccgccagcaacacagtcgcatccgccatcgacagagaagccagcttccgtaacgcctcctgtacccccccccgcgcagccttatgcgttgctgaaggctgcgagttggaccgatttgcccggcctggaaagcgaagactggttgacgagctggaatgcttggttgcaaagctgtcagggattgaaaaataagcccgattggcaattggtctgtgctgcggcgcaaaacgtgaataaagatgctcaggcgatacaagcctactggcagcaatattttaatgtgtaccagacgcaacaagtagatggtgcgcagcaaggattgatcacagggtattaccaacctgtgttgaaaggtgcccgtcatgccagcgcccgctatcctgtgcctttatacaaagcaccatcagacctgatcacagtgaatttgtccgcgttgtttcctgaacttaaatacaagcgagtacgtggtcgcttgcaggggcagtcgctgatcccttattacacacgctcagagattgagcagagtcagtcgccgctggctggtaacgaactgttatgggtgaatgatcccgtagaggcttttttcttgcaggtgcagggttcggggattgttgagctggaaaatggtgagcgtttaccggtcggctatgcagaccagaacgggcacccttatcaatcaataggtaagctgctggttgatcgcggagagatggtggcaagtgaggcttcgatgcaggggattaaaatctgggctgcgcaacatcctgagcaattgcgcggcttgctggatgcgaatcctagctacgtgttttttaagctgttgccagcaggcttgtccgggcctttgggcgcactgggcgtgccattaacggctgcccgcagtcttgcagtggatccattttatattccattgggtgcgccggtttatttggcgagcacctacccaaactcacaagcgcttttgcagcaattgatgatggcgcaagatacaggtggcgcgattaaaggtggtgcgcgcgcagacgtttattggggcgatggcgaatcggccg

SEQ ID NO: 53012 - DNA, 375 bp, Glycine max
  Peptide Sequence Number=SeqID_144697
atggataagtgccaaagacgatctccacagacacgatctccacaatgtggttgcagtcacggaagcgcaggcgactttgacacaaggagaaagaagaagaacgatagggttcaagcacaaggagaaagaagaagaacgatagggttcaagcgcgggttgtgcaatttcaaaagtttaatttataatgataacaacatcggttttttaaaactaaccgatgttaacatcaactacgtaacatcgaaagctgttattttagtagtgagacaattagacagaaatgtgaaaattattagatatgatagatgtggtgaatattacggaagatatgatgaaactgggcaacacccaggtccatttgctaagcttctttag

SEQ ID NO: 53013 - DNA, 384 bp, Glycine max
  Peptide Sequence Number=SeqID_144698
atgccacccaccaggcaccctctagacccggataagtctaacagggccctggggttcccggcattgatcacgggcctttgccagtcattcggggttcccgtcacccctagtaaggtgattcgaccgctgataacccaggccttcattgagaagtattgcacgcctaggcaagcggccaaccaccgagggcaggtgcagatacatgagtgtctctaccagctcagcctcagtcaacagggggctgaggtcgcattgtccggagactggcccgaggcccaggcaggggaggcgcctgccggatcccccagcgatttagaggaggcctgtatggatgaggagatgacggacttgctcgatttcttgggaggaagcggagccacgtga

SEQ ID NO: 53014 - DNA, 258 bp, Glycine max
  Peptide Sequence Number=SeqID_144699
atgacggtgaaaacctctgacacatgcagctcccggagacggtcacagcttgtctgtaatcggatgccgggagcagacaagcccatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 53015 - DNA, 459 bp, Glycine max
  Peptide Sequence Number=SeqID_144700
ggaactggaagattgtggaggcctctggtaatcgattaccagtctgtgtattcgattacacagaggaatgggtcactggtaatcgagtaccagatcgtgatggcggcgcagctaatccatgatcgagtggagatggagtgcctaggagggagcttgggagaccctcgaaggcaatacgagggtgccgatttcggggcacgatttcgattttacggctacttcattgggtgcattacggatgaacccggcacgcacgcttcagcgtactgtggagtggatactacccacgcctacaccatactgtctagtggagcccgtccaagtgatcgagagggtgatgaggacccactccctgaggtggattctcccgaggacgtcatgtcggcatctgaggcagactctacggaggatagtggtcctggagagatggcgatcagtggaggctcttcatcattgtag

SEQ ID NO: 53016 - DNA, 51 bp, Glycine max
  Peptide Sequence Number=SeqID_144701
atgaatgatgcaatgcgtatgcatgaaacggaaagaaaacaacataaaggg

SEQ ID NO: 53017 - DNA, 696 bp, Glycine max
  Peptide Sequence Number=SeqID_144702
atgaccgaccctctcaatgagtcaatctcttgctttctcataagggtggacccttgggtactactacctatcgccatcagaggactagacatcctcgccttcagagggctgcacaccctcgcctttgtagggctacacgccctcacctttagagggctacatgtcctcgcctttagaggactacacatcctcgccttcagaggactgcacgtcctcaccttcagaggactgcacgtcctcaccctcagagggctgcacgccctcgccttcagagggctgcacgccctcgccatcagaggactacccgtccacgccttaagaggactacacgtcctcacctttagagggctacgcgccttccccttcgtagggctacatgccctcacctttagaggactacacgtcctcgtctttagagggctgcatgccctcaccatcagaggactacacgtcctcgcctctagaggactacatgtcctcgcctttagaggactacacgtcctcgccttcagagggccacacgccctcgccttcagagggctacacgctctctcctttagaggactacacgccctcgccttaagaggactacacgtcctcgccttcagaggccttcacgccgtcgccctcaccttcagagggctgcatgcgcttgccttcatagggctacacgccctcacctttagaggactacat

SEQ ID NO: 53018 - DNA, 454 bp, Glycine max
  Peptide Sequence Number=SeqID_144703
ggggaaacgcctggttatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaactagctatgaccatgattacgaattcgagctcggtacccctcactgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 53019 - DNA, 1014 bp, Glycine max
  Peptide Sequence Number=SeqID_144704
atggccccgaggaagcttgcctcaaagaggtccaggaaggacaaggcggccgaaggaactagttccgctcctgagtatgacagtcaccgctttaggagcgctgtacaccagcagcgcttcgaggccatcaagggatggtcgtttctccgggagcgacgcgtccagctaagggacgacgagtatactgatttccaggaggaaatagggcgccggcggtggacatcactggttactcccatggtcaagttcgatccagaaatagtccttgagttttatgctaatgcctggccaacagaggagggccaggaatgtgagtatggccagaggaggaaccggtctgatgggttcgatgaggaggccatcgcccagctgctatgtataccggggcaggattttgcccggactgctgcagggaggcgagtgcaaatcatgcgcaccaacatgaccaccctgacccagatatggatgacgttgctcctcagcaacatcctgcccaccgatcataattccgaccttcccatgccgaagtgtcagctggtgtacgccatcctgacacggatgagcatccatgtggctcagttgatcgttgatgccatctatatttttgcaggtatggcgcccactaggcaccctttggacccagataagtccaacagggccctgggatttcccgcactgatcacaggactctgccagtcgttcggagtccccgttgcacctaccaaggtgattcggccgcccatcacccgagcttttattgagaagtactgtacccagagacaggctcagggtgatgctccacaggccgcaggcgcgccaccaccacctcatcaggctggccaggctggggcatttgacatggagcagtatttacggcatttggttcgccagcaggcggccaaccaccgagcacatgtacagacccatgattgtctgtaccagatgagccttagcatgcagagccagggcttcgcttctttttcatgccctactccagaccagttcaggccagag

SEQ ID NO: 53020 - DNA, 326 bp, Glycine max
  Peptide Sequence Number=SeqID_144705
ctggcaagcgcccgctaagcctaaccattgccgcaaggatttgcactaagcttcttaaggttcacgcttgtagaagcaaagactttgcctttgatgttttgatgatgccatatgataatgatgttttgatgccttatgaaaattcacttctcaagtttaattcaagacaaaaatccaagaatacaagatacaacatcaagaagatctctagtgttttaggaggggaattccaaattgaaacaacaaaaggtttggccaagaaatttaagcaaaaatgtctttttcaagagatttactctctggtaatcgattaccagaggatgtaa

SEQ ID NO: 53021 - DNA, 433 bp, Glycine max
  Peptide Sequence Number=SeqID_144706
atggaagaggcaaagaaggagatcttggaaacatttagaaaagtagaggtaaacataactttgctggatgcaataaagcaaattccaagatatgctaaattcttgaaggagttgtctataagcaaaagcttaaaggaagtgaaagatagattagtatgggcagaaatgtttcccattgagtttggaagtacacatacctctgactttctttatgagttacaggttgagaaaccatctctttctaccattatccagccgcccacaccagaattggagcctctgccatcaactttaaaatatgcttacttagacgagagcaaaagttttccagtaattatatctgcctcccttgctgatgagcaaaaggagaagttgttatcagttctcaagaagcataagaaggctataggctgggccctggcggacattcatg

SEQ ID NO: 53022 - DNA, 456 bp, Glycine max
  Peptide Sequence Number=SeqID_144707
atggtcagatggagaacagacagcttcaaggtagatggagaacaaagagagcaagaaagcttagatggagaagaagacagcgagaaggagaagacagcgcgaaggagacgaaacatacctaggtatggtggcgaaggagaagaagcagagacttgtgatgatgctcgagtgcgacgaacacgatgctcgaccttagacaaaacgatgctcagatggagaacagacagcttcgaggtagatgaagaacaaagagagcaagaaagcttagatgaagaagaagacagcgagaaggagaagatagcgcgaaggagacgaaacatacctaggtatggtggcgaaggagaagaagcagagacttgtgacgatgctcgagtgcgacgaacacgatgctcagatgcagacagggaccttcaaggtaaacggagattaaaagaagaagagagcgcgaaagcttag

SEQ ID NO: 53023 - DNA, 281 bp, Glycine max
  Peptide Sequence Number=SeqID_144708
atgactgttgaagacaatattaagacaactctccctaagaccgataatgctaaagagtttatgaggttaatgggagaatgctctcaaacagctgataagtctcttgttaggacattaatgagtacactaaccaccatgaagtttaatggtttgcgtactatgcatgaacatgtcatcgagatgacaaacattgcaacaaggcttaagaccttgggaatgacagtgaatgagaacttccttgttcagtttactttgaactcattaccatctgagtctggctt

SEQ ID NO: 53024 - DNA, 969 bp, Glycine max
  Peptide Sequence Number=SeqID_144709
atggatttcttttccaatgagagttttgaatgcattcaggcatttcagaactcaaacctcattcctttcatgtctttaaaattgcctgtttattctgaattagttaaagctttctattctaacctcgaaattcaagaaagcactttgatttctgaggtctatgggataaaaatggtcattgaccaatccctattctatgacttgacccaattatctaatgagggtgtaccatttgaaggtgcactaaatgatgattggaaatttgattactctgtacatgatgcccgccggttggtttgcaccaaccaagcggatatgaccggaaggctgcttgccggttcattggcttttgaaagccgcatccttcattatctcattgtgcgtattttgcttccaagatcttcaaaccttgctcagagatccttcttgatcagtgctgctgtgattgcatcttttggttaccgcaaagagcatgatgactcttgggtaaaaaaatgtgctcaacccattgatgatgaagcaaacttaccagttggagaagattcctctcttcttcaaaagattttggacaggttcgatggtcttcaaacctatgttggtgaaaggtttgtcatcatcaaaaagagggagattttagaagcaagcttcatgatgatgaatcaagttgattcaagtagttttgatgatgacaaagatgatgacaaaaagcccaaagaaatgatttcaagattgagtcaacaaggtacatcctttgtggtacaagtagagggtacatctacttgggttgttgtaactgagaacaagagagggtacatctcttgtggatcagttcaagtggagggtacatccacttggttgttcaaagagaacaagggagggtacatcccttgtggatctttgcttgtaatggcttttacaaggttgaaaagaaatctcaaggaccgcaagtcgcttggggactggatgtag

SEQ ID NO: 53025 - DNA, 663 bp, Glycine max
  Peptide Sequence Number=SeqID_144710
atggctctgagaaagctttcggcaaagagatctaggaatgatgccgcggctgaagggactagtgccgctcccgagttcgacagccatcgtttcaggagcactgagcaccagcagcgtttcgaggccatcaaggggtggtcatttcaccgagagagacgcgtccagctcagggacaatgagtacacagatttccaggaagagatagctcaccggcgttggacgtcgctggtcactcccatggccaagtttgacccagatgtagtcctggagttttacgccaatgcttggcccacggaggagggcgtgcgggacatgcgatcatgggtaaggggccagtggattccttttgatgaagacacccttagccagttcctgggtgacccgctagtgttagaggagggccaggagtgtgagtatagtcaaagaaggaaccgagccgatggatttgacgaggaggtcattgcccagctgttatgcataccgggtcaggattttgcccggaccgctgccgggagacgggtgcggatcatgtgcaccagcatgactaccttgacccagacgtggatgacgttgctgctcagcaacatcctgcccagcgatcataactccgacctccctctaccgaagtgtcagctggtatgtcgcctaccaggcaccctctag

SEQ ID NO: 53026 - DNA, 195 bp, Glycine max
  Peptide Sequence Number=SeqID_144711
atgtggaccactacgggggaggtggttgccgcccagctcgcccaggcgagctcagctcgcccaggcgagccaggttgcttcctccagaagcaacagccttctggaggaatatttctggagggcccaagtgggcctgggtgctatttgcaccccccttttttactaagtacacccccctctgctgttttttggtga

SEQ ID NO: 53027 - DNA, 171 bp, Glycine max
  Peptide Sequence Number=SeqID_144712
atgcggcatcagagcagatgtactgagagtgcaccatatgcggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 53028 - DNA, 399 bp, Glycine max
  Peptide Sequence Number=SeqID_144713
atggccccgaggaagcttgcctcaaagagatctaggaaggataaagcggctgaaggaaccagttccgctcccgaatatgacagccaccgttttaggagcgctgagcaccagcagcgcttcgaggccatcaagggatggtcatttctccgggagcgacgcgtccagctcagggacgacgagtataccgacttccaagaggagatagttcgccggcggtgggcatcactggttacctccatggccaaaggagggcgtacgagatatgcgatcctaggtgaggggtcagtggatcccgttcgatgcggatgctctcagccagttcctgggataccctttagtgctggaggagggccaggaatgcgagtatggccagaggagtgtgaatgtatgtatacatga

SEQ ID NO: 53029 - DNA, 474 bp, Glycine max
  Peptide Sequence Number=SeqID_144714
atgacaattgaagagtctatacatgtttcctttgatgagtctaatgccattcttccaaggaaggattttttagatgatatttcagattccttagaagatacacatattcatggaaatcattctaaagaaaaagacgaaggaagatatgaggattctcaagataatggtgctagaggaaataatgaacttccaagagaatggaaagcctcaagagatcatcccctcgacaacattattggtgatatatcaaaaggggtgtttcaaaattctggccttgttgatttcatgtcattaaaactgccacattatcctgaacttgtaaaggtcttctactgcaatttgaaaatacaggatggcattatttcctctgaggtgcatggtattcctatgatcattgatcagtccttattcttttctttaactcatttacccagtcaaggtgcaccttttgagggcaccattgttgatgactag

SEQ ID NO: 53030 - DNA, 396 bp, Glycine max
  Peptide Sequence Number=SeqID_144715
atggtagccataacccctgctaggtttcctcaacctccatttttccgaggatacgactcgaacgcaacgtgtgcttgtcatggagaagccccggggcattccattgagtactgtatgacctcaaagcgtaaggattttcaagtttattcctcagttacagcgctaaataaatggataaatttgacatctttgtccctcatcctctctgtcgcaacctaccctacggcgggagggcgatgcgagactcgcgggatgcgtgttccacgaaaggaatacgtgcggagtcgccaccaacgtttatttgaggaaaacgtcggcaaaactggaaaagatgcgatctacgaacttttaagtgaaaggctcgggagttgtatttacgcgcggggaaggtattag

SEQ ID NO: 53031 - DNA, 435 bp, Glycine max
  Peptide Sequence Number=SeqID_144716
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgcgagctcctggcagtcaacagataaaaggaacaaagaccacaaagcaaggaggcttgtgtggtggctggccagctgtgaactttgatttatatgtgagatatggcctctggcttcaaaaagggaactgggagattgtggaggcctctggtaatcgattaccagtctgtgtaattgattacacagaggaatgggtcactggtaatcgattaccag

SEQ ID NO: 53032 - DNA, 252 bp, Glycine max
  Peptide Sequence Number=SeqID_144717
atgactaggggcaatccagttagggatagtgtgcatcctggtcattctgtgcattttgagcattctgttgaggttgattctgaatattctgattttgagcattctactactaatttttatattgagaacatggctcaacctccacctcgtgagtggaatcttagggaaatggctaccctaatttcacttatgaaagcttgtgcattcaatatccttatgagggtgttccatatgttctcaagactggactaa

SEQ ID NO: 53033 - DNA, 345 bp, Glycine max
  Peptide Sequence Number=SeqID_144718
atgtgtcctccaccatcgaggctggagccccgcgaattgatttcgcctagcgcatgttcgcctatcctccaccctcaatcttattcggagacccatgaattgattgccctagcgctgattcatgtgtcctccaccatcgaggcaggagccccgcgaattgatttgcctagcgcctgttcgcctatcctcaacaccctcaactcttattcagagacccatgcaattgattgcctagcgctggttcatgtgtgctcccccagcatcagggctggagccccacgaattgattgccgtagcgctgttcgcctatcctccaccctcaattcttattcggagaccctgtga

SEQ ID NO: 53034 - DNA, 168 bp, Glycine max
  Peptide Sequence Number=SeqID_144719
atggaggttaaagatttgatttgggcaagattggatgaggggaagtgtgattttcgaaatctgcactttgtgcagaattttgctgtgaaatttgtgcagcaggatttttgcacaagtgcagaaaaatgctatgtatttgctggttgtggaaagagtaatgtagaatga

SEQ ID NO: 53035 - DNA, 354 bp, Glycine max
  Peptide Sequence Number=SeqID_144720
atggtagccataaccccttctaggtttcctcaacctccatttttccgaggatacgactcaaacgcaatgtgtgcttatcatggaggagcccctggacattccattgagcattgtatgaccctgaagcgtaaggatttccaagtttatgccattattgtaaaccacagttacaatgctaaaatggatgaatttgacatccttgtctctctcatcctttcacaaacacatctttgcttattcaacttccaccggaatgtgagtgttgtgaaaacaaagatggatacctcagagccctacactggggcaatgaggggcatcatgcataaacctcaagtgaacttagaggcagattag

SEQ ID NO: 53036 - DNA, 468 bp, Glycine max
  Peptide Sequence Number=SeqID_144721
atgaccacttttacatggatatggataacgttgctatttagggcctctgtcgtcctacgggtgcccgttcccccagcggtggtctgccatcgtgacataggaatcacacccacaaagacacccagtgggcccgaagaagtccaacagggccctgggggatcgtgcctgcaagacacccagtggacccaaagaagttcagcagggtcttggagttgtcaagctctaattacgggtctctgtcagttctacggagtacctgtcacctccagcaagggcatcaggccccctactaatcgagctttcatcaagaggtactgcgtctccaggcaggcgcagggcgaaacaccacagcagcctggggatggccagcagagggcaacagacacaccgccatcacctctagatttcacctcagctcatcccacaaaaaggttagagtgttgcttacgacccatggccgaccaatag

SEQ ID NO: 53037 - DNA, 324 bp, Glycine max
  Peptide Sequence Number=SeqID_144722
atgatcttgaaggacgagctaaaggcttaccttaggtcgaaaagaagtttgtcccaacagttaagcgagactgaagggaatatgtgggccgtcatcgatgagtgcaaagagaagctaaatctagcggcgactcacgagcaaaggctagaggatgagtacgccaagatatcagcagaaagcgaagcaagggagagggagtcaagaacttccccgattgctagccaaggccaaagcaatggcggacacctactccgcccccaagaagatccacggacttctcagctattgtcaacatatgatagacttaatggaccatatgattag

SEQ ID NO: 53038 - DNA, 222 bp, Glycine max
  Peptide Sequence Number=SeqID_144723
gcctcccaaaaggtaacggaggcgtgcaaaggtttcctcgggccagacggagattggccctcaagtgcaaaggcagaagggagcttgactgcaagacacacccgtcgagcagggatcgtcgtgaaatttgagtatcacgttcgcaacccaattccgaacattctcaccgttgggaatttcaaaatcatatctgagcttaaaagaaaacccttcgcattgtag

SEQ ID NO: 53039 - DNA, 273 bp, Glycine max
  Peptide Sequence Number=SeqID_144724
atgagcttgctgggggatgggtgcccagtagggcagatagagatccgtaaccagagctggaaacccagggccctgttggacttcttcagagtggtcatgttagtgcgcatgatccgcacttgtctctttgcagcggtacgtgtgaaatcttgtcccggtatgcatagtagcagtgtgatagcctccctctctggttgtgctcgcacagttggccctcctccaatatcagggggtggcccaggaaccgttaaaaggaaactactggccccttaa

SEQ ID NO: 53040 - DNA, 159 bp, Glycine max
  Peptide Sequence Number=SeqID_144725
aggtcaaaatcttgaagtgctaaaaggagcagttgtgctaagcggaccttgtaggctcagggcgcatgcactactaagtgcagcttcagtgtggcttagcgcacgattggcaccaagcccaaatccacttactcacgctaagcgtgagggtagcactaa

SEQ ID NO: 53041 - DNA, 684 bp, Glycine max
  Peptide Sequence Number=SeqID_144726
atgccgctgcaaaaagacgagtgcgggatcatgcgcaccaacatgaccactcttacatggatatggatgacgttgctatttagcaacattctgcccagcaaccacaatgccaatctccccctgcagatgtatcagtttggtctgtgccgtcatgacataggtaaggattgcgcccacaagacacccagtggacccgaagaagtccaacagggccctgggggtttccagcttttggttatgggcctctgtcagtcctacagggtgcccgtccccccagcgaggtcatgccatcgtgacatagggatcgcgcccaccagacacccagtggacccgaagaagtccaacagggccctggggtttccacctctggttacgggcctctgtcagtcctacagggtgcctgttcccccagcgaggtcatgccatcgtgacatagggatcgcgtccgcaagacatccagtggacccgaagaagtccaacagggtcttggagttgccaagctctaattacgagtctctcaaggtcatcaggccccctactaatcgagccttcatcaagaagtactgcgtccccaggcaggcgcagggcgaaacaccacagcagcctggggatggccgacagcgggcaacagacgcaccgccatcacctctagagttcacctcagctcatccacaaaaaggttag

SEQ ID NO: 53042 - DNA, 560 bp, Glycine max
  Peptide Sequence Number=SeqID_144727
gtcacagcttagacctcactcccataggagagaaaaggaaagaaagcctcaaaaggctaacattaacctcttatacttctatgggaaggacaatgtagaggcttacttagattgggaaataatggtagagcaacaacttaaaaggaagtctacttcaaaatcttatggctctcactcttatccaaagaaagaccaaggttcaaggcatcttaggggacaccttctaagcccaaagatgataagaggacacattacttctcaatgccccaccacaaaacccatgattatgaggggccaagacatttatagtagccaagatgaggctactacttcaccttcctctagtgaaagtgaaaaaacaaaaggggaagaatctagtgaagaaatctacccccaagaagaaggacaaccattagtggttaaagagaagtgtaaggaggcacttgctagcattgccacacctcttgggtttgagtttattcctcaagtaaagaagttgttggatgagggtttggttcacaagagcttaaatccttgtgctttgttggtgcccaaaatag

SEQ ID NO: 53043 - DNA, 243 bp, Glycine max
  Peptide Sequence Number=SeqID_144728
atgggggaaggttgtaaatcatcagtaaaacaggccacgaactgtggttgctgcttaagctaccataaggattcattccatcagaagcaagagcaagccttaggttccttggctcatccccaaactctggatacaaacgatcaattgtcttccactgtggcgaatcggcaggatgtcacagtaatcaatcagattttcggtcatccgaatgccatgaaaggttttttgcatcatgtgcattag

SEQ ID NO: 53044 - DNA, 153 bp, Glycine max
  Peptide Sequence Number=SeqID_144729
atgtgggatcggcacaggcttaaaagagcacttaaaccgagtgtatttacccctaaggcctacactccgaagagtccgttagggcctctccctcctgatttagacattgctcatgaattatacaatacccatgacctcacactcgtgttttaa

SEQ ID NO: 53045 - DNA, 495 bp, Glycine max
  Peptide Sequence Number=SeqID_144730
atgtttgccagtgatcacgccattctacgtgatagagtgcatcaacccactaagaggagtttactggatttatcatcacaagacgttgtgttggcacaaaataagttgctctctaggaaacttgagatcttgacaaaaaccctgagtaagtttccaactaacttgtctaatggtcaagctttacatccttctattttgcaggttacaggttgtaccatatgtggtggtactcatgaatccggtctttgcattccttttgaagagcaaacgcaagaggttagctacatggggaatcaacaaaggcagggatacaatcaaggtggattctcaggtttccaacatggtccttacaaccaacaaggacagtggagatcacaccctggtaatcaattcaacaaagaccagagtggaccttccaacaggctacctcaacaagggcctaacatttttcagaggacaaccaagctagaggagactctaactcaattcatgcag

SEQ ID NO: 53046 - DNA, 638 bp, Glycine max
  Peptide Sequence Number=SeqID_144731
gatcccaccaacaatgagcaaacctgaacaagtttgggatcaaacttggcattggatggctgatgacattgtctataattgtaaaaaatcatcaacaagtccagtattacagcttgatgatagaactcttcaaaatctggtcttgcttgaaattgaagaactgctgcaagcaaatcaaagatcgcttagagactatccttcaatgccatatccagaggatgcgaattgtccagcctatctagacaatagccttatattagctgaactcaattacaacaatcaagaacttagatcagagtttgaacatctattttctcacatgacagacgaacaagcatcaatttacaaccagattgttgaagttgttaataaagatgaaggagcctctagcggtatagcttctctgttattgcctggaggtagaactgcacattcaaaattcaaaatttcagttccagtttttgaagactcaacttgcaatatccatcaaggaactcaattagctgaactattaaatcagacaagtctgatcatttgggatgaagcacccatggctcacaaattctgttttgaggcacttgatcacagtcttagagatatcatcaaacacaactcaaaggacaataaaatctttggag

SEQ ID NO: 53047 - DNA, 217 bp, Glycine max
  Peptide Sequence Number=SeqID_144732
cataggcttcaggctgctcaattgctccaagttgctacatggaagggcaaaggccagctgggttaccaagttaaccaatgcatccagtttggcttcaaggttcttagtctcagatgatgcagctgagtttgtagctacctcatgcactcctctaatgactatggcatcatttctggcgctaaactgctggggagttggaagccatcttctcaattaa

SEQ ID NO: 53048 - DNA, 624 bp, Glycine max
  Peptide Sequence Number=SeqID_144733
atggcgagggcgtgtagccctctgaaggtgaggacgtgtggtcctctaaaggtgagggcgtgtagccctacaaaggtgaggacatgcagtcctttgaaggtgagggcgtgtagccctctcaaggtgagggcgtgtagccctacgaaggtgaggacatgcagtcctctgatggcgagggcgtgtagccctctgaaggtgaggacgtgtggtcctctaaaggtgagggcgtgtagccctacgaaggtgaggacatgcagtcctctgatggcgagggcgtgtagccctctgaaggtgaggatgtgtagtcctctgaaggtgagggaggtgagggcgtgcagccctctgatggtgaggacgtgtagtcctctcaaggcgaggacgtgtagccctacaaaggtgaaggtacatgaccctttgaaggcgaggatgtgtagtcctcaaaaggtgagggcgtgtagccctacgaaggtgaggacatgcagtcctctgatggcgagggcgtgtagccctctgaaggtgaggacgtgtggtcctctaaaggtgagggcgtgtagccctacgaaggtgaggacatgtagtcctctgaaggtgatggtaactagtatccaaggcgagggcgggtag

SEQ ID NO: 53049 - DNA, 333 bp, Glycine max
  Peptide Sequence Number=SeqID_144734
atgacaaacctgtggctaagccagtgttgtctcgctaagcccagatggcatccaggaaaaggaagagcattgcttctaagccacaggctcagtatgataccaggagattccaatccttggaatatagataacattatggaccggaggatccttccagaaaggaatgttaagatttatcatactgaattcgatgagtttaaggaagagttggagaggcgtaacctacacaaatgcctcaccaaccttcaggagggaagcatagatgtggcaatggttaaagaattctatgacaagctgtacaactcagaagaccaagttcccaagtgtgccaga

SEQ ID NO: 53050 - DNA, 162 bp, Glycine max
  Peptide Sequence Number=SeqID_144735
atgcattttggctattttggacaaaaaacacgtttccgcgaagaaaaatcgagtcgaagtgcttccgtgagcaaatttgtgaagattttcctccgttcctcaccgttcttcgttcattcttcgttcgttcttcgttcttcaaccgtttttaacgtactttaa

SEQ ID NO: 53051 - DNA, 918 bp, Glycine max
  Peptide Sequence Number=SeqID_144736
atggaacgactcaaaggcatgtccattttcgccaaagtggttgaattgggctcatttaccgccgccgcacgccagctgcagctcagcgtctcgtcaatcagccagattgttgccagactggaagatgagctgcaggtgaaactgcttaaccgcagcacccgcagtctgggcctgaccgaagccggtaagatttattatcagggctgccgccgcatgctggcagaggcctcgcaggtgcacgaacagctgtacgccttcaacaacacgccgatcgggattttacgcatcggctgctcaaccaccatggcgcaaaatgtcctctccgccatgaccagtgagatgctgcacgaatacccgggactgagcgtcaacctgatgaccggcataccggcgccggacctgattgctaacgggctggatgtggtgatacgcgtcggtgagctgcaggattccaacctgttctcgcgccggctgggcgccatgccgatggtggtatgcgcggcgaagagctacctggcccagcacggcacgccggaaaagccggctgaaatcgacaacttttcctggctggagtacagcgtgcgcccggataacaccttcgagctggtggcgccggaaggcctggtgacgcgcctgacgccgcaggggcgttttgtcaccaatgattctcagacgctgattcgctggctgaaagcgggctgcggtatcgcctatgtgccgctgatgtgggtgattgatgagattaacgccggtgagatcgatattttgttcccgcagtatcactcggagccgcgcccggtgtatgccgtctataccgagaaggataagctgccgctcaaggtgcaggtgtgtatcaattatctgaccgagtatttcaggcaggtggcaaggcagtatcagcagcaccgcaaaagttag

SEQ ID NO: 53052 - DNA, 1614 bp, Glycine max
  Peptide Sequence Number=SeqID_144737
atgaaagttgccgttctcggtgcagctggtggtattggccaggcactcgctctgctgctcaagacccaattacccgcaggttcagccctctcactgtatgacattgccccggtgacaccaggcgtcgcggttgatctcagtcacattcctaccgccgtgaaagttgaagggttcagtggcgaagatgcgacgccggctctgcacggcgccgatgtggtgctgatctcggccggtgtggcacgcaaacctggcatggaccgcgccgatctgtttaacgtcaacgccggtatcgtgcgtaacctgattgaacaggtggcgaccaccgcgccaaaagcgctgattggcgtcatcactaacccggtaaataccacggtggcgattgccgccgaagtgctgaaaaaagccggtgtgtacgataaaaaccggctgtttggcgtctcaacgctggatgtgattcgcgccaacacctttgtcgctgccctgaagggcaaacagccgacggagattgaagtgccggtggtcggcgggcattcaggcgtgaccattctgccgctgctgtcgcaggttaaaggcgtcagcttcagcgagcaggagatcgccgacctgacgaaacgtattcagaatgccggtaccgaagtggtggaagccaaagccggtggcggctcggcgacgctgtcgatgggccaggcggctgcgcgctttggtctgtcgctgattcgtgcactgcagggcgaagccaatgtcgtagagtgtgcctatgtggaaggcgacggcgagtacgcgcgcttcttctcgcagccgctgctgctgggcaaaaacggtatcgccgaacgccgtccgctcgggccgctcagtgatttcgaacagcaggcgctcaacggcatgctggagacgctgaaaaaagatatcgcgcagggcgaagagtttgtgagtaactcgcgcgtaaagaaaaaacgcccggcgcatgccgggcgttttgttttaaaggccaccggatttgaaagtccggctggcagccgaaccgttgctggccggcgttttgcgccccagcgtttccatccgtacctggaacggcgggaacggcatctcaatgccatgctcttcaaagccgcgcagaatcagctgatgcagctcatgacgcagcggcatacgatggcccatctccgccgcgtgcacgcgcagctcaaacagctgaatgccctgctgcagatccaccaggaacacatccggcgctggcatatccagcacgtaggtacagcgatcggccgcctgcttcaggatggtcgtcacctcttcgctgttaacgtgggccggtgccggaatggtcagcaccacgcgcgtcaccgaatccgacagcgaccagttgacgaactgctcggtgataaaggccttgttcggcacaataatctctttgcggtcccagtcggttatggtggtggcgcgcgtattgatgcgggtgatgctgccggtcaaatcgcgaatggtcacggtatcgccgatacgaatcggtttctcaaacaggatgatcaggccggagataaagttggcaaagatctcctgcatcccaaagcccagtcccagacccagcgccgctaccagccactgcagttttga

SEQ ID NO: 53053 - DNA, 1434 bp, Glycine max
  Peptide Sequence Number=SeqID_144738
atggcggaagccagcaagccgcacaccggcagctaccgcacctttaatgacttctttgtacgcccgttaaaagagggtgcgcgccctatcgatccggacgcttcgctgctggccttgccagcggatggcgccatcagccagctgggccgtattgctggcgatcagatcttccaggccaaaggccacacctactcgctgcaggcgctgctggccggcaatgacgatttggcggaaaaatttgtcgacggtgagttcgttaccacttacctcgcgccgcgcgactaccaccgcgtgcacatgccgtgtaacggcatcctgcgcgaaatgatctacgtgccgggcgatctctactcggttaacccgctgaccgcgcgcaacatcccgaacctgtttgcccgtaacgaacgcgtgatctgcgtattcgataccgatcatggcccgatggtgcagatcctcgtgggcgccaccatcgtcggcagcatcgaaaccgtctgggccggcaccgtgacgccgccgcgcgaaggggtgatcaaacgctggcgctacccatctgccgatcatgatggcgcggtcgtgctgctgaaaggtcaggagatgggccgctttaagctgggctcgacggtgatcaacctgttcgcgccgaaccgcgttaagctggctgaaagccttgaagccgaaagcaaaacccgcctggcccggcgacagcgctccgctcatcgactaattccgggaaacaccgccgtgcgcgcctctctttttctgctgctgagcctggttctcagcagcaccgtctttgccgccaccgttccacccgccagccagctgaaacaggatctggaaacggcgaaatccgcgaaaagctcgcccagccaggccgaacaggtgcaggcgctggaagcagcaattaacttcctgtccgaacgcgacaactcgctggaacgggccaaacagtatcagcaggtgatcgatgatttcccgcggctggcgcgcgaactgcgtcagcaaatcgccacgctgaccgacagcagcaagccagtgcgcagcaacatgagcaatgccgagctggatcaggagatcctgcagctgccgcagcagcagaccgatgcgcggcgcgccatgaccgaaagcgaacggcgcgcacagggcgtggcggctgccgctaccccgctggcacaggcgcagatttatgcgcgtcagaccgagagcgctgccagtaaagcgcgggtagatgagctggagctggcgcagctgtcggccaataaccgtcaggagctggcgcgcatgcgcgcggaagtgcatcagcgcaaagccacccagctggataactatctggcgctgcgtcagcccagcggcgcgaagccgaactggacgtggagcgcaccgaacagcgcctgctggcggacagcggccagctgggcaaagcgctggcgatga

SEQ ID NO: 53054 - DNA, 235 bp, Glycine max
  Peptide Sequence Number=SeqID_144739
ccgcaaagagcgtgatggctcttgggtgaagaaggacattcctgcacaagcagcaaaggaccgctctccatcaccacctcctcagagggatgactcttcatcccttatgaaaagcattctcgatagactagatggactacacacgtatgtcgacatggatactcatattgatcggcttgaagaggatgtgagtttcatccgtcagtgcttcgaccttccaccaccgccttcatag

SEQ ID NO: 53055 - DNA, 414 bp, Glycine max
  Peptide Sequence Number=SeqID_144740
gaaattaaagatgtctttcccaaggagattcctcatggaatgccaccttcaagaagcatagaatatcaagttgatctccttccagaagcttcattggccaacttacaacaacaagccccaaagactcaacataaggatgcacagaccaaagttgagtatgtgaaaagattgtatgaccaagtgaaggtgcaaattgcaaagaagaatgaaagctatgccaagcaagccaacatgaaaaggaaggaagtggtacttgaacccggtgatgatcctggacatttgagggcaaatgttttccaagaaggagggaatgatgagaatcttgaaactggccaaatacaagctaaaggctcaagtggagaaggacgaaggcccaagtggagaaggacaaagcccccgagtggagaaggatga

SEQ ID NO: 53056 - DNA, 765 bp, Glycine max
  Peptide Sequence Number=SeqID_144741
atgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcaggggtacctttcacgaatgaatgtaggacaaatatttgaatgctcgctcgggttagcaggagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 53057 - DNA, 159 bp, Glycine max
  Peptide Sequence Number=SeqID_144742
atgatgcaattctaccccgcaagggcattggatagaagactccaagaagatagggccaaagatgcaagagaaggccctagggttctcaagagccttagggtaaggaaccctagaaatgtaagatttttcagcccttgtattttagggcaccttgactag

SEQ ID NO: 53058 - DNA, 354 bp, Glycine max
  Peptide Sequence Number=SeqID_144743
atgcaaagaagatctactgcaggtgatttgatccccatcgatttggagattaacgcaaacagaattagaaaattattgcaggacttagaagcagcagcaactccaggagaagaactacgatcttcagaggcatcttctagctttcctattctaggacaatctcatacagatttaattgaagaagttattatggctgaagagccaagaagagtgaccctagaagattactcaggttccattgtgccacaattcttttccagtatagtgcggctagaggagaagctaagaggtggcttcactcgttcaaaggcaacagtcttaagacttgggatgaagtggttgagaaatttttga

SEQ ID NO: 53059 - DNA, 1295 bp, Glycine max
  Peptide Sequence Number=SeqID_144744
cttccaggcgatacgcatctggatcaacagtgagctggaagagatcgatatcgcgctgaaaggggcattaacggtgctggcaccgggcgggcgtttatccatcatcagcttccactcgctggaggatcggctggtgaagcgctttatgcgtgaccagagccgcggaccgcaggtgccggccgggattccgatgaccgagagccagctgaaagcgctgggcggacagaaccgcatcgtgattggcaatgagcgtcacagcctgcccggcgtcattggtggcgatctgctgcgttttggcaagatcccgctgctgctgctgatcgccgtgctggtttcttcggtgctggtggtgaccactacgcataagacccgtctgctgacggcgcagcgtgagcagctggtactggagcgtgatgcgctggatatcgaatgggcgcaacctgatcctcgaagagaatgcgctgggcgatcacagccgggaatcgcagacctcaatgagcggcgcaggcaaaacgctgaagtcatcagcccggataagctggtgaaggaaggcgatttacgttcgctgcgcgtgcaggaagtgcctaccgcacgcggcatgataagcgatcgcgccggacgcccgctggcggtaagcgtgccggttaacgccatctgggccgatcccaaagagctgaccgagcacggcggcgtcaccgttgatagccgctggaaagcgctgtcggatgcgctgtcgatcccgctcgatctgctggcggcgcgcgtcaacgccaatccaaaagggcgctttatttacctcgcccgtcaggttaacccggcgattggcgaatacgtgaaaaagctcaagctgcccggtatttacctgcgtcaggagtcgcgccgctactatccggccggtcaggtaactgcccacctgattggcttcaccaacattgacggccagggcattgaaggcatcgagaagagctttgataaatggctgaccggcgagccgggcgaacgtaccgtgcgcaaagaccgctacgggcgggtgattgaggacatctcctcggttgacagtcgcgccgcgcacaacctgacgctgagcatcgacgagcgcctgcaggcgctggtgtatcgcgaactgaacaatgctgttgcctttaacaaagccgaatcgggcactgcggtgctggtggacgtgaacaccggcgaagtgctggcgatggccaacagcccggcttacaaccccaataatctcagcatacgccgaaagacgtcatggcgtaacgcgctattaccgactcttcagccag

SEQ ID NO: 53060 - DNA, 319 bp, Glycine max
  Peptide Sequence Number=SeqID_144745
gtgctccagtggcgtatctggtttctatcagctgtccttcctgttcagtactgacggggtggtgccgctccaattcggcacacaagcataccgagccggaagcatagcgctggcaagtgtagccggggccaacgccgggcgatcgagtgcggctttgcgtattgccggcgctaaagggcggatgtgtcatactggcgattactatgttggcgtaacgccagggtctcgctaccgctcggtcgtcactgcggcgagcgtgaaagtggcttacaacggggcggaattcggattagatgccagaatacttaacagggaatga

SEQ ID NO: 53061 - DNA, 423 bp, Glycine max
  Peptide Sequence Number=SeqID_144746
acactttgcaagacctcagtcagactgggaggtatgcatggggagctgctgccctggtgcatatgtatgatcacttgaatgatgcttgtatcaacagcagccgacaacttgctggttacgccaccttgttacagcactttccgtcagttgcggagtgcatcgctgatccggactacgatgaggtgtctccacatgcatgtcggtggatttctatgaagaagactgtgaagaccatatctacaaagacctacaggcagcatctggatcgacttaggattcttgatgtctgctggatgccttatggggagcatcgactatttggatacatccagagtattcctgcacaacttgtcaattcatgggagtcatttgatgaaatagacgacaggtggatgcactactcagaccatcttgcgccagcag

SEQ ID NO: 53062 - DNA, 447 bp, Glycine max
  Peptide Sequence Number=SeqID_144747
atggtgaaagttggaacctcttacgtgccgatcaacgtctcattttcgccaaaagttggcccagggcttcccgcataccgaccggacatcagcgctggcaagtgtagcctggggtgcgacgctgagctaactcaccacccgccgcttaatgcgccgctcagggctgcgctttccattcggaacctgtcaggctgcgcaactgttaagacggccaacgcgcgggcgatcgaggcggctttcgcgtattacgccagggcgctaagggggagtgtcatactggcgttactatgttggcacgataacgccagggtgtccagtcgaatgcgttctgtggcagaaaaaaagcgcaccggtgcgtcagtcagaatatgtagatacaggactcatattccgggcattcctcgctcactgagctcgctacgctcggtcgtcactgcggcgacgtga

SEQ ID NO: 53063 - DNA, 696 bp, Glycine max
  Peptide Sequence Number=SeqID_144748
atggtgaaagttggaacctcttacgtgccgatcaacgtctcattttcgccaaaagttggcccagggctcccggtaaacagctacggacaggtccaagctgacttctttacttttaccctcgaagcttatcgataccgtcgaccaggttttggcgcaaaggcctcggtgagccagcttattgattctagtgtagtgatggtgtttttcgagctccagtggcttcatgtttctatcagctgttcctcctgttcagctactgacggggaattggtccgcgtccaattccacacaagcatacgagccggacatagcgggcaagtggcgaaacctgtcgtgccattcgcgcattcagacgtgccaactgtgcgcgaagggcgatcggtgcgggctttcgctattccgggcgctaaaggcggatgtgtcaactggcgattactatgttgggtaactggcagggtgtccagtgaatgcgttctgtggagagaaaaaggctgcaccggtccgcgaattccgtctgagctcctaccgctcggtcgtcatgcggccgctctagaactagtggttatccccacggggcggaatttccgtggaagaaaatgcctcccggaagataaaccagctacggcaagtgagagggccgcggcaaagccgtttttccataggctccgcccccctgacaagcatcacgaaatctga

SEQ ID NO: 53064 - DNA, 168 bp, Glycine max
  Peptide Sequence Number=SeqID_144749
atgccgacatctctggaaagggcgcagatgaccacattggcctttgctcatcaatcacacttgggcttttgggtcatggtaacaaaaagcggtgcggtcgacaaaagcgaggctcctgctcctacgtatcctccaatgaggaactcagacctacgtagttctggataa

SEQ ID NO: 53065 - DNA, 391 bp, Glycine max
  Peptide Sequence Number=SeqID_144750
atccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcggggcactgcccctctttttggacccaaggtcggcttcggccggtcgatccgggcggaagacattgtcagtggggagtttggctggggcggcacatctgttaaagataacgcagtgtcctag

SEQ ID NO: 53066 - DNA, 255 bp, Glycine max
  Peptide Sequence Number=SeqID_144751
atgcagaaaggtctttggaccagacaatatctgaacaatacagaattgtcaccaagtaaacagggaaagaaaggaaaccatgacctaaagtggtcccctctctttgattgccaaccaaaatcctgcctaggatcttcttcatcaatggattccttggcttcttggaagatgaatggcagtggaatggagaaggaagagagagaggagacgccacttcaaggagaagatgagtctagaagaagctcaccaccatag

SEQ ID NO: 53067 - DNA, 512 bp, Glycine max
  Peptide Sequence Number=SeqID_144752
ggaaaactgccaggaagctaggtggttcatctacaaggccacaacagcagatgccaagtctctatgaccgaaccacaaagctggaagagactctagctcaattcatgcaagtgtcaatgtcaaaccaaaagagcacggagtctacaattaagaatctggaagttcaggtgggcaagcttgcaaagcaattagctgaaagaccatccagtagctttacagaaaacacggagaaaaatcctaaggaagaatgtaaagttgtgatgactagaagcagaatggcaactcaagctgaggaaggaagatctaataagaaggtggagggatttaaacaacagttggctgatcatccggcactggaactagttgatgatttagttgaacttgaagaagttgttgaggaagcaaaaggtgatgaagaagaagagacaccaataagagactgtcaagagagaataaagaagaaggaagaaaaacaaaaagaaataaaagaagaagaagaaaaaaaaagttga

SEQ ID NO: 53068 - DNA, 213 bp, Glycine max
  Peptide Sequence Number=SeqID_144753
atggattggagttcctcggattatgattttggtctttcctaccatccaggagtaattagtcatgccatgatgactaagcccgtgcagttcttggggcacgtgtctaaggatggggttgcggtggataacaaggtggagtcggttatggagtggacaacaaccgacaaatccaacggaggttcgaagtttcttggggttagctggctattatag

SEQ ID NO: 53069 - DNA, 240 bp, Glycine max
  Peptide Sequence Number=SeqID_144754
atgggttctggcaatgcaatgtggttggactctcatgtcgatctgaatgaatcatccttccacggaggggcgtggaaacacataagaactcttgaattgaaatggaaaaatagatgtaactccagttacttcggaaatgttctatttctcgatggaggcaagggatataactcagcggtagagtgtcaccttgacgtggtggaagttatcagttcgagcctgattatccctaaacccaat

SEQ ID NO: 53070 - DNA, 240 bp, Glycine max
  Peptide Sequence Number=SeqID_144755
atggtgcctcctcttacctcttctcctttgtcttccactgcatctccatggtggaaaatcaccattgaaggacctcatttaagctcaaagatccagcctccattgaagctccacaagcaagcttccatcaagtggtatcagagcacaagagcttcaaattttccaccgattaaacttgctatagaagctagatttgattttctatggttcaaatttcttgttcttgttcttgaaccatga

SEQ ID NO: 53071 - DNA, 267 bp, Glycine max
  Peptide Sequence Number=SeqID_144756
atgcccttaagcgggcgagcgaggcgggtgcgttttccaaaggaggaaaatgcgcggagtcgccaccaacgtttatttgtggaaaacgtcggaaaaaccgaaggaaaccggtcgacaaaagcggggctcttgctcctacgtacccttcatcgaagaggaaatcagacctacgtagttctttttaagcgtgaatcaagcgattctttttacctggaaggtgatcattttaaggtgttggaccttaaaaatgatccatttacttggtaa

SEQ ID NO: 53072 - DNA, 50 bp, Glycine max
  Peptide Sequence Number=SeqID_144757
gctattttggctagttagatacctcagccggccattagctaatggccatg

SEQ ID NO: 53073 - DNA, 273 bp, Glycine max
  Peptide Sequence Number=SeqID_144758
atggtgaaagttggaacctcttacgtcccgatcaacgtctcattttcgccaaaagttgactcagggcttcccggtatcaacagggacaccaggatttatttattctgcgaagtgatcttccgtcacaggtatttttcggcgcaaattgcgtcggctgtccttcctgttcagctattgacggggtggtgcgtaacggcaaaagcaccgccggacatcagcgcttgcaagtgtagcggtcacgctgcgcgtaaccaccacacccgccgcgcttaa

SEQ ID NO: 53074 - DNA, 300 bp, Glycine max
  Peptide Sequence Number=SeqID_144759
atggtgaaagttggaacctcttacgtgccgatcaacgtctcattttcgccaaaagttggcccagggcttcccgcatacacgccggaagcatcagcggcaagtgtagcggggtgccaggctgcagctaactcaccacccgccgcgcttaatgcgccgctacagggcgcgctttcccagttcggaccatgtcaggctgcgcaactgttgatcggcaagcgcgggcgatcggtgcgggctcttcgcgtattccagggcgcaaagggcggatgtgtcaactggcgattactatgttggcactga

SEQ ID NO: 53075 - DNA, 127 bp, Glycine max
  Peptide Sequence Number=SeqID_144760
atggcgatgttccaggcgctggagccgttgtttccgctgataagtgatgttggcaacttgttacgtgactgtattcagcgtggcggtaaagtgttgctgtgcggcaatggcggcagcgcggcagaca

SEQ ID NO: 53076 - DNA, 1085 bp, Glycine max
  Peptide Sequence Number=SeqID_144761
atgggacctctccaaatgcaagccttccgcaagacttacggaaagatcttagagttgaccttagcagaggtatccatagaagccattgcatcactcacccaatactacgaccaacctttgagatgcttcacattcggagacttccaattggtaccaaccattgaagaatttgaggaaattctagggtgtcctctcgggggaagaagaccatacctctcctccgggtgtctcccttctttgagcagaattgcaactgtggtcaaggattcagcaagaggtttggaccgcataaaacagactcggaatggcatagcgggcctaccacgaaggtacctagaagacatggcgaggggtatggccaatcaaggagattgggtcccgtttgtggatgtgttagctttgctaatttttggggtcgtcctctttccaaacgtggatggtttggtggacctagcagcaatcgacgctttccttgcataccaccatagcaaggaaagtccggtggtagctgtcttggcagatttatttgacacatttgaccgaaggagaatagattgggaccagcttttggctgggataggaggtagaacaatcaattggttcccccgatggaaggaaggaaaggaaggagtccttttctcatgtggaggatacccaaacattccgctggtaggaacgaggggttgtattaactacaatcccgcgctcgctataagacaactagggtaccccatgaggggagcaccgacggaagaaagcatgtctcctttcattgtgatggatttcggcgcacaaaatttcaaagctatacaaagaatccataaggcatgggaaaccccgttaaagaaagatcaagaacttaggggcattcgtaatggcatcattggtgggtaccatcaatggttaaaagttcatatacgaggtttagattggctcaccaagttaaaagtcgtcagcgaagaaagttttgaagcaccggaagaggacgaagaagtccaagctctcaaaagcgagttaggaaaggcgaaacttgccaaggagaagttcaagttggccgctacacacattcggaaggagtgtgccgg

SEQ ID NO: 53077 - DNA, 954 bp, Glycine max
  Peptide Sequence Number=SeqID_144762
atgggacgtaccttgggtaactccagcttcagcaaaatgctgagcgaaacggaaagtgcccgtacttttacccttaaatccggtgccaccgcgcggtttacgcttaccaagattctgcacgatgacatcgaaacgcagacttacgtggatgccacgattaacggccgcgatcaggcctttttaactgaagaatccgtcagcgatatttcccgcaccattaaactgcagcagttctttccggcgattggccgtgaggtagacgggcgtattgaagtcctggacggttcacgccgcagggccgcgtgcctctacagcggtatgccatttgaagtgttagtgacgaaagatgggctgtcgctttcagacgcccggcagctggccatcgacattcagacggcaaaagagcacacactgcgtgaactgggtaatcgccttaaactgatgtacccggaacatatgaatcagtctgacattgctgcagcggaagggctgtcgccggcaaaagtcacgcgtgctttccaggcggcgtcggtacccgatgaaatgattgcagtctttccgtccgtcggcgagctctctattaacgactataagaccttactggatattgcagagaaagctgcgagcaggcaaatcagtgtccaggaactggcagagggcgtgcgtgaacgtattgcgcttgatgcgctcactgagcacgatgatccggctgttaaggcaaagattattggttactttcgtgcagccagtgctgaacctaagtcaacgcgtgatgcgaaaaaagtcgtgaccgaaaaaatagcggaattcggcgataaaaagcagtttgcgcggaaaaaaacagacgcagaaaagcgccttgtgacgtatgagttttcgcgtcttcctgtggcctggcaggcagagctggatgatgctgtgaaagccgttattgaaaagatgctcgcaaaataa

SEQ ID NO: 53078 - DNA, 518 bp, Glycine max
  Peptide Sequence Number=SeqID_144763
atggataatgaagagggcgtgcaggaacagatgaaggctgatctatcggccttaaaagatcaaatggcttccatcttggaggtcatgttaaaactccagaaaactatagaggataaagccacgacaaccgcctccagtacagttagggaagcagagccggtgctgcagcccgccttaaatctgggtcgagacagaaacacgacagtgtttggccgaaggtatagcccgcaagcttacccctatggcttgcctccggacttcgctccctgtgccgccccggaagatttaagccaagcccctaccttcgaggggcaactcccaccttatgacgactatcccgagcaagacgataaggaaggagatacccatctcggccccctgctccacctcaaagatccatccccccatgaactaccccaaccaaacatagtccgtcatgtcccggcttcacccacacccgtaaaagaatctgttcccttcgcggaagataagggaaagattgaggcgcttgaagaaag

SEQ ID NO: 53079 - DNA, 219 bp, Glycine max
  Peptide Sequence Number=SeqID_144764
atgtttagcgaaggaaccgattggaaaaataacaaaaaaccatattttccagtcaccggaggctccgcgcttgataacggaggacacatgaacagcgctaggcaatcaattcatggggctctgaataggatggtggaggatacacgaacagcgctaggcaatcatattcgtggggctccggataagattcgttggttggggatgcacgaacagcgctag

SEQ ID NO: 53080 - DNA, 425 bp, Glycine max
  Peptide Sequence Number=SeqID_144765
gcttttcgtcttacagacagcaaaaagtttatacggataaccactcgggtatttccgcccgtcagcgtgactcaaaagtcagtatgacagatcttgtgagcgcggaagatgacggcgcagaagacgacattagtctctgcgtgctatcaggcttttcatcttacagacagcaaaaagtttatacggataaccactcgggtatttccgcccgtcagcgtgactcaaaagtcagtatgacagatgttgtgagcgcggaagatgacgcttttcgtcttacagacaacaaaaagtttatacggataaccaccgggcttttcgtcttacagacagcaaaaagtgtttatacggataaccactcgggtatttccgcccgtcagcgtgactcaaaagtcagtatgacagatcttgtgagcgcggaagatgac

SEQ ID NO: 53081 - DNA, 267 bp, Glycine max
  Peptide Sequence Number=SeqID_144766
atgcctacgttcgaaaacaggccccgacgggtgcagagaaacacgaggaactggaaccagagaggcggcacgcaaaccgaggcgaaagggcgacctacccttcggcgaaagggcgacgcggggcttacgggtgcgtcttccatgggaggaaaatgcgtggagtcgccaccaacgtttattcgaggaaaacgtcagaaaaactggaaaagggtgtttccctcgctcctacgtatcctcaattgcgatgaggaaatcagacctacgtag

SEQ ID NO: 53082 - DNA, 273 bp, Glycine max
  Peptide Sequence Number=SeqID_144767
atgaccatccagaatatgcaatttcagcaagagacaagagcctctattcagagtctgacaaatcagatggggcaaatggctactcagttgaaccaagcttgtcgcaacatgccctttttgcggacgagcgaggcgaggctcacaggtgcgctttccaaaggaggaaagatgcacggagtcgccaccaacatttatttgtggaaaacgtcgggaaaaccgaaggaaaccggtcaaaatgaaaattctaagttcgggagttgtatttacgtttga

SEQ ID NO: 53083 - DNA, 453 bp, Glycine max
  Peptide Sequence Number=SeqID_144768
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgattgttttgcaggggcatatcaccaactgcttgcccttcagtggcctgtccgaggcaaggcttgaggtcggctag

SEQ ID NO: 53084 - DNA, 126 bp, Glycine max
  Peptide Sequence Number=SeqID_144769
atgtcattgcctagcgctgttcatgcatcctccatctacgagtctggagatcgaattcctgcatcccaggggatccactacttctcgagcggccgccaccgcggtggagctccaattcgccctata

SEQ ID NO: 53085 - DNA, 327 bp, Glycine max
  Peptide Sequence Number=SeqID_144770
tttgtgatgatttggatgttgaattacctggatgttggggaagcttgggaggattgatgggggacccggtgttgagagaaacgaggatatgggctacgtgggagtacgtgagctcagttggaggtgggcaacaggggatggtggtggtacctggagatatgtcgtgggggtcaggagaccttggggacgtcaggcgagctcctgacagtcaacagataaaaggaacaaagaccacaaagcaagggaggcttgcgtggcttgaaaacgaggcctctggtaatcgattaccagtctgtgtaatcgattacacagaggaatgggtcactg

SEQ ID NO: 53086 - DNA, 330 bp, Glycine max
  Peptide Sequence Number=SeqID_144771
atggtgaaagttggaacctcctacgtgccgatcaacgtctcaattcgccaaaagttagcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttactgcgccgctacagggcgcgtcccattcgccattcaggctgcgcaactgttgggaagggcgatcggtgcgggcctcttcgctattacgccagctggcgaaagggggatgtga

SEQ ID NO: 53087 - DNA, 255 bp, Glycine max
  Peptide Sequence Number=SeqID_144772
agcaccgagccagccatcaagaatctagaagtccaggtgggacaattggcaaaacaactggcagaccgaccgtcaagcagctttggagccaacacagagaagaatcctaaggaggagtgcaaggctgttatgactagaagcaaaatggtgagcatgaatgaaggagaggagaggataggtgcagaaaaacaacagctggtgactgagccaacaattgacccagtggtggaacctttgagtgagactaaggaataa

SEQ ID NO: 53088 - DNA, 657 bp, Glycine max
  Peptide Sequence Number=SeqID_144773
cttcttattaggccggccttggattcattcagttggggtggtcccttcaacgctacaccaaaagttgaagtttgtggtagaggggcagttaattatagtcttgggagaagaagacattcttgtgagttttccttcttctacaccttatgtggaggccgcagaggagtccttagaaatgtcctttcaagccttagaagtggtgagcaatgcttatgtggattcttccccggtacaaccacgctcatctggggccacattgatggtagcttgagtaatgttgggaaatggatacgagcccgaaatgggtatgggccggaacagcaatggtgtagcaagtttggtggagttcacacggaaccgcagaaggaaggctgccctataaaggaagggaagaagcatggcccagccgcaaggactacaagtgaaagaggttcccttgtgtcacatcgacgaaagctttgtcagcgcgggttggatgtgcgaggggtgggtcaccatgatacacgaagaaaccccttaagagcaaccgaattgggtgcggccgtgccctccggagttcgagttagggaattggcgaatagtcaaacaagccagaatttctgtggcaaacgcaatgaattcgttagtcctaaccctattgttgggcctaggctttag

SEQ ID NO: 53089 - DNA, 666 bp, Glycine max
  Peptide Sequence Number=SeqID_144774
atgcgttcatgggtaaggggtcagtggattccttttgacgcaaacgcactcagccagttcctgggtgacccgctagtattggaggagggccaggagtgcgagttcagtcagaagaggaacagggccgacgggttcgacgaggaggccattgcccagctgttatgcacaccggggcaggatttcgcccggactgctgcagggaggcgggtgcggatcatgcgcaccagcatgaccaccctgacccagacgtggatgacattgctgctcagcaatgtcttgcctagcgatcataactccgatctccctctgccgaagtgtcagttggtgtatgccatcctgacacagatgagcgtccacgtggcccaggtgattgctaacgtcatctatttgtttgcaggtatgccacccaccaggcaccctctagacccggataagtctaacagggccctggggtttctagcattgatcacgggcctctgccagtcattcggggttctcgtcacccctagtaaagcggccaaccaccggggacaggtgcagatacatgagtgtctctaccggctcagcctcagtcagcaggggcagggtttcgctccttttgcgtgccctactccagagcagtttggggatgaggtcgcatggcccggagactggcccgaggcctag

SEQ ID NO: 53090 - DNA, 264 bp, Glycine max
  Peptide Sequence Number=SeqID_144775
atggctaccattgcattatcaagtagacatgggagcaagttagcatatgacaccggaatttggggtgaatcctacaggcttttcgctgcaaaattcatttcttggttggtgggttttgttgtcgatttagggatggcctttgtggataaatgggcagtaggtaaggagaagggttgggaatggcagtcattgcatgggtttctccctcatcctcaccctcttcatttgccccagttttctcattcgtccaagcaggatgattaa

SEQ ID NO: 53091 - DNA, 622 bp, Glycine max
  Peptide Sequence Number=SeqID_144776
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgccggattttcagccgagaactaacccaactcagttcaatataataattattaagaatcaacaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 53092 - DNA, 330 bp, Glycine max
  Peptide Sequence Number=SeqID_144777
atggcagcggaatggagaaggaagagagagaggagacgccacttcaaggagaagatgagtctagaagaagctcaccaccataggaggccatggataagagcttggaggaagaaggagatgaatgaagggagagggagagaagagctagttcttaatgagggtgattgggtttggctccatcttaggaaggatagattccctactaaaagaaatccaagcttagccctagaggggatggaccttttcaggttttggagaggatcaataacaatgcctataggttggacctcccagaagagtatggagtcagcaccacttttaaggggatga

SEQ ID NO: 53093 - DNA, 570 bp, Glycine max
  Peptide Sequence Number=SeqID_144778
atggctggacctggtaagtttcccccggggttgagtcaaattaagccgcaggctcccactccctgggggtgccccttccgtcaatttccttttaagttgttcgtctttcataaatccaagaatttcacctctgactatgaaatacgaatgcccccgactgtccctgttaatcattactccgatcccgaaggccaacacaataggatcagaatcctgtggtgttatcccatgctaatgtatacagagcgtaggcttgctttgagcactctaatttcttcaaagagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcaggctccctctccggaatcgaaccctaa

SEQ ID NO: 53094 - DNA, 177 bp, Glycine max
  Peptide Sequence Number=SeqID_144779
atggcaagagctggtgacaatggtggtgtatatcatcaactggacggatctcattgcttatttctggacgcgataactacacaaatgcaacgtttgttgaaccgtaacaaagaagagctctacagacgaatagccaaatcttccttgtttactcttaaacctctatcccctagagaa

SEQ ID NO: 53095 - DNA, 652 bp, Glycine max
  Peptide Sequence Number=SeqID_144780
acacgtcctcaccttcagaggactacacatcctcgcctttagaggacttgacgtcctcaccttcagagggcttcacgccctcgcctacaaaggactgcgcgtcctcaccttcaatggactatacgtccacgccatcagagggctgcacgccctcgcctttagaggactgcgcgtcctcaccttcagaggactatacgtcctcaccatcagagggctgcacgccctaaccttcatagtgctacacgccctcacctttagaggactacacgtcctcaccttcagagggttgcacatcctcaccttcagagggctgcacgcccttgccatcagaggactacacgtcctcaccatcaaagggctacacgtcctcaccttcagaggactacatgtcctcaccttcatagggctacatgccctcacctttagaggactagacgtcctcgccttcagaggactacacgttctcaccattagagggctacacgccctcgtctttagaggactacacgtcctcaccttcagaggactacacgtccttacctttagaggactacacgtcctcgccatcagagggctacacgtcctcgccatcagaggactacacgtcctcaccatcagagggttacacgcccttgacttcgtagggctacac

SEQ ID NO: 53096 - DNA, 444 bp, Glycine max
  Peptide Sequence Number=SeqID_144781
atgagtgatggattttgcggtactcatttgcagatcatgattaggaccagaggattaggccgtgccttaggtcacgttactggcagaggtgtgggccgaggagatcgtgatgatttcgatgatgctccgcagcgtcaacggcctaccgcatccgcaagaaggcagcgagtcgctgtgactgtggcgcatgatgagccagtggtccctgcgccatatgttcaggctgacgtatttctggatgatccgatgacaccagctgatgtagaggatattgtggcagacattcttgcggacacaggcgcagaggctgctgaggatgagcatgagggatttccgggtggcccgagcgacccatccgtgttgacccagtatgcggatcatgttgcttgcagcgagcgtcctgagttgaagttatcctctcacgggaggaaggtccatagttaa

SEQ ID NO: 53097 - DNA, 210 bp, Glycine max
  Peptide Sequence Number=SeqID_144782
atgaggagtcaagacatctatagtagccaagaggaggctacttcttctccctcctcaaatggaagtaagggtgaagccaagggtgatgagcatattaatgaggtttacacctatgaagaaggtaatcttctaatgcacaaggttgatatccaagttgagtctcactatcattttccacccaaagccttacaagcttcaatggctcaatga

SEQ ID NO: 53098 - DNA, 1414 bp, Glycine max
  Peptide Sequence Number=SeqID_144783
gacgtcgtcgcgttcgcccgcaagcatgacatcgtcatcctgtcggatcttgcctattcggaaatctatttcgacgacaatccgccgccatcggtgctggaagtgccgggcgccatggatgtgactgtagagttcacctccatgtcgaagacattctccatgccaggctggcgcatgggctttgcggtcggtaatgaacgcctgatcgcagcgctcacccgcgtgaagtcctatctcgattatggtgctttcacgcctattcaggttgcggcgacagcggcgctgaatggagacggatcggacatcgcctatgtgcgcaatgtctacaagcagcgccgggatgtgctggtcgagagctttggccgtgcgggctgggatgttccgccgcctgctgcgaccatgttcgcctgggttccgattccggaacgcttccgttcgctgggttcgctcgaattctccaagcttctggtcgaacaggccgatgtggccgtcgcgcccggtatcggctttggcgagcacggcgacgattacgtgcgtattgcgctggtcgagaacgagcaccgcatccgtcaggccgcgctctttagaaatcgccacggacggcaactcgccgcccgtggcatcccacctgatagccactccatacagaaggtcgaaataatgagtgatgcattacggatcggcgttgccggcctcggcaccgttggtgcttcggtgttgcgtatcctgcgtgacaagtccgaaatgctcacgcgccagtgcggcaagcctgttacggtcacggcggtcagcgcccgcgaccgcaaccgggatcgcggcattgatctttctggtatcaattggttcgacgatccggtcgagctggccaaatctgccgatatcgatgttttcgtagaactcatcggcggcgaggatggaccggcccgggcttctgtcgaagcggctttgcgcgccggtcgccatgtggtcacggccaacaaggcgctgctggcgcggcacggcgttgcgcttgccaagatcgccgaggataagggcgtccttctcaacttcgaagcggcggtggccgggggtattccggtcatcaaggcaatgcgtgaatcgctgaccggcaatacggtttcccgcgtctatggcatcatgaacggcacctgcaactacatcctgacccggatgtgggaagagggcatttcgttcgaagcctgtctcaaggatgcccagcgcctcggttatgcagaggccgatccgactttcgacattgaaggcaatgacacggcgcacaagctggcgctgctgaccagtcttgccttcggcacgcagatcgctgccgatgacatttatctcgaaggcatcagcaatatttcgctcgccgatattcgcgccgccgatgaactcggctatcgcatcaagcttctgg

SEQ ID NO: 53099 - DNA, 507 bp, Glycine max
  Peptide Sequence Number=SeqID_144784
atgcaaggtgtgatcaagtttgtaaaaggctggctgattttttccctgctgtggggcatttttatgtggtttgtatcctggcaggcacagggcaaaacgccgggcatgatgattgtcatgagcctgtatgccggcgggcaggatgggaagaacgttactgacgggatggtttttattgctgctatcactggcggccagtgcacaattaccggtggggcctgtggtgatagcggggcagcatgggcgccacctggccgggcacagcagaacgacgggacggcgtgccgcagcggcattgagtatcggggccgcacgggccccgatcgccggggattatttacgccccagcaggaaaccgacaatcacgccgatgctggcggcaacggccagcccggtcgccgggttgtcgcgtaccgatctcaccacgcagtctgctgcatcctgcaccgcataactggcctgcgccggatagcgtcgcgcggcaccgcgtgcctgatggcggcgtga

SEQ ID NO: 53100 - DNA, 348 bp, Glycine max
  Peptide Sequence Number=SeqID_144785
atggccgaaccgtcaacccaatcgtccattctcccctttcctcggagctccgtgaattgcgttttcgttcatgtgtcctccactttcgagtttggagctgtgtttcatgattgcctaagtgcggaccctcaaggcaatcctccattctccccgctttttcggagctccatgaattgcgtttacgttcatgtgtcctccactttcgagtttggagctgtgtttcatgattgcctaagtgcggaccctcaaggcaatcctccattctcccctatttcggagctccatgaattgttttcgttcatgggtcctccactttcgagtttggagttgtgtttcacgattgcctaa

SEQ ID NO: 53101 - DNA, 225 bp, Glycine max
  Peptide Sequence Number=SeqID_144786
atgtcagtgaaaaacctcgtcgggcgcctaggagtacatgacaagacaaaccacatactagaaagtcaatcaaggtcacagtgttttacgagaatgctccaactatatgggatcaatataggcttaaaggagcactcaaaccgtgtgacccccaaggcctacactccaaagagtccgtcagggtctctccctcctgattcaggtccaacccagaaaacattttag

SEQ ID NO: 53102 - DNA, 335 bp, Glycine max
  Peptide Sequence Number=SeqID_144787
atgaccggattgaaagtgctcatctgcggcgcaggcattaccggtaatgccctggccttttggctatccaagatgggccatcaagtcacggtcatcgaaaggcattcgagcttgcgtgccaccgggctgcaagtcgacctccgagaaccgggtatcacagtcttgcgacggatgggccttgagcaacaattccgtgccaggtctgttcgcgaacagggcatggaaattgtcgaccatgccggcaaacgcaaggcatatttcgccgccaatcgatctggcttgggaatgcagagcttcaccacggattatgagattatgcgaggtgacctctgtcg

SEQ ID NO: 53103 - DNA, 231 bp, Glycine max
  Peptide Sequence Number=SeqID_144788
atggatgaattcattgaactgatgaaagaacataacttggaaacgttgggatgcttgagtgcccacttggctgtagccatgactaattttgcacgttgttttcaaatcatcattgtcacacgtgccttatggaacaatatggaagctcgtcccgaaatcgacaccttgacacccaaatttgtttcgccccagatatcaagattgggttcacacgataaaagaccccattga

SEQ ID NO: 53104 - DNA, 342 bp, Glycine max
  Peptide Sequence Number=SeqID_144789
atggcttcaggaaagaggaaggcaaaagctttggtaccccaggccaaatatgatagatctaaattttcatcccaagaggcttgggaccgcttcacagaaaatatactcggctggaagatccttctggagagaaatgtaaagctgtatgtcactgagttagttgaattcagaagggagctagaaaggagaaactggcataaggaacttataaactttgcagatgggagcatagatgtagcaattgtcaaggagttctatgcaaatctctatgaccccgaagacaaatcacccaagcagaggaaggggagagcttgccagcctactccaggtttgctcagttga

SEQ ID NO: 53105 - DNA, 60 bp, Glycine max
  Peptide Sequence Number=SeqID_144790
atggctactttatcgtattatcacgagggatcggggtacgaatctacggacgatgcttga

SEQ ID NO: 53106 - DNA, 981 bp, Glycine max
  Peptide Sequence Number=SeqID_144791
cgtttatgcgagacagagaccaacatgttagctatcatcgccaagtacgaagaagagttaggtctagccacggcccacgaacatagaatcgcggatgagtatgctcaagtatatgcggaaaaagaggctagaggaagggtgatcgactctttacaccaagaggcaaccatgtggatggatcggtttgctcttaccttgaacgggagtcaagaacttccccgattgttagccaaggccaaggcgacggcagacgcctactccacccccgaagagattcatgggcttctcggctattggatccctatcgcaccagatccaaatctagaacgatgggtgatcaaagaggagacacaggaacagatgaaagccgacatgtcggctctgaaagaacagatggcttccatgatggaggccatgttaggaatgaggcagctcatggagaaaaacgtggccatcgctgccgccgtcagttcggctgccgaagcagacccaactttcttggcaactgcgcaccatcttccctcaaacatagtaggacggggaagggacacactggggcacgatggcaaccctcatctgggatacaaccgagcggcttacccttatggattgccgcccaactactcaccacccgtcctgcaagacgatgcaggccatattgcttctcccgtccttgaaagagaacctcctcaacagcccgatgaggtccacaaagaccctcaagactatgctcgaagggatgtcgagttctatcccccgatccctgaagggccggcacccagcatgttgcctcagcccaacatcacgacacaaccaatagttttgtccacagaaggaccgcccccggcaactgaagaaaggaggaagctcgatctcctcgaggagagattgagagccgtggaaggatttggggactatccgttcgctgacatgacggatctttgcttagtacccgatgttgttatccccccgaagttcaag

SEQ ID NO: 53107 - DNA, 483 bp, Glycine max
  Peptide Sequence Number=SeqID_144792
atgcgacagtttggatacacccagaccattcctgctccgcctgtcgattcatgggtgtcgtacgatgatatacacaacaggtggatgcattatttggatcatatggttccaggaggtgaggtatgcgttgtgccaggtcagtgtgccagcgactacatagactggttcttccgcatttcccatcctttcatgacaccaggccagacatcatatcctctgccagatggtcatgctccgcagccccaagtcatccctcaggccccagagacagatatccctcacgtgccagagccaagagcaccatcgacatctgcgaggcccgctgtagaggagcctagacatgtagtggaggtttgctatgggattgttgagaggttggagtgccatctgagcctaggggtggtcacgccaggctcatcgacacatgaggtgatcgaagaattcctctggatggccaggagtgtcacacaggatcaggcgtag

SEQ ID NO: 53108 - DNA, 612 bp, Glycine max
  Peptide Sequence Number=SeqID_144793
atgctcgaaagttttcaacaacaagatcaaatgtcagttttggaattgtacatagaaaaggatgtggctggtggttctatgtttaattctgcaaattctcttacagcatgtggaaataatttatctaataatgaggcgcaaccgccaagaaatgtgagcaatttacatggtgatgaagatgatgatgatgataattatcttgtgtctaactcatacgtggaagagtctttagacgaagatgatagtattgatggtatatctgatacagacgatgaagtcaccaacatgattcaaccagtaagaattgttcacccggtagaaggtgtacaaggaattcaaaatccattttggaatgatgttttgcattataataatatcaactggagtcatcctgatgaggaggacatttgtggtttggagatgccatcgagttttaatgttggccaagaattatatgttgacatggattttgatagtaaagatgtggtcaagaatgcagtcaaacaatatgttatgaaggtgcatcaaagtttcaaagtggttgaaagcaaatcgaacaagtatgtcgtttgttgcttgaataaaagcgcagagtgtccttgccctttctag

SEQ ID NO: 53109 - DNA, 492 bp, Glycine max
  Peptide Sequence Number=SeqID_144794
atggatttcttttccaatgagagttttgaatgcattcaggcatttgaaaactccaatctcattcctttaatgtctttaaaattgcctgtttacactgaattagttaaagccttctattctaacttagaaatccaagaaggcactttaatttctgaagtctatgggataaaaatggtcattgaacaatccctattctatgacttgacccaattatccagtgaaggtgtaccatttgaaggtacactgaatgatgattggaaatttgacttctctatgcatgatgcccaccggttggtttgcaccaaccaagcggatattaccggaaggcttcttgccgattcattggcttttgaaagccacatccttcattatctcattgtgtgtatctttcttccaagatcttcaaaccttgcacaagtttctgaagaagatcttattgtcatgtgggcttttcacacagaccgacaaattgattgggcacacttagtctga

SEQ ID NO: 53110 - DNA, 216 bp, Glycine max
  Peptide Sequence Number=SeqID_144795
atgggggtgcaaatagcaaccaagcccacttgggccttccagaaaattcctccagaaggcggttgcttctggaggaagcaacctagctcgcctgggcaagctggaaaatccaagccgaggcacttctgtaacgtttatgtaacgttttcgtgggtgatttcgcgaagattttcaaccgttcttcgacgttcttcatcgttcttcggtcttcaaccg

SEQ ID NO: 53111 - DNA, 240 bp, Glycine max
  Peptide Sequence Number=SeqID_144796
atgtctgcgtactatgaaagtgccacaaggatactcttcaacatcaagagccttgtgtctgtgactgagcttaagttggttggcttgaaatcgcatgattgtcatgtgttaatgcaacaacttttgcctgtggcaattgcgggacgttgcctgaaaagaatggtacatgaagctcttaaagggttataccaagaatcaacatcgaccagaggcgtcaatagtggaaagatacgttgctga

SEQ ID NO: 53112 - DNA, 429 bp, Glycine max
  Peptide Sequence Number=SeqID_144797
atggataatgaagagggcgtgcaggaacagatgaaggccgatctatcggccttaaaagatcaaatggcttccatctcggaggtcatgtcaaaactccagaaaaccatagaggataaagccaccgcaaccgcctccagtacagttagggaagcggagccggtgctgcaacccgccttgaatccgggcctagacagaaacacggccgtgttcggtcgaaggtatagtccggaagcttatccttatggcctgcctccgaacttcaccccccgtgccaccccggaagatttaagccaagccccgacctttgaggggcaactcccaccttatgaagactatcccgggcaagacgatggggaaggagatacccatcttggccccctgctccacctcaagatccatccccgcatgaactaccccagccgaacatag

SEQ ID NO: 53113 - DNA, 564 bp, Glycine max
  Peptide Sequence Number=SeqID_144798
atgggtgatcaagaggagacacaggaacagataaaagccgacatgtcggctctgaaagaacaaatggcttccatgatggaagccatgttaggaatgaggcagctcatggagaaaaatgtggccaccgctgccgctgtcagttcggctgccgaagcagacccaactctcttggcaactgcgcaccatcctccctcaaacatagtaggacggggaagggacacactggggcacgatggcggccctcacctgggatacaaccgagcggcttacccttatggattgccgcccaactactcaccacccgtcctgcaagacgatgcgggccatcttgcttctcccgtccttgaaagagaacctcctcaacaccccgacgaggtccacaaagaccctcaagactatgctcgaagggatgtcgagttctatcccccgatcctcgaagggccatcacccagcacattgcctcagcccaacatcacgacacaaccaatagttttgcccacggaagggaccgtcccccggcaactgaagaaaggaggaagctcgatctccttgaggaaagattga

SEQ ID NO: 53114 - DNA, 537 bp, Glycine max
  Peptide Sequence Number=SeqID_144799
atggtaggagcgtccattagccggctcccccgatggaaagaaggaggggcaagagtgttatgctcgtgtgaaggattcccaaatgtccccttgatgggaatgaagggttgtattaattataatcccatgctagccataagacaactaggctaccctatgagaggtgcaccatcggaggagatcatcgcgtgtttcgttgcacgaggcttcaatgaagccaatgcgaagatacttcaaagagttcgtaaagcatggaatacagtggaaatgaaagataaggagcttaggggaagtagcaatggcatcatcggtggctatcacaagtggttgaattctaggacgcaagggataacttggctcccaaagctaaaaggcctaagtgggaaagaagctgaagtccctaaggaaagcaaagaagtgcaagctttgaaagcggaactcgaaaaaacaagagtgatcaaggagaagctaaagacggcagtcactagagtcaggaaagattgtgatgagctgagaggtcaacatgactacggttga

SEQ ID NO: 53115 - DNA, 372 bp, Glycine max
  Peptide Sequence Number=SeqID_144800
atgggaaacccgttaaggaaagatcatgaacttaggggcattcgtaacgacatcattggtggttatcatgaatggctgaaagttcatatacgaggtttagattggctcgccaagttaaaagtcgtcagcgaagacagtttcgaagcaccagaagaagacgaagaagtccaagctctcaaaaacgagttaggaaaggcgaacttgcaaggagaagttcaagttggtacaccattgagaattgaggaaattctaggatgtcctctcgggggaagaaaaccatacctttcctccgggtgtctcccctctttgagcagaattgcaactgtggtcaaggagattcagcaaaaggtttcgggactcgggtgcatatag

SEQ ID NO: 53116 - DNA, 140 bp, Glycine max
  Peptide Sequence Number=SeqID_144801
gtgcatcacatatcgacacgctcgaaattgaacaacaggaagctctcgagaaattcaaatcgtcaaaaattttcacacggaggtccaattcaggcacatcacatattgagatgctcgaaattgaacaacggaagctctga

SEQ ID NO: 53117 - DNA, 860 bp, Glycine max
  Peptide Sequence Number=SeqID_144802
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataagataccaggcgtttccccctggcggctccctcgtgcgctctcctgttcctgcctttcg

SEQ ID NO: 53118 - DNA, 642 bp, Glycine max
  Peptide Sequence Number=SeqID_144803
atggctacctcaccaaaagaaacttcagctcctggttcaccctctgcaccatcaaaccaggaacgacctgaattcaatatccagcccatacaggtgattcctggtcaagcccctgttcctgagaaactggttcccaaaagacaacagggagtgaagatttctgaaaaccctagccctgcaacaagtcctagggaagtagacccggagatggataagaagatccgcagtattgtgagtaacattctgaaaaatgctgctgtgcctgatgctggtgaagatgttccaacatcctccaccccgaatgtttctgtgcctgatgttgataaagatgttccaacatcttccactccaaatgctgaagccctcccttcacccagtgaagaggaatcaacagaagaagaggatcaagcctcagaggagacccctgcaccaagggcaccagaacctgctccaggtgacctcattgacttagaagaagtcgaatctgatgaagaacccattgccaacaggttggcacctggcattgcggaaagacttcaaaacagaaagggaaaaaccccccttaagaggtctggacgaatcaagactatggcacagaagaagagtactccaatcactcctgccacatccagaagaagcaag

SEQ ID NO: 53119 - DNA, 694 bp, Glycine max
  Peptide Sequence Number=SeqID_144804
aggactacacgtcctcgcctttagagggctacacaccctcgcctttagaggactacacgccctcaccttcagagggctacacgccctcgccttcaaagggctgcatgccctcgccttcagagggcgacacgccctcgacttcagagggttgcacgccctcgcctttagagggctatgcgtcctcactttcagtaggctccacatccgcaccttaagagaatttaagatcctttgcccgccaccccctgatccaggaggagggccaactatgcgagcacaaccagaggaggaggctatcgcgcagctactatgcatatcagggcaagatttcagccatgccactgcaaagagacgagtgcagatcatgcgcactaacatgaccactcttacacaaatatggatgacgttgctacttagcaacattctgcccagcaaccacaatgctgatctccccatacggaaggatcgcgcccataagacacccagtggacccggaggagtccaacagggccctggggtttccagcttttgttgtgggcctcagtcaatcctacagggtgcccgtcccccccagcaagggattgcgcccgcaagacacccagtggacccgaagaagtctaacagggtcctgggatttccagctctgattacgggcctttgtcagttctacggagtgcccgtcgcccccaacaag

SEQ ID NO: 53120 - DNA, 294 bp, Glycine max
  Peptide Sequence Number=SeqID_144805
atggggctcaatgaacaaggtattggaaatgatagcttaaggtcaacaagtgagagggaagaggaaagaacaagcatagctaggttccttagtaggcttaatatgaaagtgagggataaggttgaactccttccgtatagggacctagatgagctagtacaactttgtataagagtggagcaacaacttaaaagaaagccttcttcaaaatcttatggctttcactcttatccaaggaaggaccaagcccaaggaatttgggtgctgcacctttcaaaaccaaggaagataagg

SEQ ID NO: 53121 - DNA, 162 bp, Glycine max
  Peptide Sequence Number=SeqID_144806
atgcatgatgcgatcaaggaacaagccagaggactatcagtgacaatgcatcaccaaaagaggaaaacactagacaagactttgctattatcaagcgagtcggagacccagcatgaccatagatcaacctccattccctatggctcacacagacccgagtaa

SEQ ID NO: 53122 - DNA, 331 bp, Glycine max
  Peptide Sequence Number=SeqID_144807
atgacttccgttgagcttcctatgagtgattgggaggacaaatggattgatgtgtacttcgacataagttcaaagttgctagacatttgcaatgcatttagctctgagctttcaccgcaaatagataatatatgtgcgagagccaaagggcatgaagatgaagacaatctctggatattgtgttttgtgggaaattctactcaaagtgttgatattaacaaggagctcagccttgggcaagtggaatttgatcagttcaaaaggcaacaaagtggcagtgggaatgctgatggtgaaaattttagtcaacaacttgaatgggttcaaagcg

SEQ ID NO: 53123 - DNA, 393 bp, Glycine max
  Peptide Sequence Number=SeqID_144808
atgacgtattccaacatcaagcgcgacacctataaaaatccgacgctggcgcagtggaacaatggcggcgccgacggtgccgcctcgaactacgaccgcacctacaccctcaacgacctgagcatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 53124 - DNA, 426 bp, Glycine max
  Peptide Sequence Number=SeqID_144809
atggtggcacgggtaatgctcaggcacggttatgagcccggaatgggtctgggcaaggacagccacgggaatgccgatgtggttgacgttaggggtaacccgcacaaatatgggttggggtatgagctcaagaaacctggaagaaggaatgcaccatcaagactccgggcagatagggcatggcccggtcatgttagccagtgtttcacaagtgctgggataatgttcgaggaagaggtggcggcaataggagaagaggctccacaagatccgccaagtttcgtgcgaccgtgccatcccaatttccaacttgggaactggcacgtgacgagccagtcggaagtctataccgctgattcaatatgtaaggatcgatcctttgaggatcctaacaacgagggtttgataatcgattttgaccgagaa

SEQ ID NO: 53125 - DNA, 138 bp, Glycine max
  Peptide Sequence Number=SeqID_144810
atgggtttgtcaggcttaaaggagcactcaaatccggtgacccccaaggcctacactccgaagagtccgtcagggcttctccctcctgattcaggtctaacccctaaaattattttagcacccagacactgctcgtga

SEQ ID NO: 53126 - DNA, 435 bp, Glycine max
  Peptide Sequence Number=SeqID_144811
atggtgaaagttggaacctcttacgtgccgatcaacgtctcattttcgccaaaagttggcccagggcttcccggtatcaacagggactccaggatttatttattctgcgaagtgatcttccgtcacagctgtccctcctgttcagctactgacggggtggtgcgtaacggcaaaagcaccgcccggacatcagcgctggcaagtgtagcggtcccgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattttaa

SEQ ID NO: 53127 - DNA, 123 bp, Glycine max
  Peptide Sequence Number=SeqID_144812
atgactaaagcacgtcaaaagggggtacggaaagaaaatgggggagatgcttgccacccagctcgcccaggcgagctaggttgcttcctccagaagcaaccgccttctgttggaattttctag

SEQ ID NO: 53128 - DNA, 550 bp, Glycine max
  Peptide Sequence Number=SeqID_144813
ggcctctctaaccggtgaaaagtggtgggtgtccactaacggccattcctggctcggctccgataacgcaattccggaaggagtcggtagttgggcactggatcccttcggacctggagaacgtgtgacgctgggtcggggtttggtgaaccaactggtcgctcctctagttgaagcctcccagttcaaatacgtcataaggcgtggaattagaccaaggggaatctccataggaactagtccctcagatttcgcacgtaggagatcgagacacagccccagggctatgaggaaagatgaaagcccggccagaaccacacgtgcaagtttccctgcatgtggctcgtccgtgataacttattcggatttgcgcgaactagcggaccgatcactaagtggggatgctccctccagcatgagcgaaccttttcgaaactggttaggaatgggcgtcactatcccagccctgatccagccagaagaggaaatcgcaatgcatcttgctcagctggcaaggcgtagcttggagtgggagtgtagcgtgggtaag

SEQ ID NO: 53129 - DNA, 138 bp, Glycine max
  Peptide Sequence Number=SeqID_144814
atggaaattctagatcctttatattggttggaccttatgatgcaatcctaccccgcaagggcattggatagaaaactccaagtagattgggccagagatgcaagagaaggccctagggttcttatgagccttgggtag

SEQ ID NO: 53130 - DNA, 753 bp, Glycine max
  Peptide Sequence Number=SeqID_144815
gatcccacccctcaccttcaaagggctacacgccctcatcttcaaagggctacacgccctcaccttcagaggacttcacgccctcaccttcaaagggctacacgccctcgccttcagaggactacacgtcctcgccttcagagggctacatgccctcaccttcagagggctgcacgccctcgccttcagaggactagacgttctctccttgagaggattatatgtcctccccttgagaggactacacgtcttcgccttcggagggctacacaccctcgccttcagaggactacatgtccctcttttcagaaggggacatgctctcgcctttagagggcgacacgtcctcgccttcgaagggctgcgctctccctcgccttttgagggctacgcgtcctcactttcaaaacattctgcccagcgactgcaatgccgatctccccctgcgagagtatcggttggtctgtgccatcccaacatagggatcacgcccgcaagacacccagtggacccaaagaagtccaacagggtcttggggtttccagctctgattgcgggcttctgtcagttctacggagtgcccgtcatccctagcaatgtcatcaggcctcctactaaccgagctttcatcaagaagtattgcgcccccaggaaggcagaggacgagacactacaacagcctggggatggccagcaacaggcatcaaatgcatcgccgccacctccagagcccctcagctcatccacaaaaag

SEQ ID NO: 53131 - DNA, 507 bp, Glycine max
  Peptide Sequence Number=SeqID_144816
atgggatcaagtcaaaagccttcgcttaaaaagaggttctatcaagtcaaaatcaagagcttagaggtcactagtttacgagagttggggcaattaatgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtctgaagaaatcctgggatgcccactgggaggaaggaagccatatcttttctctgggttctatccctccacgacaagagttgccaaggtagtgaaaatctcagcacaagagttggaccatcttggctaccccatgagaggagcgccattagacgaaagcatcacgcctttcatcgcacggggttttagtgaccacaacgcgagggtactccaaggagttcgcaaggcatgggatgcggcgtga

SEQ ID NO: 53132 - DNA, 198 bp, Glycine max
  Peptide Sequence Number=SeqID_144817
atgcaatcacaaggactcgcactacctactgagcctgaggttggtcttttcactacacgtgtcaggacaaaggagagttgtattgatccctcagggaacgaccttgacacgggagttgtgggactggggaaacctgcagataggtcggatcattatgttgatgatcccctatatctgatgacattggtcatcccataa

SEQ ID NO: 53133 - DNA, 480 bp, Glycine max
  Peptide Sequence Number=SeqID_144818
atggataattcccccacaaagaaaaattcgttaaagcctggacaaataagtgtttgggatgccatgaacaacatgatcatgcagcaacacactgaaattaaggcatcctttgatacaagtacacatgcggctggacatgtttttaaaattaccttatacaagaggctacttggtatgatatcaaggtatgctttaaatcaaattgctactgagtatgagcatgtacattatgctaacaaaaacccttctcgttgtggatgtgtcatgagaactactcgcgatcttccatgtgcatgtgaactatccaaatatgttctcggtaccatactgtcataccctaatttcgtccagggattattatttgatgacatacaacctttgattggccgcttcgagatacttggcaccctttgttgcacaatatgtgaagtcccgagacgtgccgaaaatcaaaaggaagcaggcttatgcgatccgtga

SEQ ID NO: 53134 - DNA, 180 bp, Glycine max
  Peptide Sequence Number=SeqID_144819
atgtcacttcatgatagaacaagcgaatggactgaagcggtgcgcttagcagcatggcccttcgctcagcaaacatgcacagctcatccttcttccagattcttcctcgcgcttagccgaggaatgttgcactcagcggatggctcgctaagccagcagattggcttagcgagagggtga

SEQ ID NO: 53135 - DNA, 243 bp, Glycine max
  Peptide Sequence Number=SeqID_144820
atgggtgccaagtacctcgaagtggtcaaacgagggtcgcatcccaacaaacggatggtgcagaatgaccataatttgtctctgcgtgcccttgggcacaatcgagcttggatggcaaggcgcagaatgaccataatttgtctctgtgtgccatcatacgtgatcgcctctggatggcgaagaggtgtggggaatgaccataatttgtctccgcccacctctcgactcactgtccctgaatga

SEQ ID NO: 53136 - DNA, 297 bp, Glycine max
  Peptide Sequence Number=SeqID_144821
atggtttcccatctcgctcttcctttatcacacaacaatgtgctggcttgcccgagatctgaattcgatgtacagcagatccctgtgtggggcaagttgaaacatggatgccagggtggccaatgcatcggccatttggttctcttcccgagtttcccattctcctctcaactggcgtatcaccaaagccgagtctccatacactttgagcagttatacatcaaaatcaatggccgcttgaatcccaagggcgcacgcttcatattcgaccatattgttggtacaatcgaaacctag

SEQ ID NO: 53137 - DNA, 483 bp, Glycine max
  Peptide Sequence Number=SeqID_144822
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgtgtcttctatccaatacccttgcgggatag

SEQ ID NO: 53138 - DNA, 672 bp, Glycine max
  Peptide Sequence Number=SeqID_144823
gtctgagttcctcattggaggatacgtaggagcaaaagcctcgcttttgtcgaccacaccgctttctgttaccatgacccaagagctggccaatgtggtcatctgcgccctttccggagatgtcagcatcttccggagcaagagccttgcttttgtcggccgccccacaatctctgtcatactgaccctgacgtcatgtgacatgcggagacaaattatggtcattccgcacccctttgccattcagacacagtcgtgtccgatggcacgcagagacaaattatggtcattctgcatccttttgtcagccagaggcggcgggcccgatgacatgcggagacaaattatggtcattccgcacccctttgccattcagacacagtcgtgtccgatggcacgcagagacaaattatggtcattctgcacccttttgtcatccagaggcggcgggcccgatgacatgcggagacaaattatggtcattccgcacccctttgccattcagacacagtcgtgtccgatggcacgcagagacaaattatggtcattccgcacccttttgtcatccagaggcggcaggcccgatgacatgcagagaaaaattatggtcattccgcacccctttgccattcagacacaatcgagtccgatggcacgcagagacaaattatg

SEQ ID NO: 53139 - DNA, 507 bp, Glycine max
  Peptide Sequence Number=SeqID_144824
atggcatcagggaaaaggaagagcactgcttataggccacaagctcagtatgatagcaggagattccaatccttggaagcctggaaccaatatacagataacattttggactggaggatccttccggaaaggaatgttaagatttatcatactgaattcgatgagtttaaggcaaagttgaagaggcgtaacctacacaaacgcctcgccaaccttcaggagggaagtatagatgtggcggtggataaagaattatatgccaacttatacagcccggaaaaccagagccctaagcaagtgagggtgagaggacatttaatcaggattggtgctaatagcctgaattccttcttagagactccagtagtcttggagaagggtgagacactgcctacctattccagagggccatccttggaaaattctaaggaaagatctcaccactcttacatagacatggagtgtcctctcctacagcaacttgactcccacttcccacacctctga

SEQ ID NO: 53140 - DNA, 300 bp, Glycine max
  Peptide Sequence Number=SeqID_144825
atgaaacaaaaaggaaaaagaaagaaagaccgcgaaggtcgacatgttatagttaagaagtataaatcattcgaaaagagcaaacgtatcttctggaaacaagggactgatgctaagaggtgcttgagtgcccacctggctgtagccatgactaattttgcacgttgttttcaaatcatcattgtcacgcgtgccttatggaacaatatggaagctcggcccgaaatcgacaccttgacacccaaatttgtttcgccccagatatcaagattgggttcccacgataaaagaccccattga

SEQ ID NO: 53141 - DNA, 735 bp, Glycine max
  Peptide Sequence Number=SeqID_144826
gaagtcgctgcatgttcttaatccttatgcgttttctggattttcccccagggatttcttgtctgctgtatctctcgttacaatctttcaaagaaatgaacgtggattcgaggctttagtcctcactttggggcaggatcatcttgagctaccttctggggtgaggacaaaacatggacagcagaaaccaatcaaggtggctatcttggcagatttgtttgacacctttgaccggagcgcgatcaattggtttcctcgttggaaggaaggcaaggaaggagttcttttctcgtgtggggactaccctaatgttccactgatagggactaggggttgtattaattataatcccgcactcgccataagacagctagggtatcccatgaggggagcgccaaccgaagaaggtctctcgcctttccttgtgagggatctaggcgcgcaaggcctcaaggttaaacaaagaatccacaaggcttggaggagtccgttgaagaaacacaaggagcttagaggcatccgaaatgacatcatcggaggttatcatggatggctaagaattcacacgcggggtttagattggctctccaagttgaaagttatcgatgaggagaacttcgaagctccggaggaagatgaagaagtccgagctctaaaattagagctagggaaggcaagactcaccaaggagaagttcaaatcagctgctatacacatctggaaggagtgcaccga

SEQ ID NO: 53142 - DNA, 278 bp, Glycine max
  Peptide Sequence Number=SeqID_144827
tgatccgaccgccgatcacccgggccttcatcgagaagtattgcacgcttaggcagacgcatggtgatgcacctcaggacgcaggtgcaccgccaccacctcatcaggccgatcccactggatcactaggcatggaacattatctacagcacttggttcgccagcaggcggccaaccaccgagggcaggcaccacatacaccagttagcccttcgtccattaagcatgaatgcaagttaggctcagaggcaattaatcgaacacgaagcgtgcactga

SEQ ID NO: 53143 - DNA, 114 bp, Glycine max
  Peptide Sequence Number=SeqID_144828
atgaagatgctcttgataccacatgatatgaatagcagcagaatggagaaggaagagagagaggagacaccacttcaaggagaagatgagtctagaagaagctcaccaccatag

SEQ ID NO: 53144 - DNA, 47 bp, Glycine max
  Peptide Sequence Number=SeqID_144829
ctccaatggagcttacatcatgtggtatgaagagcatcttcatgtag

SEQ ID NO: 53145 - DNA, 672 bp, Glycine max
  Peptide Sequence Number=SeqID_144830
cacctcatgaaagggttttccaaactgggctgggcggtactcgccctgctcggcgcattctgtctgggcaccgtagccctgcgccgcggcgaacacatcaacgcactgtggatcgtggtggcagcggtttcgctgtacctggtcgcctaccgcttctacagcctgttcatcgccaacaaggtgatgcagctggatccgacccgggccaccccggcggtgatcaacaacgatggcctggactacgtgccgaccaacaagcacgtgctgttcggccatcactttgccgccatcgccggtgccggcccgctggtcggcccggtactggccgcgcagatgggctacctgcccggcctgttgtggctggtggtgggcgtggtgctggccggtgcggtgcaggacttcatggtcctgttcctgtccagccgccgcaacggccgttcgctgggcgacctggtaagagaagagatgggccaggtgcccggcaccatcgcgctgttcggcgcgttcctgatcatgatcatcatcctggcggtgctggcgatggtggtggtcaaggcgctggccgaaagcccgtggggcatgttcacggtgatcgcgacgatgcccatcgcgatcctgatgggcgtgtacatgcgctacatccgccccggcaagatcggctagatctcggtg

SEQ ID NO: 53146 - DNA, 573 bp, Glycine max
  Peptide Sequence Number=SeqID_144831
atgaccatgattacgccaagctcgaaattaaccctcactaaagggaacaaaagctggtaccgggccccccctcgaggatcgaattcctgcagcccgggggatccactagttctagagcggccgccaccgcgggggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaacaaccccgtcagtagctgaaacaggagggacagctgataagaaacaggagccactgggagcacctcaaaaacaccatcaatacactaaatcagtaagttggcagcatcacccgacgcactttgcgccgaaataa

SEQ ID NO: 53147 - DNA, 621 bp, Glycine max
  Peptide Sequence Number=SeqID_144832
ggctacacgccctcgccttcagaggactacacgtgctctccttcagagggctacacgccctcaccttcagaggacttcacgtcctcgcctatagagggctgcacacgctcgcattcagaggactacacgttctccccttcagaggactacacgtcctcgccttcgagagggctgcacgccttcgcctttagaggaatacacgtttttgccttcagagggctacacgccctcgcctttagaggacctacacgtcctcaccttcagaggactgcacgtcctcgccttcagaggactacacgtcatcaccttcagagggttgcacaccctcgccttcagaggactacaagtcctcactttcagagtcaacacgtcctcgccctcagagggctacatgccctcgccttcagaggactacatgtcctcgccttcagagggctacatgccctcgccttcagaggactacatgtcctcgccttcatagggctacacaccctcgccttcagaagactacacatcctcagcttagaggtgctacacgccctcgcattcagaggactacaagtcctcccttcagaagactacacgtcctcgccttcaaagggcttcacgccctccctttag

SEQ ID NO: 53148 - DNA, 564 bp, Glycine max
  Peptide Sequence Number=SeqID_144833
atggcagagccatcgaagaagagaaagggatcatcctccaccgccgctgctgctgcctatcgccgccacgggccatctgaagcatccacagcacctattcatccatctttatcatctccaagatcatccacattgttttcttccgatgatcaacgtctacggtacctctctcaattttcttctaggatcatcttagaccctaagtacctagatgtagaattctttaatgatgaaacgtttgattgctatcaagtgtttcaaaattttggccttgttgatttcatgtcattaaaactgccacaatatcctgaacttgtaaaggtcttctactgcaatttgaaaattcaggatgacattatttcctctgaggtgcatggtattcctatgatcattgatcagtccttattcttttctttaactcatttacccagtcaaggtgcaccttttgagggcaccattgttgatgactggaaatttgattattctagtcatgatgctcgccgcatggtctgcaatgatcaagctgaaatgaccgaattttacttcctcggtcttcaaatttag

SEQ ID NO: 53149 - DNA, 1734 bp, Glycine max
  Peptide Sequence Number=SeqID_144834
cgatagagggctacaggccctcaccttcagaggattgcatgtccttgcctttagagggcttcatgtcctcgtcttcagaggactacatgtcgtcgccttcagagggctacacgccctcgccttcagaggactacacgttcacacctttagagggctacacgcctttgccttaagaggactgcacgtcctcgccttcaaaggactacacctcctcaccttcagagggctacacgccctcacctttagaggagtgcacgtcctcgccatcagaaggcttcacgtcctcacttttagagtactgcacgtcctcaccttcagaggaatcctcatcctcgcctttaaagggcttcacgtcctcgccttcagaggattgcatgtcctcaccttcaacggagtgcacgtcctcgccttcagagcgctgcacgtcctcatcttcagtgggctacacgttctagccatcagagggctacacaccctcaacttcagagggctacacgtcctcaccttcagagggctacacgccctcaccatcagaggaatgcacatcctcatcatcagagggcttcacgtcctcacctttagaggactgcacgtgctcgccttcataggactacacgattacacgtcctcgacttcaaaggactacacatcctcgccatcaaaggacaacacatcctcaccttcagaaggttacacgccttcgccttgtgaggactgcatgtccttgccttcagaggactacacctcctcatcttcagagggcaacacgccctcacattcagaggactgcacgtcctcgccttcagagggcttcaggtcctcacctttagaggaatgcacgtcttcaccttcagagggctgcacgtcctcgcctttagtggactacacgtcctcgccttcagaaggctacatgccctcacctttagagggctacatgccctcaccttccgagggttacatgccctcacctttagaggagtgcacgtctttgccttcagaggactggacgtccttgcctttagagggctacacaccctcgccttcagagggcttcacatcctcgccgttagaggactatagagtgcacaccctcaccttcagaggagtgcatgtccttaacttcagagggctacacgtcctcacctttaggagactgcacgtcctcgcctttagagggctacatgccctcacctttagaggacttcacgtcctcgccttcagaggagtccatgtcctcgcctttagagggctacacaccctcgccttcaaagggcttcacaccctcgcctttagagtactgcatgtcctcgcctttagtggagtgcacgttgtcgcctttagagggctgcacgtcctcgccttctgggggctacacgccctcaccttcagggggctacacgccttcaccttcagagggctacatgccctcgccttcaaaggactgcacgtcctcgccttcatagggctgcatgccctcgccttcagagggcttcacgtcctcaccttcgacggagtgtatgtcctcaccttcaaaggattgcacgtcctcatcatcagaggactgcacgtcctcaccgtcagagggctacacgtcctcaccttcagaggactgcacgtcctcaacttagatggctacacgcgctcgcctttagaggactttacctcctcaccttcagaggactgcaagtcctcgccttcagagggctacacgcccttgccttcagaggactgcac

SEQ ID NO: 53150 - DNA, 814 bp, Glycine max
  Peptide Sequence Number=SeqID_144835
atgaaaattacagtgctcggatgcggagcccttggtcaactctggctgaccgccctatgcaagcacggacacgaagttcagggctggctgcgcgtacctcagccctattgcagtgtaaacctgattggtgaagacggaagtatctttaacgaatccctcaccgcgaacgatcctgatttcctggcgcatagcgacctgctgctggtgacgctcaaagcgtggcaagtttcagatgcagtaaaagcgctggccgcccagcttccccccacgtcgcccgttttactcctgcataacggcatggggacgattgatgaactgaaaagcattgtgcagccgctgctgatggccaccaccacgcacgccgcacgccgtgacggcaatatcattgtgcatgtcgccagcggcgtcacgcatattggacctgcccgggaccaggacggcgactacagttatctggcagacaccctgcaaacggtgcttccggacgtggcctggcacaacaacatccgccctcagctgtggcgtaagctggccgttaactgtgtgatcaatccgctgacggcgctgtgggactgcccgaacggggaactgaagcaccatccgcaggaggttgccaccctctgtgctgaagtcgcctcagtgatcgagcgtgaaggcttacacacatcggcggatgatttacgctattatgttgagcaggttattgatagtacggcagaaaatatctcatccatgttgccggatgttcgggcgctacgccacacggaaatcgactacatcactggctatctgctaaaacgcgcccgcgcacacg

SEQ ID NO: 53151 - DNA, 246 bp, Glycine max
  Peptide Sequence Number=SeqID_144836
atgaaaaagaagaagattgcactttatgggagtcgatttgatgaagaaatgagtgagataggaaggtttggaggtttgggaatggaggtacggggcaaggaggaaggggctgcgcaggagattctaaaaacgaggaggcagcctactggtaatcgattacatgaatattgtaatctattacaagccatctgttctagtgtaatcgattacagtattcatgtaatcgattaccagaacaaaaaatag

SEQ ID NO: 53152 - DNA, 444 bp, Glycine max
  Peptide Sequence Number=SeqID_144837
atggtggggtacgcgccttcaagctttgcggatttggtcttcgccgatgaaaggattgaagtgggtctaaaaagaggaaaatttaatcatcctgcttggacgaatgagaaaactggggcaaatgaagagggtgagaatgaaggagtaacccatgttgcgactgccgttcctacatggaaacttcccaccaacccaacaaacatcattactcagccaatatcaacccttctccttacccatcacccacctatagaattcaccctaattccgatatcctatgatgacttgctcccatatctactcgatagttcaatggtagccataacctcagccaaggttcctcaacctccatttttccgaggatatgactcgaacgcaatgtgtgcttatcatggaggagccccgaggcattccattgagcactgtatgaccctgaagcgtaag

SEQ ID NO: 53153 - DNA, 369 bp, Glycine max
  Peptide Sequence Number=SeqID_144838
atgcacctcaggccgcggacgccccgcctccccatcaggctggtccagccggatcattttgacacggagcagtatttacggcatttggttcgccagcaggcgaccaaccaccgggcacatgtacagacccacgattgtctttaccagatgagcctcagcctgcagagccagggttttacttcttttccgtgccctactccggaccagttcagggcagaggtcgcatggcttggagattggcctgaggcccgggcaggagaggcaccagcggaggcaccagcagaggctcccgacgaggcagatgaggcccgcgaggacgaggagatgaccgatttactggatttcttaggagggagcggggccacataa

SEQ ID NO: 53154 - DNA, 123 bp, Glycine max
  Peptide Sequence Number=SeqID_144839
atggagaattggcgaatagcgccagacaatcaattcgcggggctccacactcaagcgctaggcaatcaattcgcgggactccagactcaaggtggaggacacatgaatagcgctaggcaataa

SEQ ID NO: 53155 - DNA, 183 bp, Glycine max
  Peptide Sequence Number=SeqID_144840
atgcatgctttgttagggtcattcaacagtggaaactggtctgactctaaagtccttggtagtgcagggctgagttgtcgtgctttcacgaggaatcggagtgtgacaagtcaattgaattttaggagagcatatggttcaatgcaaatttactctaaatttggggggaggaaagtcaattag

SEQ ID NO: 53156 - DNA, 289 bp, Glycine max
  Peptide Sequence Number=SeqID_144841
atgtcttcatcattatcatcaaatgactcatcactatcatcaaatgaatcttcctctgacgatgacgatcacattacgaagaacaaagtgttgatgtttgctgtagctaatgttaccaattacttcatgaaatatgttgtgaaaaatccatgtagagattcaagcatgacaggccatcgttgggatataattaagcctattgatccatcatttagggatactcctgatgagattctaaaagatgccagatatcgcccttactttagggattgtattggtgcaatagatg

SEQ ID NO: 53157 - DNA, 450 bp, Glycine max
  Peptide Sequence Number=SeqID_144842
atgaagaataatgcagggaatatagaggaacctactaattctattaagtcttctaatttagaacatcctttctcttctctcctacggcgagatctcccaagatccgaagaagatttaaatgaattaaattctaagactcttgctacgttcttgaaggatgggaaagaagaagaatttggagaagatagtctcagtggtagaactttatcttctactacttcagaagtaagagaagctataaaaaggattcaagaagagagtttatttgaagaggataactcttttttctttgtacctgaagaaaaagacccatttgcaaatttcgattattcagcttccagtaaagcaggtccaagccatttaggtaaagggtgtaaccgtaaagacctatttgctaaagtagtgaagttacccactattttagaggaaagtgacacagaaatttattaa

SEQ ID NO: 53158 - DNA, 130 bp, Glycine max
  Peptide Sequence Number=SeqID_144843
tattcaccaagtgttggattgttcacccaccaatagggaacgtgagctgggtttagaccgtcgtgagacagtagggggcctcggccccccaaaggcacgtgccgttggtgaccctcgtgaggcggattag

SEQ ID NO: 53159 - DNA, 54 bp, Glycine max
  Peptide Sequence Number=SeqID_144844
gtgaatttgaggttttggtgatccctgaattgctggttgaaatgtttatcctaa

SEQ ID NO: 53160 - DNA, 300 bp, Glycine max
  Peptide Sequence Number=SeqID_144845
atgaccgaccctctcgatgagtcggtctcttgctttctcataagggtgaacccttgggtactagtaccctcacctccagaggactacatgtcctcgccttcagaggactacacgtcctcgccttcaaaggatcatggctacacgccctcaccttccgaggactacatgtcctcatcttcagaggactacatgtcctcacctttagagggctacacgccctcggctccgaggactatacgtcctcatcttcagaggactgcatgtcctcagcttcatagggctacacgccctcacctttag

SEQ ID NO: 53161 - DNA, 579 bp, Glycine max
  Peptide Sequence Number=SeqID_144846
atggataatgaagagggagtgcaagaacatatgaaggccgacctatcggccttaaaagatcaaatggcttctatcacggaggccatgctaaagcttcagaaaagtatagaagataatgctacgccggtcgcttccaatacagctagggaagcggaaccggtgctacagcccgcaataaacttgggccgagacagaaacacgatggtgttcggtcggaggtatagtcctcaagcctacccttatggtttgcctccggacttcactccccgtaccgctccggacgatttgagccaagcccctaccttcgaggggcaactccctccttatgccgactatcccctacaagaagatgatgaaggagatgcccatctaagctctctacttcccctcaaagatccggccccccatgaattgccccaagcaaacatagtccgccatgtctcatctccacccgaacccgttaaagaattcgatccctttgcaaaagataagggaaagatttatttacttgaagaaaggctgagagcgatagaaggcctcggcaactacccgttctcggatttagcggatctgtgtctg

SEQ ID NO: 53162 - DNA, 456 bp, Glycine max
  Peptide Sequence Number=SeqID_144847
atgcgcacggtatcggcgccgtatttctcaaccatcacctgtgggtcgatgccgttgtttttcgacttcgacattttgctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 53163 - DNA, 978 bp, Glycine max
  Peptide Sequence Number=SeqID_144848
atgaaaagagaaaaacatgcctcctatagtagtcataactcttgcaagagcctaagtgaagaacttcgtaactattatgaaggaaggcataggtcacatcttagacctcactcccataggagagaaaatgaaagaaagcctcaagatgttaacattaaactcacatacttccatgggaaggacaatgtagaggcttacttagattgggaaataagggtagagcaaaaacttaaaagaaagcctactttaaaatcttatggctatcattcttatccaaagaaagaccaaggtctaggcatcttaggggcatcaccttctaagcccaatgatgataaggggaagacaatagaaaagcaaccccctaaggctaaggacacattacttctctccaccaagaaaaccatgattatgaggatccaagacatttatagtagccaagatgaggctactacttcaccttcctctagtgaaagtgaagaagcaaaaggggaagaatctagtgaagaaatctacccccaagaagaaggaaaacctttaatggttaaggaggattgtaaggaggtaagtgtctcctccaagaggttagctaagaaggaaagacattttgaaataaagacaaatattgaagaaatttcccctcttaaacaacctccacattttctcctttgtaaaaagacacttgttagcattgccacacctcttaggcttgagtttattcctcaagtaaaggagttgttggatgagggtttggttcgcaagagcttaaatccttgtgcttttttggtgcccaaaataggtattactaggcaccaaatccctaaaatacgtggtatgatgaatgtgttgagtggtgcaacactcttttgtaaaatcactcatgcacccaacatcttcatgatttgtgtacatagggactcattagtaggcttgttcttattttttgtttcatgcaacctagtgctcatgtggacaccttag

SEQ ID NO: 53164 - DNA, 433 bp, Glycine max
  Peptide Sequence Number=SeqID_144849
ggatggggaagaaaaactagaaaaccaaaagaaaaagaaggatagtaaggccttgtcttcaaaggccaaggggaaggaaaaagaggaaaaggattcaaccaagaagattgttaagaaggaaaatcattttgcaataaaatgtgatatcaaaagagcactccttcttaaacaatatttctaccttctcctatcaagggaaacatcccttagcaccaccatacctcttgagcttaaggttattcctcaagtaaaggagttgttggatgagggacttcccatggaccctaagagaataaaggccattcctgagtggcctactccaccattaccactcattgagttggtgaggaactatgttctctcatgggaagatggtgttgaggaaagaatccctgagtttcaagaacctatggatttgaggttgaaattctga

SEQ ID NO: 53165 - DNA, 556 bp, Glycine max
  Peptide Sequence Number=SeqID_144850
atggatgtgctagtggatctagcggcgatcgatgcttttcttgcttatcaccacaacaaggaaagttcggtcattgctattttggccgatgactatgacatgtttgaccggagatgcgagaagagtaacacgagaattgtctgttgtacacccactctttatgtatggctgatggttgaaggcttagacgcaagagataacttggctctcgaagctaaagagttcaacaacaatgaactcaagcttcgaagggccaaaagggacgagtcgagggtggaaagtatgatattagaggacaagttgaaggcttgtcaaaggtcgaagagaagcttgaccgaacagttgagtagggcggaagagaacatgtggacaatcattgaccaggaagcaagagagagagtgatagattcattacacggagaagctatgatgtggatggataggttttctttcactctgaataggagtcaagagcttccaaggctgttagccaaagccaaggcaatggcggacgtgtactcaactcccgaggaagttcatgggcttttcgattatt

SEQ ID NO: 53166 - DNA, 270 bp, Glycine max
  Peptide Sequence Number=SeqID_144851
gtgatcattttaagggcgtccccagtggagtcgccaactgtcgcaacctacccttcggcgggagggcgacgcgagactcgcgggatgcgtgttccacgaaaggaatacgcgcggatcgccaccaacgtttatttgaggaaaacgtcggaaaaactcggaaaagacgcgatctacgaactttttagtgaaaggttgctgggagttgtatttacgcacggggaaggtattagcaccccacacgttaccgtcccaagggacggcagcccttaa

SEQ ID NO: 53167 - DNA, 405 bp, Glycine max
  Peptide Sequence Number=SeqID_144852
atgggtgaagtagaggaggtgcaaaagcatatgaaggccgacatggaggccatgaaagagcaaatggccacaatgatggaggctatgatgagcatgaagaagataatggaagccaatgcgattgcagttgccgctaccagcgttgttgctaaggtgaacccgatgcccctatctgccctcaaccaaatgaatcatccaaccttagctatggtagactttgagccttgcctcggatatgccactgaagggcaagcagttggtggtataccgctgcaaaacactttggagggccctcagtatcacccacaaccacacccctcacattccacagcggttaaaaaccctcatgctatggcagaaatgaggaaagttggatcatctagaggaaaggctatgggccattga

SEQ ID NO: 53168 - DNA, 444 bp, Glycine max
  Peptide Sequence Number=SeqID_144853
atgagcaaaggccagtgtggtcatttgcaccctttctggagatgtcaacatcttccggtcgagactttttcaagtctcacaagttatctagaactacgtaggtctgagttcctcattgtaggatacgtaggaagacaaaaattggtcattctgcaccctttgtcatccagaggcggcgggcccgatgacacgcggagacaaaatttggtcatttcgcacccttttgccattcagacacagtcgtgtccgatggctcgcagagacaaaaattggtcattctacaccctttgtcatccagaggcggcgggcccgatgacacgcggagacaaaatttggtcattccgcacccctttgccattcagacacagtcgtgtccgatggctcgcagagacaaaaattggtcattctgcaccctttatcatccagaggcggcgggcccgatga

SEQ ID NO: 53169 - DNA, 524 bp, Glycine max
  Peptide Sequence Number=SeqID_144854
aggctactacttcaccttcctctagtgaaagggatgaagaaaaatgggaagaatctagtgaagaaatttacccccaagaagaaggacaaccattagtggttaaagagaagtgtaaggaggtaagtgtctcctccaagagtttagctaagaaggaaactcattttacaataaagacaaacattaaagaaattttccctcttagacaacctccacattttctcttttgtaaaaagacacttgttagcactgccacaccttttgggcttgaggttaaatccttgtgctttgttggtgcccaaaatagtgatcaaggggttcccaaggaccctaagagaataaagatcattcttgattggcccactccaccaagtataagggaaatctggggctgccatgacttaacaaacttttacaaaaggtgtcaagggaaggagccagagtatgaagaacctcaggatttgaggtcaaatcctttccaaggtggaagggatgatgcaatcctaccccccaagggtattggatag

SEQ ID NO: 53170 - DNA, 335 bp, Glycine max
  Peptide Sequence Number=SeqID_144855
agattcaacattcaatttcgagcgtctcgatatgttaccagcttcaatcagacatccgactaaaaggttattgtcgtttgttttggctcggagagctcaactttcaatttcgagcgtctcgtatattacgggactcaatcagacatccgagtaaaaagttattgtcgtttgaattggctgagagattcaacattcaatttcgagcgtctcgatatgttacgggactcaatcagacattgagtaaaaagtcatggtcgtttgtattgcctcagagtttcaacattcaatttcgagcgtctcgttatattacgggactcaatcagacatccgagtaa

SEQ ID NO: 53171 - DNA, 238 bp, Glycine max
  Peptide Sequence Number=SeqID_144856
atgagtgacatagaggaggcgcaagagcagatgaaggttgacatggaggccatgaaagagaaaatgaccataatggtggaagccatgatgagtatgagaagtatgatggaggtcaatacggctacagttgttgccgcaagtaccgccacaaaattggacccgactcacccacctggcttcaatcaattaaataatctagtctcagatatggtagggcaaggaggtgaagcattaggaa

SEQ ID NO: 53172 - DNA, 785 bp, Glycine max
  Peptide Sequence Number=SeqID_144857
ttgacagcagcatcgacctagccttggtgaaggagttctatgccaacctctacaatcccgaggggccttgcccaaaacaagtcaaaatccgaggccacttgataaaaattgatgaagacagcctaaacaccttcctagagatacctgtggtattggctgagggagaatccttacccgcctactccagctactgcaggatgcccactgatataagagagattgaggctgctttgtgtatacccggccgagggtttgttttaaatgctgaaggccatcctgggaagatcctcaagaaagatctgacaactcttgctcaggtttggagtgttctctcatactccatcctggctccgacttcccacacctcggatttgactttagatagagctaggttaatttttggtctagtctctcagctggacatgaatgtaggagctctcatctttggccagatcacatctatggcccagtctaactcctctagacttgggttccctactcttatcacagaagaactgttggaacctgcggatctggcagttactattagaggggctaggagagcgagggcaaggccagctgaggctccttccatatctacagctcctcctccagcacataccttagcagcttcttctaccctatcttctacaaactttcaatgtcttgaagccatgcttcgaagcatacatcaggggcatattattttattacaaagtttacagctggtagcacctccagactctatcccttctattgaacagtttaatgaatgggtagcctaa

SEQ ID NO: 53173 - DNA, 453 bp, Glycine max
  Peptide Sequence Number=SeqID_144858
gttgggaacatgagttggcggtcggtgaggggaagccgtaagaggaagatggatttcgaactggacctcaaccgtgatccgccgctggttcgagaagaggaggaggaggaggaggagggggggccctcaaggcatcagcagcaccaccaccaccaacaagaacctcaaactcccattgtcgatgtcgacgccattgacgacgatgttgttgaaagctcgcctaggtctttcgctcaggctaagagcaatgctgatgagaggaggagagttcgcaggaggacgactattgttgatttggactcagaagatgggaccggaggagttcctcaaaaccaaacaatcatcaatggcgatctttatgtaaatttggccaacaacagcagttctgcgaatgctgtgattgaggacaatatgatggaattttgcattagatggtctggttatgtcatgtga

SEQ ID NO: 53174 - DNA, 324 bp, Glycine max
  Peptide Sequence Number=SeqID_144859
atggatgctttgttggtgattgggaactgtgttggttcagctaatcaccgaagcttcattgccttcctcatttctgcagtgttgagtacaatctatgtctctatcatgtcagcatatgcaggcttgcgtacatggccaccgttgaaatactcccttgggcacataaacggggttagtagcagcgaactggcatggagaatcataaatgaaatcgttgttgcattcctgagatctgccctgcttctttcctccaggggactcattcttgcttatcttttcattgcaaaaaaagatcacttcaacgtgtatatacttgtggactag

SEQ ID NO: 53175 - DNA, 217 bp, Glycine max
  Peptide Sequence Number=SeqID_144860
atggtaatcaattacatcatgtggccaaagaaagagaaggttcaaacagctgatgactcgcttagcgaggcagatccgctcagcgagtggcatccgcttagcgaggcatccaactcgcttagtggatggaaaaccctagaagaggataagccagagatgtgctcacccagtgcccagccagcccgtctagcgaggacgttgtctcttctcgcgctca

SEQ ID NO: 53176 - DNA, 369 bp, Glycine max
  Peptide Sequence Number=SeqID_144861
atggtacccctgcctgtaaaaagttcagagaacagtgagaaaggaattgaggaaaaagaccctaaagctcctcaagaaaatcctaaaatgctagctacaccaaatgaacgaaatgctggatcgaagacaatagttactagaaacttgtcatacagtgtggaacgagctgatttggaaaatcttttcaaagagtgtggagaaattgttgatgttcgtctacatacggatgctgaagggaggtttagaggctttggacatgttgagtttgcaacagcagaagcagcacaaaacaactgccaaaggcttttcatggatagttgtacctttgcaagcaacagttccatttacttatcaaggataaaattttaa

SEQ ID NO: 53177 - DNA, 1386 bp, Glycine max
  Peptide Sequence Number=SeqID_144862
atggcatttaaatcactaatgaccatgaatgttgtcccttcagacatggtctccccagccatgaactcattacagggctactatggacttaaggggaccccaagtccctcagaagatggtccattccccagaaacttacctatgtctgaccgacctctgagtcatcaccggaaatccagaagtttggtcaatgtaattttggaagaaattatggaaaaatcagatgatgcactggctgcagaaaccagggaagttggctccaataaatggaatgacaaacttggcctgagacatcagaaatctgtagctgactttattaggataccggagttgcttttgagggaggataatagcagcagtggtgttcttccatcaagaacaggaaagggcttagctctgagacagaaagcagctaaccgaaccacagcaacaactgattctgaaccaattggtttgaatcctgcggcgttgggcatgggggatgcttctctaattgatggttcatccggggtcaggaaatcatcaagcacttcttgtttacaggatcaagataacagtggctcctcgtccatttggccaaccaaaatgtggaatttgaaaccagacttacaagccctctcaactgcagccattggaaaaccaatctttgatggctttcccaagccaataactggttatggaatcattagccgctacaccagtgggcccacaacattcacacgtaggcaacgagaagctgccgctgttgctgaagagctattccaacatactgaagaagttgttgatgatgccgagggttttccaggcgggcattgtgacacatcagtgttgactacctatgctgatcatgttgcagtacttggagggttatcctcccatggaaagaaggttcagaaattcgagaggcctgctactgagattgaaggcttggttgctgccacaagattaagttctttgatcgcatgttcattggacactggcgatcggagacttatatccacttttgtcgagaggtggaataaggaagcgagcagtttccatcttccagtaagagaggtcaccatcaccctcgatgacgtggcctctttgctccatcttcccattataggagcattccacagcttcgacactcttcatgttgacaaagcgatgttgatgttagtgaagttacttaaagttgctgaagatgaagctagagctgagacaagtggaagctacgcatggggagttgtcgccctaatgcacatgtatgataatttgaatgatgcttgcaagagcggcggtaaacaacttgctggatatatcacactgttacaggtcaccacgtgtatgccactaaacatctacaaaggccttatcagcattgacgtattgaaagtggcttga

SEQ ID NO: 53178 - DNA, 4290 bp, Glycine max
  Peptide Sequence Number=SeqID_144863
atgagtatctgcagcaagatgataaatgaagaaacaagccaatctattttggttagtggagaaagtggagctggtaaaactgaaagtacaaagatgcttatgcattatcttgcctttttgggagggagagcagcaactgaagggaggtctgtggagcaacaagttctggagtccaatcctgttttagaagcatttggaaatgcaaagactgttaggaacaacaattcaagtcgttttggtaagtttgtggagattcagtttgatcaaaaggggagaatttcaggagctgctatcagaacatatttgctcgaacgatctcgtgtctgtcaagtttctgatcctgagagaaattatcattgcttttatatgctttgtgctgcaccacaagagacatttacagcaaaaggtttgatgcacttccacctgcggtggaatccagcagccgtcattggtggcattggtgcctctttgaacaagagcaaggatagggatgttgataagtataaattgggaagtccaagaacatttcattaccttaatcaatcaaattgcattgagctggacgggttggatgattctaaggagtaccttgcaactaagagagctatggaggttgttggaatcaattctgatgagcaggatgcgatatttcgaatagtagctgcagtacttcacttaggaaacattgaatttgttaagggagaggaagatgaaacggattcctccaagcccaaggatgaaaaatcccatttccatcttaaaatcgcagctgaacttttgatgtgtgatgagcagtcccttgaagactctttctgcaaacgtgttatggtgactcgtggtgacaccataacaaaatcacttgatccaaatgctgcaactctcagtagagatgcattggctaaaatagtttattcaaggctttttgactggattgtggacaagactaacaactctattgggcaagatccagattcaaataacttgattggggttctagatatttatggatttgagagtttcaagacaaacagctttgaacaattttgtatcaatttgacaaatgagaaattacagcaacatttcaaccagcatgtcttcaaaatggagcaagaggaatatacaaaggaagagatcgattggagttatattgagttcgttgataatcaagatgttcttgatctcatagagaagaaacccggtggcattattgctctcctggatgaggcctgtatgtttccaagatcaacacatgaaacatttgctgaaaagctatatcaaacctttaaagacaataaacgcttcagcaaaccaaagttgtctcgtactgacttcaccatcaaccattatgctggtgatgtcacttatcaaactgattttttccttgataaaaataaagactacgttgttccagaacatgctgctctactcagtgcttcgaagtgctcctttgtttcagggctgttcccacctttacccgaggaaactacaaaatcaaccaagttctcttctatagccgctcagtttaagctacaactgcaatctttgcttgaaacactaaatgctaccgagccacactacattcgttgtgtaaagccaaataatcttctgaagcctgggatattcgagaacaataatgtgttgcagcagcttcgatgtggaggagtaatggaggcaattcggataagttgtgctggatatcccactagaaagaactttgatgaatttgttcagcggtttactatcctagaacctaagattctgaaagcatgccctgatgagatgactgcttgcaagaggcttctagatcgagcaaaccttaaagattatcagattggaaaaaccaaagtgtttctgagagcaggtcaaatggcagaattagatgcatgccgtgctgaggtcttgggaagatctgcaaacattattcagagaaaaatccgcacatttatttgtcgaaaacactatattttattgcagttgtctgccatagaacttcaaagggttgctagaggacatcttgcacaacatcagtatgaatgcatgaggagggaagctgcttctttgaaaattcagaaagacttccgcatgcatatgtccagaaatgcttacaaaactatttatgcctcagctgtttatattcaaaccggtatgcgagggatggctgctagaaatgaccttaggttcaggaaacggacacaagcttcaattgttattcaggatcactacagaggttattcagcacgtatttatttccaaagactaaagaaatcagcaattgcagcacagtgttcctggaggagaacattggcacgtagagaacttcgaaagcttaaaatgttaacattggtgcttgtgcgtgaagtgcgcattgagagatctcgatctgttaatctcaattctggaagttcttctcttgataattctgttcatcctaattctgcacagtctatgaaccctaactctcaagctcaagttaatttgaccactcagaccacttgtgaggataattctgcgaacgattacataggaaatcgattttcagtggtcatggtggtgggaatttttgccagaacaactatagtggtcatggttcaggccatggtggtggtagaggtaggtttgttgatgctagaggagaattatgatcctactcttcctccacctgcttcacttgctcctactcaatctacttcagctccaagtgctcagacttctcagcaagttcagcatgctcaacccattcattcatcatcttctcctactcagactcagactcagacttggtatcctgattctggtgcttcccatcatgcagccaaggaatccaaggcacttgaagctgccaaaaataatctggaaatgcaagtcaaagaattaacttcgtgtctagaaacagagaagagaatgagggaagccaagacacaggaaaataaaaaactacagcatgctttgcaagagatgcaacttcagctccaagaaatcgaggaagccaaaaaacaggaaaatgaaaaactaaagcatgctttgcaagagaaggagcttcagttccaagaaattgaggaagccaataaacaggaaaatgaaaaactacagcatgctttgcaagagaaggagcttcagttccaagaaattgaggaagccaataaacaggaaaatgaaaaactacagcatgctttgcaagagatggagcgtcaattccaagaaattgaggaagccaagaaacaggaaaatgaaaaactaaagcatgctttgcaagagaaggagcttcagttccaagaaatagaggaagccaaaaaacaggaaaatgaaaaactacagcttgctttgcaagagatggagcttcagttccaagaaactaaggcagcgttaattcaggaacgagaggctgccaagaaagtagatgagcaaactccaactacacaggagaattctgttaatgttgttgacagtgaattgatcaataagcttactacagaaaatgaacaactcaaggaactagttaattcgttggaaaagaaatctatacaggagtttcctgttaatgttactgacaatgagttgatcaataaactttcttcagaaaatgaacatcttaaggaactgattaattcactggaaaagaaaactatacaggagtttcctgttaatgttactgacaatgaggtgagcagtaagctcattacagaaaatgaacatcttaaggttttcataatatcaaaaataactcctgaagctttgcaggatcaggttaattcattggaaagaaaaattgatgaagctgagaggaaatatgaagaaagtaacagggttagtgacgagcgcatgaatcaaattatagagacagaatcaaagatgattgagataaagacaaatgtgcagaggcttgaagaaaaactatctgatatggaaactgaaaaccaagttttgcggcagcaagccttgttgagttcatcatccaggagaatgtcaggaaagcttgcacctgctacaactccgcctttggaaaatggtcatcaggcatcacagggttctgtccctgcgaaaacatttggtgcagaggataaagagagtgtggatgctcttttcaaatgtgtgacaaaagatcttgggttctctgaaggaaaacctgttgcagcatttaccctttacaattgtctgctacattggaaatcttttgaagcagaaaaaacaagcatatttgatcatcttatacagctgattggttctgagttagaggttactttctgtttactcaaaccatttttccatttgtttgttagaggcaaaagttaa

SEQ ID NO: 53179 - DNA, 504 bp, Glycine max
  Peptide Sequence Number=SeqID_144864
atgtctcataggctagtctgcatgccaacaactgattcttataatgcaaatataacttcaaacgaggctggtcaactcagttttgtagtggggtcccatgtttgggttgaggaccctgatttagcttggatagatggagaaattcaggaatctaacaatgaagagatcacggttatgtacgaatcaggctcgaaggttgtgagcaaatcagctaacatgtatcccaaagatccagagttcccacctaatggtgtggaagatatgacaagattggcatatttgcatgaaccaggagtacttcaaaatttgcatcttcgatatgccatgaatgaaatttatacatacacaggaaatatattgatagccgtgaacccttttcaaaggttacctcatttgagtgcaactagtaccatggcaaagtataaaggggcggcttttggtgagcagagcccacatccttttgcaattgcaagttctgcatataggtatcttgttgttgcttaa

SEQ ID NO: 53180 - DNA, 807 bp, Glycine max
  Peptide Sequence Number=SeqID_144865
atgcctagggatagcaattcggggtggcttgtcccgccttcagctcgccaaaaacaggtttgggtcaggctgcctgctataagctatgctagtgtgaaaattccatattatgcaatacataattatttgttctttgttagcactgttgaaatttctaatccgcagtatctaaagtatgtctccaacagtcacacacaaatgtcctcttctctgaaacgctgcacatcctacaccaaatacgagatcagaaagcgaaaccctgaaccaaaatcatgtgccctattggtaatcgacgtgcaaaaccacttctcatccatggccaccccaatcctccataacctcaacaccaccatctccctctgccgccgcgcctccatccccgtcatcttcactcgccactgccacaagtcaccctccgacgccggcatgctggaggagtggtggtccggggacctcatcgtcgacggcacggcggaggccgagctcctggaggctctggaccggaaaagcagcgaccttgtggtggagaagagcacctacagcgcgttcaggagcactggcttggaagagaagttggtggagatgggtgtgaaggaggtcatagtgacaggtgtcatgaccaacctgtgctgcgaaacgacgtcgcgtgaggcgttcgtgagagggtttagggttttcttctccgcggacgccactgccacctctgacgtggagcttcacgaggccgctttgaagaacttggcttatggttttgcttacttggttgattgccagaggcttcaacatgccctctctggtgccaagtga

SEQ ID NO: 53181 - DNA, 1677 bp, Glycine max
  Peptide Sequence Number=SeqID_144866
atgaccggtaaaagtccaattactcaacggacagcgagacatggctcacacaaactgtgcaaatttgatttatcggatctagaatggacaaatatgattccagagtgtccaacataccacccatcagagcatgagtttgagcatcctttagtttatctgcagaagattgctcatgaggcttctaaatatggtatatgcaaaattgtttctccaattgcagcctctaacccagctgcttttgtcttaatgaaagagaaaaaaaatttcaagtttgaaacaaatgtacagcctcttcgtctttctaaatggaatgaaaaggatataataaccttttctatgagaggcagaaaatatacatatcatgattttgaggttcttgcaaacaaggccttttttagtagatttcacagttctagagaccttccctcttcttatgtggaaaaggaattctggcatgagatggctcaaggagaaaaaggaacagttgagtacggagtcaatgtcgaaggtagtgccttttcatgtgatcctaatgacaggcttggaacaagcaaatggaatttgaagaatttttcacagcttccacaatccctgatacgtttagttgacagggaaattcccggaataactgatcctatgctttacattgggatgctgttcagtatgtttgcgtggcatgttgaagatcattatttgtacagcataaattatcatcactcaggtgcaaataaaacttggtatggcgtgcctggctatgcagcatcacaatttgaaaagacggtcttacaacatgtgtattgcaataagatcataacaaaacatggagaggatggagctttcaagtttctagcacaaaaaacaaccatgttcccaccaaatgtcatgttacaacatgatgtggcagtttacaaggctgtacaaaagccaggagagtttatcatcacctttcctagagcatatcatgctggatttagccatggttttaactgtggagaagcagtaaactttgcaaatggagattggtttccacttggggctgcagctagcaggcgttatacacatctcaaaatgatgcctttaattccatatgaggaacttctttgtaaagaggcaatgttggttttcaagtcctcaagagtcagaagttccaagaacaaacctgaagacacaacatcttatcaagctattatgctgcctttcatgcatcttatgcaatcttataagacctccctcttgcgactgaacagttcaagaaagttgcatagttcttcaaatacaacagacattgcaccacagacttgtttatgtgggagagattatactattttcaaaaggaatgacattttcgcactggaagaagctgcaaaaagttttcaacagggaaaagaatgtgttgacaaattctctctatcaagtatattctcctgtaacataaatgattgcatcaaagttcctgagaataatccttggcagagagaaaaaagtgtaagaggtactagttttctaggggttgcatctaaaccgaaaacaaaagtggctgacagcaccaagcacagtgatgaaaggaataagtcaacaacgaagcattggagaaacaatgggcttccatccgtgaggggtgccgaaaggccaggaatcatttataacttgagaaaacgcaaatcaaaattgatttag

SEQ ID NO: 53182 - DNA, 132 bp, Glycine max
  Peptide Sequence Number=SeqID_144867
atgaagggtgagcatgagcctacccagctcgatttgagtagagctatcaaaatggaccaggtcgatccattaggtttgacccaccttataaacgagctagtccaacctaactcactttttgtggagacttga

SEQ ID NO: 53183 - DNA, 828 bp, Glycine max
  Peptide Sequence Number=SeqID_144868
atggtgcctgtattcacctttattatggcgctgccactggggatagagaaagtgaacatgaaaaagctgagtgctaaggccaaggtgttgggaacttttgtgtgtattggtggagctttgatgttgatcctttataaaggagtgcccttaatcaaccaacaaccagagcacatagcagacaaaggcacaataagatcatcagcctccaagttaaagaaatggatcataggttcactgcttctaactgcaggatgcttcttgtggtcttcatggtttcttatacaagcaagcattagcaaaaagtatccatgtcaatactctagcactgccattttgtccttttttgcttccattcaatcagcaatattgactttggtcatcgatagaagtaacgccaaatggattctcaaaggaaagttagagataatgactgttgtatatgctgggctggtaggatcaggcttgtgctatgtggcaatgtcatggtgtgtgaaacaaaggggtccagtttttacttcagcatttacccctcttctacagatgttcgtggctgtgcttgatttctctatattacatgaggaaatttatcttggaagtgttgcaggatcagtcttggttatatctggcacgtatattctactttggggtaaaagtaaagaggaagaacaatgtgccgtgaagggtactcaagaaagtcaagaagatgaagaatgtaagaataatttggaggccagttcaaatgtaccttctaagctaaggcctaatgaggaacaaggattctctgaattacaagtgaagcagctagctattacagtaactagaagttga

SEQ ID NO: 53184 - DNA, 146 bp, Glycine max
  Peptide Sequence Number=SeqID_144869
aagatggtatatatttggcatactcagatttcaatcaattcttgctaggagattcatcttgtctaaaagagctaaatcagtggtttgctaagcaactggacacacttagaaggatgaataggttcccttttgagcgcaagccgtag

SEQ ID NO: 53185 - DNA, 1338 bp, Glycine max
  Peptide Sequence Number=SeqID_144870
atggatactcttaatgatttactagctgcaagtgatcttatatcactacattgtgctttaacaaatgaaacaatgcagattattaatgctgaatgtcttcaacatgtaaaacctggagcttttattgtaaatacgggcagtagtcaacttttggatgattgtgctgtaaagcagctcttgattgatggaaccttagctggatgtgctttggatggggcagaagggcctcaatggatggaagcatgggtggttggagaatatggtaggggtttgaagcctcctacttatcatgagatagatgggaaagggaggccacctataaatcttcttgttaatagtgcaagtgggactgttttcttgaattctattgatactaatgatataataaaggatgtcaagcaaatgtttgagttattggacagcttggtggaggtgaaggagatgcctaacgtgttgatacttcctcgaagtgcagattacagtgaagaggtttggatggaaataagggagaaagctatatctatattgcaaacattcttcattgatggaattataccaaagaatgccatgtcagatgtggaagaagagagtgaggttgacaatgaaagcgaacaatctgatcagcaatacaacggaaatgctctccagattattgttagagagcaaacagatgatgttcatagtacctctgctagatctgaaggaaggcgcagcaggtcaggtaaaaaggccaaaaaaaggcatacccgtcacaagtcccaacaaaaacatgaagatccttctgcactggagaaagaaggcacatctcagagagatgatactgctatgagtggcactgaccaagctttgagctctagctctgaagactcaagaaatagaaaaactccaatagaatctatgcaagaacccactggtgctcaagtcataaagtcaagtctgagacttagtggaaactgtactgaactattgaaagatggatatattattgctctgtatgcaagagactgttctgcacttcatgtctcaaggcaaagggttaaaggtggaggttggatcatggattccatgtcaaatgtgtcaaaaagagaccctgctgcacagttcctcatcatcttcagaagcaaggacacaattggattgcgatcccttgctgctggtggaaaattattgcagatcaatagaagaatggagtttgtatttgctagtcatagttttgatgtttgggagaactggactctagaaggttccttacaggaatgcagactggctgttttggatgtacgcgttgagattttggcaactgtaggcgaagatggagttactcgttggcttgaatag

SEQ ID NO: 53186 - DNA, 969 bp, Glycine max
  Peptide Sequence Number=SeqID_144871
atggctcttgagtcagctcctgcttcagctgacatcagaggagttcacactcatggtggaggctatgttcagtataatatctatggaaacctctttgaggtctctaggaagtatgtccctcctattcgccctgtgggaagaggagcatatggaattgtttgtgctgctgtaaatgcagagacgcatgaagaagttgccattaagaaggttggcaatgcatttgacaacagaatagatgccaaaaggaccctacgagaaattaaacttcttcggcacatggaacatgaaaatttgttacgaggactcaaatatgtacactcagcaaatgttctgcaccgtgatctaaagcctagcaacttgctactgaatgccaactgtgatcttaagattgcagactttggtctcgctagaactacatctgagactgatttcatgactgagtatgtggttactcggtggtaccgagctccagagttacttcttaattgctcagaatatactgccgccattgatatttggtctgttggttgcatccttggtgaaatcataacaagacaacccctatttctggggaaagattatgttcatcagctcaggctgattacggagctcataggctcacctgatgacactagccttggatttctacgaagtgataatgctcgtagatatgtgagacagcttccacaatatccaaggcaacaatttgctgctagatttccaagtatgtctcctggtgctgttgatttgttagagaagatgcttgtctttgatccaaataggcgcatcacagttgaagaagctctgtgtcacccatacttggctcctcttcatgatattaatgaggaacctgcttgcgttagacctttcagttttgattttgagcaaccatctttcactgaagaagatatcaaggaactcatctggagagaatctgtgttattcaatcctgatccacctatttattga

SEQ ID NO: 53187 - DNA, 1446 bp, Glycine max
  Peptide Sequence Number=SeqID_144872
atggagttcttgtggaaaactctcatgaggatacacgtgattagaacattttttgctctccttttggttgcacttttaagttcagagggagtagagagcagaaaagccaaagttgtgaccacttccttagagtacaatgctataaactgcagagctcacagtgcttcattgacagattttggtggtgttggagatggaaaagcatccaacacaaaggcatttcagtctgcaataagtcaccttagtcagtatgcttctgaaggtggctctcagctctatgttcctgcaggaaaatggctcactggtagcttcagcctcactagtcacttcacactttatcttgacaaagatgctgttctccttgcttctcaggatataactgagtggcctgtgctcgaacccctcccatcatacggtagaggaagagacgcaccggcaggaagattcacaagcctcatatttggaacaaaccttactgatgttattgtcacaggtgaaaatggcaccatagatggtcagggtgagttttggtggcagcaatttcacaggaagaagttgaagtacactcgcccatacctgattgaattgatgttctcagacaacattcaaatctcaaatctaactctcctcaattccccatcatggaatgttcatcctgtttacagcagcaatattattgtgcaaggcatcaccatttttgctcctgtcacatctcctaacactgatggcatcaacccaggccagtatttcataatcaacttcaaattcttcaaatatagaataatgtatagcaagcaaagtggatgggatgagtacggcataaaatttgggtggcccaccaaacagctaatgataagaaggctaacatgcatttcaccatacagtgcaaccattgccttgggaagtgagatgtcaggtggaatccaagatgtgagagctgaggacatcacagcaatccaaacagaatcaggtgtcagaatcaagactgcagttgggagaggagggtatgtgaaggacatatatgtgaagagaatgaccttgcatactatgaaatgggcatttaagatgactggtgactataactcacatgctgatagtcactatgaccctaatgccttgcctgagataaaaaacatcaactatagagatgttgtggcagaaaatgtgaccatagctgctaggttccaaggaatctccaatgacccctttacaggaatctgcattgcaaatgtgacactaagaatggcagccaaggccaagaagcagccttggacctgcactgatattgaagggatgacgagcggggtgactcctccgccttgtggtttgttacctgatcaagggccagagaagattacagcatgtgatttcccagcagatagtctacccattgatatgttggagcttaagaaatgtactacaaccatgacatttgttggagtgtag

SEQ ID NO: 53188 - DNA, 537 bp, Glycine max
  Peptide Sequence Number=SeqID_144873
atgtcaatcaccacaggaatatgtcaagtagttgctgtttcgttgcttttgggatcactgagtgtgtattccttggaatgtgatgatgatcgctgcaaaacttggttgtgcaacagcactggtgcctgcacttgcaaccttcctgatccttccaccatcttaaatggtgatagaactttcctcgggggtacgttttgtgatgaagaaatgaccatgtgtgatgggacaaactccttctggtgtgaacatggggcaacttgtgaggagattgttcaaggagagaagtactcttgcaaatgtccccctggatttgctggggagcattgtgagcattctggagcatcttgtggtcagactttttgcttccataatgctgaatgcttggctgaagcaggtgatgtttgccagtgcccttctgaatggaaaggcagtgccgattgctctcttccaaccacaccaacaggttctactctcccttcttcctttcacaaattacaaccaagtttggatgctgttgaaatgaagagagttatatga

SEQ ID NO: 53189 - DNA, 810 bp, Glycine max
  Peptide Sequence Number=SeqID_144874
atggataaggattcgaatatcagaacctaccctgatatgggcgaacttgcgtttggaaagacgggaaggctaataatatcagggttaatatacacggagctcttcttggtttcggtagggttcttgattctcgaaggtgataacttgagtaacttatttcccactgtggagattcatacagctgacttagcaattggtgggaagaaactgtttgtgatattggttgcccttgtcttggacaacttgaggatactttcttacgtatctgcaagtagggtatttgcttctgctatcattattctgtcaatatcatggactgcaacatttgatggagttgggtttcatcaaaagggaactcttgttaattggaagggaaaccccacagctgttagcttatatgccttttgctattgtgcacatcctgtgttccccagtttgtacaattccatgagaaacaaacaccagttctctaatgtactacttgttagctttctcttaagcactgctggttatgcatccatggctataatttgttgcctaatgtttggtcccaaggttgaatcacaggtcacattaaacctgaaaataaataaagtaagcccgaaaatagcaatatgtactaccttggtcaatcccatatccaagtttgctttgatggtaacacctattaccaatgctttgaaagacttgcttccaaggacttacaggaatagagcgaccagaatcctgattagtactgtcttagtaatcagaactactactgttgcccttgttgttcctttctttgggtatctcatgtccctttcttga

SEQ ID NO: 53190 - DNA, 942 bp, Glycine max
  Peptide Sequence Number=SeqID_144875
atgccggttgacaacatgggagataatgttactgtctcgaccactcaacaccacattgcaatccccattgagaaattgaatgcatcacttgaagctgcaaaggaagaaaattctgtaaccgatgatgcctatgtggacaatgatgtccaaaaatctcaagagaaagatgaagaaactgaagagaagggagaatgtcgctactgtcaggaagaggacttagtttctaatatggaatcaccctgcaattgcaatggtagcgtcaaggaatggacaattcctggaaccaacactcaaattcgatcacctctggtgctggcagatcgtgctaccaagggcctcattgattcgatgaacaaagacttcagcttgagaaaccccactggtggtgtgatatttggcatgtcactcgtcatcgttgttttcactgggggtcgtacacaacctggaactaccaagcctgatgagggggaccgccatccatactctataatagagtgtgagcctaagcgggaagtcattttaccatctgtaatctacatacaaaagattttgcggcgaaggccatttcttatcaagaatcttgaaaatgtcatgcggaaattccttcagtccttggagcttttcgaggaaaatgagaggaaaaagttggcaatcttcacagcacttgctttttcccagaagctgtctggtctcccaccagaaactgtgttccaaccacttcttaaagataaccttgtggccaaagggctagttctgtcatttatgactgacttctttaaggagtatctgattgacaacagtcttgatgatcttatttcaattctaaaacggggtaaagtagaggagaatcttttggacattttcccccctacaaaaagatctaatgaagccttctctgagcatttcaccagttccaacagccttgatgatctcaacttgtga

SEQ ID NO: 53191 - DNA, 1188 bp, Glycine max
  Peptide Sequence Number=SeqID_144876
atggcttccctcatgagcaccatcctcaagcaaaggtcttgttcttcttcttcacatgctgggaggctgttgttctccacaacaacagcagccattgttgattccccttcacttgctcagagaatcagagatttgcctaaggaccttcctggaaccaacatcaagaagcatgtttctcaggggttgagaatagtgaaaacgcctagttcacaacatagtgaaaagattgaattcccactgagaaagctcattgggaggactccactggtttatcttaacaaagtcaccgaaggatgtggagcttatgttgctgtcaagcaagagatgatgcaacctactgccagcatcaaagacagaccagcatatgcaatgatcacagatgctgaggaaaagaatctgataactcctggaaagacaactttgatagagcctacatcaggcaatatgggtatcagcatggcatttatggccgccatgaagggatataagatggttttgaccatgccctcttacacaagcttggaaagaagggtgaccatgagagcgtttggagctgaattaatcctcactgatccagccaaaggaatgggaggaacagtaaagaaggcttatgaacttttggaaaacacaccaaatgctcacatgctgcaacaattttcaaaccctgccaatactcaggtgcattttgaaacaacaggtcctgagatatgggaggatacaaatggacaagttgacatatttgttatgggaataggtagtggaggcacagtctctggggttggacaatatcttaaatccaaaaatcctaatgttaagatatatggagtggagccaagtgaaagcaatgtgctgaatggtggtaaacctggtcctcatcatataactggcaatggggttggattcaaaccagacatattggacctggatgttatggaaaaagttcttgaagttagcagcgaagatgcagttaacatggctagggtgttggcattgaaggaaggactcatggtagggatatcatctggagctaacacagttgcagcactcagattggctcagctgcctgagaacaaaggcaaacttattgtgactgttcatccaagcttcggtgaacgatacctatcatctgttctgttccaagagcttcgtcaagaagctgaaaacatgcagccagtagcagttgattaa

SEQ ID NO: 53192 - DNA, 1875 bp, Glycine max
  Peptide Sequence Number=SeqID_144877
atggatgaagataaaacccaacaacttcccagaagaatgaccaggtcttcagcttcatcgtctccatccacttcaaataacatagttgcagcaaaagtaactagccttgaacctctaacaatcaatgaccttttagttgggggagatcccatcagcctagatgacataatttctagctttcctggtagaagtagccagattcttgaagttgtgcgtcatttgggacctttgaattcaccaatgcttcctttgttcgtatatggaagttcttctaccggaaaaaccagtatcattcttcaattattcaggcatctcaacaggcctattgttttttctagttgtaggacatgttataaccagaacatcttgtttgaatctattctaaatcagctacttctccacagaaaaaatgctgccaatggttatttgaatgcaaaacgctgtgaaagaccatctgattttgtcaattttcttcgagaagcattgaccaatgttataagcaatctgaaggagaagtcagagaagttgatctcaaatgaaatgactcaagggaaaattggaaatatgatctacttggtatttgacaattttcagcttgttagggagtgggataagagttctactatattgcccttgctgtttaatctctatgatctgctaaatacgcctgaggtgggtttgatttttatcagcagtacttctccagataccttttactctaacatgggctatgttgagcctatccccatttactttcctgattacacagaagaagatattcgtcaaatattattgagaaaccaagtgaaccagaagctatattcctcatttctggatgtatctctgaaatctttctgtggaattactaagcagattgatgatttatctgctgccttaaagccactatatgaaaaatattgtgaacctttaagtgataagggaaagggagttgctcctaatcaagaaatgaagcgaaggctgcttgctcatatcaaccctcatattgcctcctctttgaatgagatatttaaggtttcatctctttcttcaactgaagttgagacccgtaaagaggaaaagtggaagggaaatcttaggagattggagcaatctaaagagcttgtcagtcttgattttcatatatctactagtgcaaagtatcttctgatttcagcattccttgcctccagaaacccagcaactcttgatgcttcactttttgattccaaaggtggttctgataatcggaaacgaaagaggaagccctctgagaaagcgcaggaacggaaggaaactttagaacaggaactactaatgaaaggacccggaactttcccattggagaggttgttagccatctttcaatgccttgtatcagttgcagaagaaccatccgacgaggaggaacaaaataatgatggattaggagttgaaggtggcaatggtggactgatgtctgacattcttttgcagctatccagtctctgcaattctaattttatatttaaaggaagaagctgtcccattgaaggctcaacccggtatcgatcaaccatatctgaagaccttgctttgaaggtgacatctttgtctcacctaacaccctcaaaattctttgttattgtttatgtaaggagattaaaatatacatcaacaaagaatgatgctttcaattttgttaagcaggttgcaaggagcttagagttcccattatcaaaagtgtatactacctctactatgccctactgttatcaacatgaaatggctggaatcccctatgaatgcttgaagcaaaaccaacggtatagaatggataattgtgaacatggcggttcatgggatggatggactgagcattttacaatggacaactga

SEQ ID NO: 53193 - DNA, 378 bp, Glycine max
  Peptide Sequence Number=SeqID_144878
atgacaacaatgtccggtcctcaccggagtacggcgagaccctggccggagcttgacgaatccgatgacgggtccggcgtggcgcttcatcatctcctgctggatctgcgagggatcgagcttggagatatcggaggaagggaaagggggttcgggtttcttgccccattctcgccacgcgtcgtcctcctcgtcgtcgaacacgtcgtccaactcgtcggggatgtgaaccttgcgctttccggcgagggcaaaatgggaatttgcggacgcgaggaggagaaggagaaggagagtggggactggttggaaggtcatgggggaagagaggatcaaatgaggaatgatgcactctcgctatcaactggcataccataa

SEQ ID NO: 53194 - DNA, 168 bp, Glycine max
  Peptide Sequence Number=SeqID_144879
atggctccaatagattccagaactttgatacaaccgctaaattgtcactgcatgcaaggtatgacatggtgcaaggggcatgcataccttttgtctcgtacaggcatggattggacaataaatcaccgtcgaagtttgggggtggaaaaagagatgtgggcccaatga

SEQ ID NO: 53195 - DNA, 2913 bp, Glycine max
  Peptide Sequence Number=SeqID_144880
atgggattaaacgtttattgtccccatattgatccaaagcagcactttctgggaactggggcttactatgaatgggtttattctggtggcattccatcgccaggagagacaccatttctttgttactttacatggcaaggtgcctctcactccactgatttgtgcgtcccagataaagataccggttgccaatttgccgattgggaaatcaaactaaatggattgtgtaggtactttggtgccggacctggggcctatttggcacgcacgcctcgttcgtgccaagttcccaaacacgctcgtctccgcacacacgacacgagcgagaaccaacctcgtgagacgcatctcgcatgcttcactcgctcgcacgctcgcacgccggacactttccggtccgcacttccgtttcctgatctcgatcctgccggattcctccccttcgccatcgatcacgccggatctccgcgccggtcgccgggaattgctgttcctgacggagctctgaagattccgtcgaggagaagagggatctgccggagaattcgtcatttacaacgtgttttcgatctggaagcttgtgaaattcctgaggacatggtacttgggattatggcaactgatatgcagaggcttgttggaaccagtgaggatgatgaagaaatgggaatggatgtgaaagatgaggatgatgaggatgatgattatgaggaaaatggaggtgaacaggggaatgcttcagtatcagggatggtagagattgatgatgggaatgggataggaactgccactggtgacaacaggtttcagcagcaccagcagtttcaagagcaagtaggcaccccgggtggaggtactcgaagatctaggccgctagaagagaaagagagaacaaagctaagagaaaggcgccgcagggccatcactgcaaggatcttggcagggcttcgcaggcatggcaactacaatctaagagttagggctgacataaatgatgtcattgctgctctagcaagggaagctggatgggtggttcttccagatggttctactttcccatcaagatctcagggtcaaaagccagctggtggtaattctacaattgtcacttcatcatcttcccttgcggcttcacaacagactccatctgcttctctcaggggagttgcttctggctataggagccctttagagtataatgcatgtcaaacaaaaggtgtttttatgcctactccgtctccttatgatctatcctcaagttcccggtctcaaacatctatggtgggggatggagaagcacaaagagacaatcgtcctctgattgctggttcaatggataatgctgatgataagcagattgctgacttgccccccagattaccagagcgtgatttggctggtaccccatatgttccagtttatgtgatgctatcgttgggggtgatcaatattaaatgtgagcttgttgatcccgatggtctactaaagcagctaagggtgttgaaatcagtacatgttgatggtgttatggtagactgttggtggggaatagtggaggcacatgctccacaagagtataattggaatggttacaagagactctttcaaatggtgcgagagcttaagcttaagctgcaggttgtaatttcatttcatgaatgtggaggcaattttggcgatgatgtttgtattccactaccgcattgggttgctgaaattggtcggagcaatcctgacatttttttcactgataaagagggaagacacaaccctgaatgtctttcttggggaatagataaggaacgagttttaagaggccgtactgctgtggaggtttactttgatttcatgagaagtttccgggtagagtttgatgaatactttgaggatgggtttatctccatgattgaaattggactgggtccatgtggagagttaagatacccatcttgtcctgtaaagcatggttggagatatcctggtgttggtgaattccagtgctatgatcagtatatgttgaaaagtcttaggaaagcagcagaagtaaggggccattctatttgggctagagggccagataatgctggtacctataattctcagccacatgaaacaggtttcttttgtgatgggggtgattatgatggcttctatggcaggttttttcttagctggtactctcaggttttagttgatcatggaaaccgggtactttctctggcaaaattagcttttgagggatcttgcattgctgcaaagactgcaagtcatgctgctgaattaactgctgggtattataacccatgcaatcgtgatggttatgctgcaattatgacaatgttaaagacaattggagtcagcttaaacattccttgtgttgacttgcacacatttaaccaacaacatgagggctttccagagacatttgcagatcctgagggaatagtctggcaattgttgaatgccgggtgggatgttgacctaccagttaccggtcagaatggatttccttgcctaaacagagttggctataacaaggttttggataatgccaagcccatgaatgatccagatggaaggctcttttcatcctttacttacctgaggcttagtccacttcttatggaacaacaaaactttgtagagtttgaacgatttgtcaagagaatgcatgtgttcgtgttcctcgggaacgttcctctgctacggaggctacctggctcgtctgtgcagaagatatccgaacttgtgattctcaaacactatgctgttggggttgagttaggtccaatctcatattttgatacccaagtcccacatcggcttaccatttgttgttcacgcatcaagcccaagctgaggttgttggctctgttagtgccgatgaagaaaatcatccggagttccacttga

SEQ ID NO: 53196 - DNA, 411 bp, Glycine max
  Peptide Sequence Number=SeqID_144881
atgtataataattttactgatgatccatacaccatagggtacatgtcatgcactgcacttgtggatgctggaatacccctaaaacatcttgctgtggcgatatgttgttctgtaacagatagtggctgtattatattggacccaaccaaagaggaagaggagaaaatgaaagcatacatcaatttagtttttccaaatacaattgtttcagtcctcccagagagatcatcgcaggtgggtagtgagcctatggcacatggaatcatgacatctgttacacagggtgctatgtcagtggatgattatcttcactgcctagatcgagggcgtgctgctagtgcaagattgtcggaatttgtgaggaagaacatagggccgaaatctacatgtgaggcatctaaagccgggtga

SEQ ID NO: 53197 - DNA, 972 bp, Glycine max
  Peptide Sequence Number=SeqID_144882
atggcgttatccgggtcttactatatgcagcaaagaggaatacctggatctggaggacaacctgagttacatatttcacctaatatgcgtccactgtctaatccaaatctaccatttcaatccagcattggtggtggtaccattggatccacattgccattggaatcttcagcaatttcggcccatggtgtcaatgtgggagctcctactggggcacctctaggggaacctgtcaaaaggaagagaggaaggcctaggaaatatggtaccgatggaagtgtgtcattggcattgactccaactccaacatcatctagccatcctggagccttgtcacaaagccagaaacggggcagagggcgccccccggggactgggaaaaaacagcaattggcttctcttggtgaattgatgtctggttcagctgggatgggattcactcctcatatcatcaacattgcaagtggagaaggacctagagttgtatgcattttgtcagccaatggtgctgtctctactgtcacacttcgtcagccatcaacttcaggcggcactgtcacatacgaggggcgcttcgagatagtgtgtctgtcaggctcttacttggtcactgaaaatggtggctcacgcaatcgaactggtggattgagtgtgtcccttgctagtcctgatggtcgtgtcattggcggcggagttggtggagtgcttattgcatcaagccctgttcaggtggtagttgggagctttctatggggaggatcaaagacaaagaacaagaaaaaggaatcctcagaaggtgcagaagttgctgtggagtcagatcatcagggagttcataatccagtttcactgaatagcatctcacaaaatcaaaaccttcctccaactcccccatctctaagtccttggtcaacatcacgtccgttggacatgcgtaattcccatgtggacattgatttaatgcgtgggtga

SEQ ID NO: 53198 - DNA, 1305 bp, Glycine max
  Peptide Sequence Number=SeqID_144883
atggattttggaggacaatattggaaggcaagactaaatattccaccacctgatacatgccataagacagaggatgtgacagcaactaaaggaaatgaatttgaggattactttttgaagcgcgagttgctaatgggaatatatgagaagggttttgaaaggccttctcctatccaagaagaatgcattccgattgctcttactggtagtgacattcttgctagggctaaaaatggaacaggcaaaacagctgccttttgtattcctgcattggaaaaaattgatcaggataatgatgttattcaagttgcaatattggtaccaacacgagaactggctttgcaaacatctcaagtgtgtaaagatctcggaaaacatttgaaaattcaagttatggttacaacaggtggtaccagcctgaaggatgatatcatgcgcttatatcaaccagttcatctgctagttggaactccgggaagaatattagatcttgcaaagaagggtgtttgcattctgaatgattgctctatgcttgttatggatgaggctgataagcttctctcccaagagttccaaccttcaatagagcagctgattcaatttcttcctggaaaccgtcaaatcctgatgttttctgctacatttcctgttactgtcaaggacttcaaagatcgatatcttcgtaagccatacatcgttaaccttatggatgagctaactctgaaaggtattacacaatattacgcatttctggaagagaggcagaaagtccactgcctaaatacacttttctctaagctgcaaataaatcagtcgatcatcttctgcaattccgtgaatcgggttgagctactcgccaagaaaatcacagaacttgggtattcatgtttctatattcatgcaaagatgttgcaagatcaccgaaatagagtgtttcatgacttctgcaatggtgcctgcagaaaccttgtttgtactgatcttttcactaggggaatagacatccaagcagtcaatgttgttattaattttgattttccaaagaactcagaaacttatctgcacagggttggtcgttcagggaggtttggacacctaggtttagcggtgaacttgatcacctatgaggatcgcttcaatttatataggattgaacaagaacttggcactgaaataaaacaaattccaccacacattgatcaggcaatatattgccgtgcacctaatgtttattactattgcactttattaatcgaagaaaaggttgatgcgaatgttgttctagcacttgtgaatgctttgtaa

SEQ ID NO: 53199 - DNA, 5592 bp, Glycine max
  Peptide Sequence Number=SeqID_144884
atggtgaacccaaatctcagaacagacccttccaccatttacaaccttatcaaatcctacgcactttccccctcaaccatcctcaaagcccataacctcttccaacaaatccaccgacccacgttgcccttttggaacatcatgatccgcggctggtccgtcagtgaccaacccaacgaagcaattcgcatgtacaacctcatgtatcgccagggcctgttgggtaacaacctcacatacctttttctcttcaaggcctgtgctcgagtccccgatgtttcttgcggctcaacgattcatgcccgcgttttgaaacttgggtttgagtcccatctctatgtttccaacgccttgattaacatgtatggctcttgtggtcatttgggtcttgctcagaaggtgtttgatgaaatgcctgagagggacttggtttcgtggaattcgttggtttgtgggtatggtcagtgcaagaggtttagggaggtgttgggtgtttttgaagcaatgcgggtggctggtgtgaagggcgatgctgtgactatggtgaaggttgttttggcatgcacttcgttgggtgagtggggtgttgctgatgccatggttgactacattgaggaaaataacgtggaaattgatgtttacttggggaatacactgattgatatgtatggacgccgtggtttggttcatctggctcgtggagtttttgatcagatgcaatggagaaatttggtttcttggaatgcaatgattatgggttatgggaaagcaggaaacttggttgctgctcgggagttgtttgatgctatgtcgcagagagatgtgatctcgtggactaatatgatcacaagttactctcaagcaggccagtttacggaggccttgaggcttttcaaggaaatgatggaatctaaggtgaagccggatgaaataacagttgccagtgtgctttctgcatgtgctcataccggttcacttgatgttggggaggctgctcatgactatatacagaaatatgatgtaaaagctgatatttatgttggaaatgccttgatagatatgtattgcaaatgtggtgtggttgagaaagcattggaggtgtttaaagagatgaggaagaaggactctgtgtcatggacttcgatcatttcaggccttgcggttaatggctttgcagattcagcacttgattatttttcacggatgttgagggaagttgtgcagccatctcatggagcctttgttggaattttgctagcctgtgcacatgccggattggttgataaaggattggaatattttgaaagtatggagaaggtttatggactgaaaccggaaatgaaacattatggatgtgttgtggatcttttgagtcgctctggcaatttacaaagggcatttgaattcataaaagagatgcctgtgactccagatgtggtaatatggaggatattgctgagcgcttctcaggttcatggaaatatacccttggctgagattgccacaaagaagcttcttgaactggatccttctaatagtggtaactatgtactttcatctaatacttatgcgggctccaatagatgggaagatgctgttaaaatgagagaactgatggagaagagtaatgtacagaaaccatcaggtagcagttgcatagaaacgcaaagtgtagttgagctttggaacttggaagacaacgccgattccttcaacgttttcgtcattattttatcaatcctcacactcttctttccagtgcgaaacgaaaccacgatggacaggctgagaaatatgagcatggatatggcttgtagtttgccgcagtcaagagtgttgcatggaggtctggggacgagttacagacacagatcagtaggtcagttaggctgctttgattttagagggagaggttttggttgtgcttcttttggggactcgagaagtgtttcaagactgcagaggagcaggatgaatgtttctgcttgttggaataattcaagagtggctactggcagggagtttaaagttttgaatacgaagagaagtttgtcttgtaagaagaataataatcttttcatggtgtctcgagtgatttggtcgaagtgccagggtaatgattctttagcctatgttaatggcaatggccggaatgttgattacgtggaaggttcaggtgaggatgtaggattggggcctgtttctagtgctgaactggatgcaactttggaagaagaagaagggcaagcggagaggaaagagggagggagtgaaataggattagaggaactgagtgtggatgaactgaaagaactattgcaaaaggccttaaaggagctagaagtagctcaaataaatagtaccatgtttgaggaaaaggttaaaaaaatatcagagactgccatttctttgcatgatgaagcagtcaattcttggaacaatgttaattctacccttggcaccatccaagaaatagcaaatgaagaacatacagccaaagaagttgtacaaaatgcaacaatggctctttcattagctgaggcaaggcttcaagtagccatagaatctttggaggctgcaaaagaagttcctgattcagcacaaggttctaatgagaacagtggtgataaggacacggtggatgaggagcaagctcttttggttgctaaagaagatatcaaggaatgccaggctaatttagccaattgtgaggcagagctgaggcatttgcaagatagaaaggaggagttgcagaaggaagtgagcaaattgcaagaaattgctgaaaaggctcagctgaatgcggtgaaagctgaagaggatgttacaaacataatgcttttggcagagcaagctgtcgcctttgaacttgaggctacaaaacttgtaaatgatgcagagattgccctacagcgagcagataagtctaattctaattcaaatgctgataccatagaatctacacaagcacaagatgttgttgtggctgttcctgaagaggagaaagtggttcaaggtttttctggtgatgttgaaagagacagagatttggcaattgacgacgaatctgtgcttgccaatttatcacctgaaacactatctgataaaaccagccaagttttggaagacaaaacacagtctgattatttaagtgataatgagaatgctgtgcaaacaaaaaagcaggaaatacagaaagatttgaccagagatagttcactagctcccaaggcattattgaaaaagtcttctcgattcttttctgcatcattcttctcttctgctgaagatgggactgagttcacacccgcatcagtcttccagagctttgtattatctgtacagaagcagttgcccaagctgatatttgggttattgttaatgggagcaggggttgccttctattctaatagagtggagaggaatgctcagctgcttacacaggcagatgttattatgaccagtgttgaagaagtttcctctagtgcaaagcctctgtttagacaacttcagaaactccccaagaaaatcaagaaaatcattgcatcattacctcatcaagaggtgaacgaggaagaagcctccctctttgacatcctctggttattacttgcaagtgttatatttgtgccaatatttcaaaaaatccctggaggcagtcctgttcttggctacttggctgccggtatcttgattgggccttatggtctctctatcattcgtcacgttcatgggacaaaagcagtagctgaatttggagttgtttttcttctattcaatattggcctggagctctctgttgaaaggcttagttcaatgaagaaatatgtctttggattaggctctgcacaggtgttggcaactgctgtagctgtcggcttgatggctcattatatttgcggccaagctggtcccgctgctattgtcattgggaatggcctagcattatcatccactgctgttgttctgcaggagagaggcgagagcacttcacggcatggccgagctactttttctgtgttactttttcaggatctggctgtcgtggtcttgctaatactcatacctcttatttctcctaattcttccaaaggaggggttggttttcaagctattgctgaagcacttggactggctgctgttaaggcagcagttgccatcactgctataattgcagggggacgtttggcaggactttccatggcattgggagcatttttggctggtttactactggcagaaactgaattttccttacaggttgaatctgatattgctccttatcgtggccttcttttggggctcttctttatgacggttggaatgtcaattgatccaaaacttcttgtttcaaacttcccagtcattacgggcacactaggactcttaatatgtggcaagactatcttggtttgtttgataggtagaatgtttgggatttcactcatttctgccatcagagttggtctacttcttgctcctggtggggagtttgcatttgtggcttttggtgaagctgttaatcagggcataatgtcttcccagctgtcatctttgctgtttcttgttgtgggcatttcaatggccatcacaccatggctagctgcaggaggccagctgattgcttcccgctttgagcagaatgatgttagaagtttattacctgtagaaagtgagacagatgatctgcaagatcatataattatttgtggatttggacgagttggccagatcattgcccaacttctttcagagcgtcttattccatttgtcgcactagatgtaagaagtgatagagtggcagttgggcgtgctttggatctccctgtgtactttggagatgctggtagtagagaggtcctacataaggttggggctgaaagggcatgtgctgcagcaataactcttgatacgcctggtgcaaattatagaacagtttgggctttaagcaagtacttcccaaatgtgaagacttttgttcgtgcccatgacgttgatcatggattgaatttagaaaaggctggagctactgctgttgtcccagagaccttggaaccaagtcttcaactagcagctgctgtgctttctcaggctaaactccctacgtcggagattgcagctactataaatgaattcagatctcgacatctggctgagctcactgagtggggagagtcaaacctgcgacctctcaccccctcccttcttcctttatcactagatcaaccttataactcctatatcactattatatggtggatagcagctacaaggtccatatggaagctcagaaatgatgtgatctttcataatcagcctttccacatttctaagttggtggataacactaacttcctcacttggtcctggctgaggggggttatgggggtttcttgtagggcatctgtgttatgtagttttggactcatgttcctggagacattatctccttatcttgtagtaccactgctgtgtgaagcaagtggaagttctcttggttatggatttaatagaattatgaacaaacccaaatctccatccccagattcattagatgagacccctgtctccgaagggacactagcaatatga

SEQ ID NO: 53200 - DNA, 225 bp, Glycine max
  Peptide Sequence Number=SeqID_144885
gttgtaacggttggagttgttgggggttctgaccttataaagatatcagagcaacttggcagcacagttaccaatgagtatgattacgtattttctgagaatggtcttgtggctcacaaggaaggaaagctcattggaactcagcaaagcagacaacaacaacaacaacaacaacgccttatcccactaggtggggtcggctacatggatcaacttccgccataa

SEQ ID NO: 53201 - DNA, 1395 bp, Glycine max
  Peptide Sequence Number=SeqID_144886
atggcagaggcaaaactaaggtatgctgttgttactggagcaaacaaagggataggatttgagactgtaaaagagctggcctcaaatggagtcaaggtggtgctcacagcaagagatgagaaaaaaggccatgaagcctttgagagattgaaagagtgtggtttctctgatttggttatttttcaccagcttgatgtcactgaatctgctagtatttcttcactagtagagtttgttaagaccaattttgggaagcttgatatattggtgaacaatgcaggaatcagtggtgccaatctggatgaagtggaaggatcaacatttaaatgggaggaactgactcaaaccaatgagatgactgaaaagtgcctaacaacaaactactatggtgcaaagaaaacaactgaggcatttcttacccttctgcagttatccaattcacctaggattgttaatgtttcctcccaagcagggttgttaaagaacatatcaaacgaatgggctaaaggggtgcttgatgatgctgataatcttacagaagagagaatagacgaggtactcaaagagtttatcaaagacttcaaagaaggttcattagcaaccaaagggtggccaaccttcttgtctgcatatattgtctcaaaagcagccatgaattcatacacaaggattctagccaagaagcaccaaaacatgtgcattaacagtgtgtgccctggttttgtcaaaacagacataaacaaaaacactggcatcttaaccgttgaccaaggtgctgctagtgttgtgaaattggcactgttgcctgatggttccccttcgggcctcttctatattaggcaagaattggcgaacaaagggataggattagagactgttaaagttttggactcaaatgtaatcaaggtggtgctcacagccagatatgaggacaaaggccatgaagccattgagagactgaaagagtgtggtctttctaatttggtgatttatcaccagcttgatgtcactgactctgctagtattgcttcattagttgactttgttaagagccagtttgggaaacttgatatcttggaatcagtgatcagtgatgtcaatctggatgaagtgaacatagcgaacgaatgggcaaaaggggtgcttgatgatgttgaaaatcttacagaagagagaatagccctgaattcttacacaaggtttctagctaagaagcaccctaacatgtgcattaatagtgtgtgccctggttttgtcaaaacagacataaatagaaacactggcatctattccattgaccaaggtgctgctaatgttgtgaaatttgcattgttgcctgatggttccccttctggcctcttctatataggcaagaattgtcagacttctgaatga

SEQ ID NO: 53202 - DNA, 726 bp, Glycine max
  Peptide Sequence Number=SeqID_144887
atgctccaaccatatgggatcagcataggcttaaaggagcactcaaacccgatgacccccaaggcctacactccgaagagtccgtcagggcctctccctcctgattcagcgatagcaacatctctagcggttcccggaaattctttcaattattcatccgactgctccgatagaattcccaaacgtcagagagacggagaagagattgaaacctccacttatgctgtcttcatgcgattcctttttctccctccacgaataatatctcgcaaatcccaacggtggaagcacagctctgggtttctgcgggaaagaaaaaggctacaatgcgaagggtgtttctctcagttcagacatgatatcaaaattcccaacggtgagaatgctcggaattgtgttgcgaacatgacactcaaatttcacaacgatccaacggtgaacgggttcaagatcatcgtttttctgagactggtagcaataatggatgagatgcaaatgaggagtgcagggagtaaggtggtattcaggagtttactttcactgaaatacccagagattgttattgttccatctgcaattactcgagctagagttccagcttctgttgacagcaatcccccattgaaggttccacgtgaaagccttgatgacatcatttttgacagaagtgaaaggttcactcctggattaattgagcaaattttggtgagggttaccgataagtga

SEQ ID NO: 53203 - DNA, 465 bp, Glycine max
  Peptide Sequence Number=SeqID_144888
atggaacaagacaaccttaacaacaacaacaattgtgatgaggaaacctttgtgtgtgactcaagagaaacaaaaagaagcattgctgagagaaggggtttcaattccaatgctgcaagaatcaacacagcactgtttcgcactgcaacttcaacaacaaacccttcaccttccctggccgctcgatcacctcgtctcaccatcccccctggcattagtccaaccgacttgcttgactctcccatcatgcttccaaattctcaggccatatctcccaccactggctctttcttcatgctgccacctctcagccatgaaggatcaatgctcacaactgaacaagggaatgtggatgtgtcaaccgcatctgatgtcgatgcctctttcaaattcaagcctcgtggacattttgatcctaatcatttgcctccttactctgcttctctaaatcagttgttgatttga

SEQ ID NO: 53204 - DNA, 1788 bp, Glycine max
  Peptide Sequence Number=SeqID_144889
atggccttcgtcaccactgctgaagtgtgtgatgcgaacccccagttaattttgagtggggagcttcgtgcccttcagccagtttttcagatttacggtcgtcgacaggtcttctctggacctatagttaccttgaaggtgtttgaagacaatgttttggttcgtgagttccttgaagagaaaggcaatggaagagtgcttgttgttgatggaggcgcgagtttacgctgtgctatattgggtggcaaccctgtggtacaagctcaaaacaatggatgggcaggtattgttgtgaatggatgtataagagatgtggatgagatcaatggttgtgatattggagtgagagccctagcttcccatcccatgaaagccaataaaaaaggcatgggagagaagcatgttcctgtaaatattgctgggacaaggatcagtgatggggattggctctatgcagacactgatggaattctgatctctcgaacagagctgtctggtggttttggcgatgtggtattgaatatgaggcaatgtgctgcttcttcttactacttggacatggacaagtcttctcacagggttgccaaattgccatccattgggaatgccacgacactatcttattctcatgcagatgacacgtgtggtgccacactctgcaacaatactgcacctacttgtgtctattcttccctcccaaagtcctaccaccgtgctgaggagaccaaagacagtgttgaatcagcagtgcaacgtgctccttctcaaagcactcatggcagcgcactcttgctgaagaaactgggactttgcttcctgagtgttgcgtatgtgtgcatggttatgattttggctctcattctggctgctgtggtgggtgttgctttggttcggttgtgggtggaggaacccgtgtctgtcaaggaaaatctgcattttgattacactgaagctcaccctacggctgtgtttttattcaatggagttagaagctttaagggtcacctcaagaaaaagcaaataagtgtcccagttggccactcgtttttcgcttctttggttcttgtgatgcctgaatctgactttaatagggagcttggcgtctttcagttgactgcagaactcatatctgtgaatggaaatgtgatagcaaaatctagccagccatgcatgttgcggtttagaagctcgccaattcgactagcccggacctttatgatgggtgtgcctctggtgcttggaatctcaggggagactcagaatattaatgtagaaatactgaggcacaaagaagactatagaagaagcaatgctattagagtaactctgcatccaagagcaggaacatcttctcttccacagctatatgaagccgatattgtgataaaatcccatttgccttggaccaaagaattggttcgaaattggaagtggacattttatgtttgggtgtccttgtatgtctacattgtactacttgtgtctctcctatgttgttataggccactcgtctttctggtgacaccagagtatttcaatgatcatagggtgagtgaacttacaagagaagaaccaggacaattaggagatgaaagtgaggtttctgagttgttgaggaaatggagaagaagcagaagtaagagaaaaaccgtcctggcacatggtggtgtgccagaaaccattgttggatcatcagcatccagcattagcatgactgctagagaagatgtaaccagtgtggttatggaggatgaggttgaggactctgaatcagtgtgcataggttag

SEQ ID NO: 53205 - DNA, 435 bp, Glycine max
  Peptide Sequence Number=SeqID_144890
atggtcatacaagttgagtgcctcaaaagttcgacctttgaggcacaaaccattcatgagggtggtgagggtaaaagggtcaaccccaaaaccccttttgatgattttccccatgacggagaaggcgaggcccatttggcccaagtgggtgaaggagttgatgaagatgctgagagtgacgagggagggtttagggagaagcttgttgagggaaacgatggagggtggagggtggaggtggagcatgctgtggaaggaggaaacggcgtcgtcgaagctgaggggtttggggaggggtttgcgcggggagtgggagtagaagcgggtgaagaggaggagaaaaggaagggaggggaaaagggtggtggggttcagcattatggtggagaaggagatatgggactcatagagtttgtgagtgttgcgtggaagtga

SEQ ID NO: 53206 - DNA, 141 bp, Glycine max
  Peptide Sequence Number=SeqID_144891
atgaaaatgctaagcggaccttctaagctaagcttagcgagtatgatgataatcgcgcttagcacgagattcgcgctaagcgcacctttgagcttcttcgtagatcttcttcgcgctaagcttggaatgactgctaagtaa

SEQ ID NO: 53207 - DNA, 1257 bp, Glycine max
  Peptide Sequence Number=SeqID_144892
atgtcagatattgaagccgggcttggattgaagaggaaacacttaatagctatctctcttttggttggagatgatcatgatataaatggtgttcgagggattgggcttgatactgcacttcattttgttaaagcttttagtgaagatgatatattgaatagattacatgagatcggcaaagggaatacttcacaaattcccatctgcattaaagttgaggacaatgtggatgggaactccccaaatagaaaactatctcattgttcattctgtgggcatccaggcagcaaaaaagatcatatgaaatttccctgtgaatattgtgtcacaaaggatgatgaaggttgccagagaaaaccagaggattttaaatgtgattgcttctcctgtgatatgaataggaaacataaggagaaaaaaagactagaaaatcagcatacaattttttttcacaagattgcagaggagccaaactttcccaaggatgaaatcattgatatgtatttatgcaatgacaatggttatttttcagcaagtgatagcccacacattgtatggggaaaccccaatattgagatgctgattaattttttaaacttccatcagcattgggaaccagcctacgttcgacgaatgatgtttcctatgatttccaccatctttttgagagatatgacaacaactacagtagagactacgttgtttgggcaatatgagtttgattccgtagaacgtgtcaaaatgagatatggatatcaattttttgtggtcaaatggaaacgtgcaggggttaacatttcctgtaaagttccattgaaggaatcaagtgtgcaacaggatgatgctatagagcttgatgaaatggtggatctactggatgactttgatgctccagagattcatggagacgatggatgcagttttctgcttacagatgaaaatatggaccttgtaggtgctgcttttccagcagaagtcaaaaggttttggcaagagcaggaactgaaaagaataaagaactcaacatcaagatctcaagaaaatgaaaaatcaccatcaccaaactcaagaagtattcagctaaacattacagagttctacccatcaacgaaagttaaacatcgtcaatcaaaacaaggagaagagtcatccaagaatgctgatagtcaaggcaatgggggctcaaaaatgaaaaggaaaatgtcaagtcctgataagattccaaaatccgtgaggcgccgccttttgtttgattag

SEQ ID NO: 53208 - DNA, 429 bp, Glycine max
  Peptide Sequence Number=SeqID_144893
atggaagaatccaagacctcattctctctcttcaagaagccactttcatggcaaaacacttgttaccttcttcgtccaccaacaacaacccttaccccacccatctccaccaaatccactccttcctccgccacggacggcgacccgatgcaggtcgagatcgtcgccgatgatgaagagaccacttcaaagtgcacaattgacaaggttgaggagaaaatgaggcactgcttcatcaagaacaagcgccccaaacggccccttttgccctccgccgcagcggtggcggaggagaagcgggttgtttccgatgatgggtttgtggggagggtcagtgacagtgactatgatccatatgctatgaggatggttggttttgttgatggccatggcttgtggttgttttggcatggaagatttgggatgtag

SEQ ID NO: 53209 - DNA, 1869 bp, Glycine max
  Peptide Sequence Number=SeqID_144894
atggccattcaaaactgcttttccaagaaaccaaaccaccaactcacaagactctaccttctctccttcacaacttttctttgcaccattacttacctcctcggcctctggcaccacgcgccgccctcactcccctccctcgtctccaccaccgcccactccaattgcccaaattccatccccacactcaatttctccgccacccacttctcccccgacccccaagctcctgcgcgtgacttctacgcgcctccgtgcgatccctccctctccgagtacaccccatgcgaggacgtgcagcgctcgttaaagttcccgcgcgagaacctcatctaccgggagcggcactgcccgccggccgaggagttgctccgctgccgggtcccggcgcctttcgggtaccgcgtgccgctgcggtggccggagagccgcgacgccgcgtggttcgcgaacgtgccgcacaaggagctgaccgtggagaagaagaaccagaactgggtccggttcgagggggaccagttcaggttccccggtggtgggaccatgtttccacgtggcgccggcgcgtacatcgacgatatcggaaaactcatcaaccttgaagatgggtccatcagaaccgccctagacactggctgtggggtagcaagttggggggcatatcttctgtcacgtgacattatagcagtgtcatttgcaccaagagatacccatgaagctcaagttcaatttgctcttgaacgaggagttcctggattgattggagttcttgcctcaattaggcttccttacccttcaagatcctttgacatggcccattgctctcgttgtctcattccctggggccagaatgaggggatttatttgaatgaagttgatcgagtgctacgtcccggcgggtattggattctatcagggccaccaataaattgggagaaccactggaaaggttgggagaggactcgtgagaatctgaaagaggaacaggatggaattgagaaagtggcaaaaagcctatgctggaagaaattggtgcaaaaaggtgaccttgcaatatggcagaagcccaccaatcatattcattgcaaaatcacgcgaaaggtctacaagaatagacccttttgtgaggcaaaggatccagacacagcatggtacactaaaatggatacctgcttgacaccactgccagaggtgaatgacatcagagaagttagcgggggtgaattgtcaaactggcccgagagactaacatcagttccaccaaggattagtagtggaagtttgaagggaatcacagctgagatgtttaaagaaaacaatgagttatggaagaagagagtagcatactacaagaccctggactatcagcttgcggagcgtgggagataccgtaatctgcttgacatgaatgcttacttgggaggctttgcagctgcactgattgatgatcctgtgtgggtcatgaacactgtccctgttgaggctgaggtcaatacacttggtgccatatatgaacgtggattgattggaacctatatgaactggtgtgaagccatgtccacttacccgcgaacttatgacttcatgcatggtgactcagtttttagcctctaccagaacaggtgtaaaatggaggacattcttcttgagatggatcgaattttgagaccacaaggtagtgtcatcttgcgtgatgatgtggatgtgttgttgaaggtgaagagtttcacagatgcaatgcaatgggattcaagaattgcagaccatgaaaaggggccccaccagagagaaaagatattggttgcagtcaagcagtattggactgcaccatctcctgaccaaaaattaacacagaaagctctaaattga

SEQ ID NO: 53210 - DNA, 1503 bp, Glycine max
  Peptide Sequence Number=SeqID_144895
atggggttcataagatctgtgttgtctggctccattttgcttgttggttttgtatttgcaggaagctgtgaatccatagccatgaatgtgatgcgaaggttgaaaagcattgcttctgggaggacttccatttcatcagatcctgtaatgagggcacaagctttgtgtgagattgacatgattggaggggattgtaccacaaaaagagcaaagtttgatcaagacaccgaaggaaaggtcaatgaggaaacatatcctaatgagaggtgcggaaaagatcaggaacaccatgtagattccaatgttccttcagtgcctagaactgagaagtcaggttatgatcagcttccaaaagaattaaatgaaatgaagattggagatgacaaaggcaaaaacaacaatgagaaggatatggaagcaactattgtgagtggtaatggaacagaaaccggtgaaattattacaactgctattggaggtcgagacggacaaccaaagcggacaatctcatacatagcagaacgtgtggttggcactggttcttttggtgttgtttatcaggctaagtgccttgaaactggtgaagcagttgcaataaaaaaagtgttgcaagacaagagatataagaatagggaactgcaggttatgcgaatgcttgaccatactaatgttctcagactaaaacactgtttctattcaactgctgagaaagatgatttgtaccttaacctagttttggagtatgtacctgaaactgtctacagagtttcaaagcactatgtcagaatgcaccaacatatgcctatcattaatgtgcaactgtatacataccagatatgtcggggtttaaattatttgcatcatgtgattggagtctgccatcgggacatcaaaccccagaatctattggttaatccccagactcatcagttaaaagtatgtgattttgggagtgcaaagatgttggtgcctggcgaacccaacatatcgtatatatgctcgcggtattatagagctccagaacttatatttggtgcaacagaatacacaactgctattgatatttggtctgctggttgtgtgttggctgagcttcttctaggacatccaatgtttcccggagagagtggggttgatcaattggtagagatcattaagatcttgggaacaccaaccagagaagaaataaagtgcatgaatccaaattacaccgaatttaagtttcctcagataaaagcacacccatggcataaggtttttcacaagaagatgccttcagaagcagtggatctagtgtcaaggatgcttcagtattcaccgaatctacgatgcactgctttggaagcatgtgcacaccctttctttgatgatctgcgagaaccaaatgcatgcttgccaaatgggcgaccattgcctccattgttcaacttcactgctcaagaactggcggatgcacccgatgagttgcgtaggcgtctcattcctgagcatgcaagaagttga

SEQ ID NO: 53211 - DNA, 297 bp, Glycine max
  Peptide Sequence Number=SeqID_144896
atggaaaaagtccaaggtgagatgcagcagaaagggtacggacaccaagatcggaagaagtgcaagccacatgaaaaatccaagcaaccgtcgcttccccgtcctcgccaccgcgacgtgaagagcggtccttccgtcttctcgagacttggagaagatatcacgaggggcgacgttgatgttcagtttcgcctcttccaagaagcctttcttcaagatgtcttcaagtgtttccattcctctttggctgttttgaagtttctgatttggcccagtgccttcccacacgagagttga

SEQ ID NO: 53212 - DNA, 161 bp, Glycine max
  Peptide Sequence Number=SeqID_144897
atggcagaagaagatgcactttctcttgacaacaatgaaggtggtgtatgtgctgagtacaccgatgtcggtgtctatggaagacgaaaatctggatcaagcaaggaagcgtacgaaatgagagaacgacgattacatttgtcgtggacacattctgaacc

SEQ ID NO: 53213 - DNA, 480 bp, Glycine max
  Peptide Sequence Number=SeqID_144898
atggggaaggcagctcatttaaacatgctgcagatcagcagctggcacggattctatactttaattgattcaattttttatattaaaaaaatatcttggtcaaatttggtacatgctaagaatttattaatcttgttaactaggttgaagaaaaactggatggtggacaagggaaaacttcagttaggcgcttcttttcaagattttgtacaccaatatttttggaggcaatcttttattttaacattccttgctgagtggggtgaccgtagccagatagcgacaattgcactggcaacccacaaaaatgcaattggagtagcagttggggccactataggacacaccatctgtacctctctggctgtagtgggaggaagcatgctggcatctaagatttcccaacgctcagtagccactgttggtggcttgctcttcctcggattttctgtatcttcatatttctacccgcctctatga

SEQ ID NO: 53214 - DNA, 483 bp, Glycine max
  Peptide Sequence Number=SeqID_144899
atgcatttgaagcaagaaacagcaaacttgatgaagaagattgagcttcttgaagcttcaaaacggttcaacatctctttcttttctatccatcttcgcaaattagttatgttcactgttaggtttcactcacaacaaaaagaatatattgcattgtactattcatcccttaggaagctcttgggagaaggtttggggtcatgctctttagaagaactgcaacagatagaacaacagttggaaaggagtgtaagcagtgttcgtgcaagaaagaatcaggtttacaaggaacaaattgatcaactaaaagagaaggaaagagccctatatgctgaaaatgctaggctgtgtgagcagtatggtggtatccagccacagccagcaacaaaggatccgaaagaaattcaaccctatgcagaaagcagtccaagttcagaagtggagactgaattgttcattggactactcaggtctagctattga

SEQ ID NO: 53215 - DNA, 477 bp, Glycine max
  Peptide Sequence Number=SeqID_144900
atggctgatccttccaccatttcctcaactgtgagacttttttatgagcaaaagatgcgggaaaggaataatcgtggtcaggcaaaacctaagtcaagagttgaggcaagaagagctgagttaagagctaaggcaaaagctattttagagaagcctcggattcttcttgttgctgctttcggaagtgtttgtgcagctatagtgaaggtagttctcacaaaatcagctttgtgttttattgatgaacaaatacttcctcagaatgtaactgtatatcgtcatgagaaagtatggaatatttggaaaaagctaggtgatcctctgcttcagattgcgggagagttgtgtgatgatcttctgacatcgatcgtgctagcatgggactacaagaagccactttttgatttgatcatagtttcattgagcagtgtgtttatgtctcctcctagggtcttgcttgtgcacctctatacttag

SEQ ID NO: 53216 - DNA, 462 bp, Glycine max
  Peptide Sequence Number=SeqID_144901
atgggatacctgcgaaaacactttgatgctcaaattagaatcatagaatgtttgtggagcggaggactcactcctacaaccaacaattttcaggttcaggagatgtcaaggaagttgcaccctctgcgagcttggcataataaaccagatatcatgcccatcaccattgatcatcgtcggtactgctacattccatggggttttacgcctcacaggcaactagagtggttcaaagacatccgtttttatctagacatggaagtgtctcatgatgctcaagaattcatagtgaccctagtgaggtttgatgcgagaggtaatgtcctaagttggagattcgagttagtacgtcccgtgcatgtcactaaagaccaaggagatcacaccgacatgacacccgaggagggggaagagtattacgagctgccacaagacttagagccttcatttgaggaggattga

SEQ ID NO: 53217 - DNA, 921 bp, Glycine max
  Peptide Sequence Number=SeqID_144902
atgtttaaaccccacacttgtgggagccatgcgttggactgcattttatatggcactataaggcccagcagttgtgaaacacccagctggctgaatatctctagtaattccaggttggttgtccagccaaatacatctagagctcatacatttgcggaagaattcctagcatgtggtggcatagaaactcttcttgttctgctccagagggaagctaaagctggagatagtggtgttctggaatcattgtcaatgaatcctgaatctcaaaaaactgagattgctggtggtaatgaaatgataaaagaaagtcagaaggatgaagggttaaaggagaaaagcgaagccatcatacaagacaatgaccaaggttctatatctgttgatagtggtagtagccctgatcctagttctgatgttaacagtgacaggatatttgaaataacttctgccaagaatttgggaggcataagtctatccattagtgcagacagtgctagaaaaaatgtttacaatgctgataaaagtgatggcattgttgttgggatcataggtctcttaggtgctttagtagcttcgggacatctgacatttggttcccgtgctggtcctgatacaacaagcaaccttttgggtgttggactccatgacaaaggtggtactatgtttgaagacaaggtttctcttctactttatgctttacagaaggcatttcaagcagcacccaacaggctaatgactaacaatgtttacacagctttgttggctgcctcgatcaatgcctcttcttcagaggatgggctaaacttctatgattctggtcatcgctttgagcattcacaacttttattggtgcttttgcattcccttccctttgcacctaggtcactacagagcagagcgctacaggtattagcctaa

SEQ ID NO: 53218 - DNA, 384 bp, Glycine max
  Peptide Sequence Number=SeqID_144903
atggatagtgtgcctctcatagccatcactggtcaagttccgctgaaaatgataggcattggtcctgttctcatggatattcatgaaatcgaatggaagcatgaagaaattgagcagaagcagaaaagagttccgatgacgctaccaaatctgacacatctgaaggggcatttttggctggtgccacagctgtccaacatggcaaaaatcatcaagatagtgccacgggacaatgattctgatattggagtgtttgagcgcttgatggatatctatggagcaaccgcccgagtaggcaaagacattggtaatcccaccaccatggcgttggagagcttgaatgagcatgtcagcaccattttcgggcttgctggtgtgaactga

SEQ ID NO: 53219 - DNA, 1812 bp, Glycine max
  Peptide Sequence Number=SeqID_144904
atgaaaatgctgaaaaaaccaataaaatgcatcaagaaaaagaaaacagaaggatgctttgtttggaatctgggaaaaatggggttgttttctgggatatttctggggatggtactgggcatagcattgatggctgcgtggcaacgcatgatgacgtaccgtagcgccaagagaattgcaaaggaatatttgctagtaacatctgacactgttatcactgttatgagttacaagtttatcagtcgtatgtctgtatcctatgcctgtgggctgtggacttcagcatggagtccggatcctagattctatagattaaactacagccctggtgaggttctcatctgttattgtgattacttagctttctacagaaatgatttgacacatcctcctattattccagttaatctggtgaaatggctaaacaagcagctgtccaaactttggccatttgtggcagatgcagcaacattggtgattagagaatctgttgagccactgttggaagagtacagaccaactggaatttcttcattgaagttcagcaagctgtcccttggaaatgttgctccaaaaattgaaggtattcgcgttcagagtcttaacaaaggtcaaatcataatggacattgatttccgttggggtggtgatcccaatattgttttggctgttgaagcacttgttgcatcaatccctattcagttgaaggatctccaggttttcaccattatccgtgttatattccaacttgctgatgagattccctgcatttctgctgttgtcgttgccctacttgctgagccaaagcctagaattgattacactttgaaggctgttggtggaagtttgacggcactgcctggaatttcagatatgattgatgatatggtgaactcaatcgttaccgatacgctccaatggcctcataggattgttgttcctcttgggggcatacctgttgatactagtgaactggagcttaaaccccagggaacgcttagagtgactgtaattaaagcgaatgacctaaagaatatggaaatgattgggaagtctgatccttatgcagtgttgtatattcgaccactgtttaaggttaaaacaaaggttattgataacaacttgaatcctgtttggaatgaggtgtttgacttgattgcagaggacaaggagacccagtcactcattgtcgaggtttttgataaagacattgggcaagataagcgattgggaatagtaaaattaccacttaatgacatggaaccagaaaccgaaaaggagtttgaattgaggatgctgtcatcacttgatacactgaaagtgaaagacaagaaggatcgaggaaccataacaatgaagatcttttatcaccaatttaacaaggaagaacagttagttgcactagaagcagagaaaaatatactagaagaaaggaagaaacttaaagaagagggagttataggaactacaatggatgcgctagatggagcagcatcggcagttgggtccggtgttggaatggttggtactggtgttgctactggtgctggacttgtggggactggaattggtgcaggagctggatttgttgggactggaattggtactggagccgggtttgttggcagcggcatcggtgctggagttggttttgtcggcagcggtcttggtgctgttggtagtggactgagcagagcaggaaagttcatgggaaggacaatcacaggccaaggtagttccagaaggagtggttcaaatactcctgtcaatgtggaggagactggtggtggtgcaaaaccgctgcagcagtaa

SEQ ID NO: 53220 - DNA, 2436 bp, Glycine max
  Peptide Sequence Number=SeqID_144905
atgagagaacgtgagagagagcagcccagagagagagagaaacatagagtgagtgagagacccagcgagagagggagacttagagagaaacagaagggcaggggtccagggggggagagagagagaggacgagaccggaagagatcccttccgatagctaaggagagtcacaggggtagaagggctgagaaaaggcgcgagcggtcgagaactactgtcacaaaaagagggcgatggaggaatgtgattcgtaaggaagaactgcatggtgggcacggagctcggaataacgaccttgttgagaacgaaaagtggactacggtggtaagtagaaggtccttgaaggcttcgcagcatctctcgtcgacgggaggacaaccggagttagggggcagggacactcgttacgaacgcaactggaggaatcaggccgatattacgtcctactatttcacacatttccccgacgaagcaaatgaggagctgttatggtggcatttcaaaaaatggggagatgtccgtgaagtatacatcgccaagagactcaataaggagggtaggaggtacggctttgtacgctataaggatgttcgggatgcaagaggattggaactaagactggacaatatagtcattaacggctgtaagcttttcgccaaccttccgaggtttgaaagatcacgtcggaaaacagagttgcaggaatataaatatgctggggggaagaagacgaccgaggggagcaaggtcggtgtgacgaatactgatcatcctcggaagtcatatgtggacgcagtggttaaaggggggtgtctaggacccacgaaggaagatgaggttagaaaaccaatcattcagatcaaacctccagaaagtgggggagtttggtgtgaaggaacttggacgggaaagctgaagaagatgacggagattgaaacgttagaggaccgcatcgcgtgggaactaggatacaatgtcggcactaagttcctaggtgacgacatggtccttctgcatggtttgaccgacgaccaggcccgttccattatcaaatcggagatggaaagaggagattccctcttctacgaaatgaagaagtggtcaccgtcatctagacctactaacagggttgtgtggcttcaattgtggggcttcccgatacaggtatgggggatgcaaagcttcaggacggccatggctgaaataggtgacgttatcgagcccgatgatgacacggaggatcgccggcgtcttgaccgggcccgtgttctggtgcggacgccgttaccgccaccgataaggtctgacatcatcgtctgcgtggggaagctcgagtacaaggtctgcatcgtagaagaagttggtccagaaggtggaatgaccaagagaagctcctcgccgtcggagggatggtccgatatgataacgtcggaggacgacggggatggtggcgacgtggtggacgataccgacaccaatttttctttctcaccggagctatccaatcggaacgcttttccagcgggtaacctatggacacaccgtcagaccgatggtcgcagcatcgacgggggacttacgggtaatatccagcctaacgtaaaccttcagcaaaagtcaaaaacatccgcagaggctatggtagaccctactactggtaaagacagcttaggagaaggccctacagtcactcaaaaggaggaagtttacactaaaagagatactgccaataacaatcaacagaatgactataggcacagacatcacccacaaggaaaatattcgaacggagaagggaaagacccagaagagcaggctagtattggggaagaagagataaccgcaatacaatatccttatcccttgcctctggagcaaaatgggccaaattactcaaagggcccattagaggttaaagatgggtgcaataaggagtattccgtctcagctgaccatttgggaatgaatgaaggacagcatcataaggggggtggattaagtaataacacaggcccattattgacagaggaagggtgtcacaaggagaagcctagacacgaagcccaacctttaaaagtttgctcagacaagttctgtaaagtatattctcggcaaaagaccagttctctttctagggaccgaatccctcatatggaggctcaagaaccttcaccccctcatcgcagcttctcttcagcagaaccaaatgacactcagacaaggaatcagaagcagaaccctgtaccttcagaagggagattaaaaagtgaaattcaatgcagtgacgagatgatgcttgaggcccaacagctatgtaccttgggaaaggaattaggcatggaaacagatttagacgttctccacaaatatgcttctatggagcgtagagatagagaagaagccagaaagatggggaataggatatggcctcaatga

SEQ ID NO: 53221 - DNA, 1156 bp, Glycine max
  Peptide Sequence Number=SeqID_144906
atggctcacctgctccccttcctcgtcctcactctcctcgccgccaccgcctccgcccacaacatcaccgacattctcgccgccaaccccgactacagcgacttcaacgacttcctctcccaaaccggcctcgccggcgacatcaacacccgccagaccatcaccgtcctcgtcctcaacaacgccgccttctccgccgtcgccgcgaaacaccccctctccgtcgtcaagaacctcctcagcctccatatcctcctcgactacttcgacaacacaaagctccaccagatcaccaacgggaccactctttccaccactctctaccaaaccacaggtaatgccaacggcaacgtcggctccgtcaacatcaccgacctcaaaggcggcaaggtcggcttcggctccgcggctcccggctccaaactcgactcctcctacatcaaatccgtcaaaagtatcccctacaacatctccgtcatcgaaatcagcgcgccgataatggcgccggggatcctcgcggctcctcctccgtcagccgacgttaacataacggcgctaatcgaaaaagccggatgcaaaacgttcgcctcacttatctcctctaacggactcattaaaacgtttcaggcaacggcggataaaggtttgactattttcgctcctaacgatgaagcgtttaaggcgaaaggagtacctgatttgagcaagctcacgaacgctgaagtggtttcgctcttacagtatcacgcagccgctaagtaccttcctgttggatctttgaaaacaacgaaggattccattaatactctcgcttccaatggcgccggaaagttcgatttgaccgtttccgtcgccggagattccctcacgttacacaccggtgttgattcgtcgaggattgcggacaccattctggattcctctccgctttcgatttattcagtcgacagcgttcttcttccgcaggaactgttcgcgaagtcgccgtctcccgctccggcgccggaatcggtttcttctcctactcctgcaccgtcaccagtggcggaagcgccttcgccgtttcccgcgtcgcctccggctcccgcgggagagagtcccgctggtgctccggcggaagcgccatcatcagaagctgagcggagtagttccgccg

SEQ ID NO: 53222 - DNA, 1137 bp, Glycine max
  Peptide Sequence Number=SeqID_144907
atggcggcggcatggcaccatgttggggcagttttctataaagtgtcagtgtatgatggtggcattgcagagagaacccacgacagagaaggttccaagttctcttgcgtagttgcatatgatgctcctgctactgcacgacttcttgctcagacagcgacttctacaccggcggtgcttcttcaccggcaaccttttccggttccggcgactgccatctccattggttgcacacgtgtggatggcatggcggtcttcggggatcacaacgggtattgttcactcgtgaaaaaagcaaaaagatacatcaaggatgcctggagggagtctggcactagaaacaaatgtcgtagatatggtcggatgcaccaccacacgccgaaacagtggggcactcaaatgttgtttgacgtgcaaagggagggcgtgtcatcaaagctttggcagcggttgccaacaaaggagaaaatcgctggaaagggggacagtgagcaaaaaaaggagagaagtccactggaatgtggaaataggacgccagaagtaggacgacaagcagagtggttcacaggggataatagctgccagtgttcatggggacagacccaattggttggattgctagggctgaaaaattctgaggtacaagaaattccttcgttccataagctacaatatgcattcatgagcatggagggtgctgcgacacattggttctacatttggagccaaaacaatccagattcagattgggagtcatttttcacagctttgatcaaaagattcggagatcgccatggtaaccacatctttgaaagattgagtatcttgaagcaagaaaagccaactaagacaaaaacccacatcaaaaaatgggagacttccacaaagttcttgaaagggaggaccgacatttcaaagcggaaacacatgttgcgcaagatattgaatgaaaaagttgattcccatgcctctcaacaagacaaaaatagcatggagggaagtgggtcagaattcagtgaagcaaaggctagttcttgggcaagaaaggaggaactacccaactttgatagaaacatagaagggggaactgatttgagttttgagtgtgacaatgacccattgcagttcttgaaataa

SEQ ID NO: 53223 - DNA, 1476 bp, Glycine max
  Peptide Sequence Number=SeqID_144908
atggaagaggcgaaagtggaaactccgatgacaacgtggagagacaattgttcgcagagtttgagccctagagcgcgcattgtctccgttgcctccaacatcgcttcccagcctcttcacaaccccgaccctcaagtttggggcgttctcactgccgtctcctacaatgcccgcaaaaggcaccagggaattaacattttattaactgctaatgagcactgcattggtcgattggtagaggatgtgcgtttccagattgattcaaattccgttagtgcaaatcattgccgaatatacaggatgaaagttactaatgaaaatatggagaatgccacatcaatattcttgaaagatgcaagcacaaatggaacttaccttaactgggagagattgaaaaagaatggcgctgctgtgaaagtttgccatggcgatattatatcatttgctgctcctccgcagcatgatctggcatttgcttttgtatttcgagaggcgcttgtgcccagcctcatgccagataatgcagttgctaaacgaaaagcagaggattttgtttccgataacaagagattgaaaggtttaggcatcggtgctcctgagggtcccatatctctagatgattttcgaagtcttcaaagatcaaacatggaattgagaaagcaattggagaatcaggtggttacagttgatactttgcgtagtgacaactgtgcagctgttgaatgccatgaaagtgaattaaaatcagtcaaagagtcggttgcaaaatgttaccttgatcaattaaaagcattacagcaaatggtggatctcaaacataaggaattaggggatctcaacagagcgtctgctgcacaaaaacatgccatggaagaccttaatgaaaggcttagtgcttctacgcagtcatgtgctgaagcaaattctataataagtagccaaaaggtaaatatagctgaactgaaggaacaattagatgaagagtggactcaacgaaaagaagagcgagaaaaggctgcaggtgatctaaaagctgctgttcatagagcccagtctgaggctcaagaggaattaaaacgactctcagatgcttccttaagaagagaaagagagctacaagaaacaataaataagctacaggagtcagagagagaaatgtctttgctggttgaaaccttgaggtccaaactggaagataccaggcaaaaattggttgtatctgataataaggtccgtcaattggaagcccaagtacatgaagagaagcttgccaatgaaaatgaaatgaagaaagtagaacttgaacaacaggaaacaagaagattaaggaaagagcttgagagcgaaaaggcagctcgagaagaagcttgggctaaagtttctgttcttgagcttgagataaatgctgcaatgcgagatcttgattttgagaggcggaggttgaaaggtgccagggaaagacttatgcttcggtaa

SEQ ID NO: 53224 - DNA, 4104 bp, Glycine max
  Peptide Sequence Number=SeqID_144909
atggttgcattgactgtggtgaagcagctatcttgctccatcttcattagtctggtatcaagatttagagctggactgaaagcagaaattggagtatttttccccatgattgttctcagggttctagaaaatgttgctcaacctaattttcatcaaaagatgatagtgcttcgttttctacagaagctttgtgatgattcacagatattggtagacatttttatcaactatgactgtgatgtcaattcaacaaacatatttgagaggacgataaatggacttcttaaaactgcccaaggtgtccctcctggtgcaacgaccacagttttgccacctcaagaggaaacactaaaatatgaagccatgaagtgcttagttgctgttttaaaatcaatgggagactggatgaacaaacaattgcgcattccagatcctcattcaggcaagaaagttgaagcagttgataatggctatgaagctggaggccttcccctggcaaatgggaatgaagaagagccagttgaaggatcagacactcattctggaatctccaatgaggtatctgatgtttcaactattgaacaacgccgggcttataaactgaaacttcaggaaggtatatcactttttaacaggaagccgaagaaaggaattgaattcctcatcaatgccaacaaagtgggtaattcaccagaggaaatagctgcttttcttaaagatgcatctgggttgaacaagactttgattggtgattatttaggagaaagagaggagtcatccttgaaagtaatgcatgcatatgtggattcttttgactttcaagggatggagtttgatgaggcaatcagggcctttcttcaaggctttagactgcctggggaggcacagaaaattgatcgaatcatggaaaagtttgcagaacgatattgcaaatgtaatccaaaagtcttttctagtgctgatacagcatatgtccttgcatattctgtgattctgcttaataccgatgctcacaatcctatggtgaaaaacaagatgtcagctgaagatttcataaaaaataatcgtggcatagatgatggaaaagatgtaccagaggaatacttaaggtctttgtatgaacgaatatctagaaatgagatcaaaatgaaagaagttgatctggaagcccagcaaaaacaggctgtgaactctaacagacttttaggcttggatagtatattgaatatcgtggtccggaagcgtggggaagacagtaatatggagaccagtgatgatctaatccgacatatgcaagaacaattcaaagaaaaagctcgcaaaactgagtcagtctattatgcagcaactgatgttgtaatcctcagattcatgattgaggtgtgctgggcaccaatgttagctgccttcagtgttcctcttgatcaaagtgatgatgaaattgtaatagcactgtgtcttgaaggcttccgttatgctattcatgttacttctgtaatgtccatgaagactcacagagatgcctttgtgacttcattagcaaagtttacctccctgcattctcctgctgacattaagcagaaaaacatagatgcaatcaaggtgattgttactattgctgatgaggatgggaattacttacaagaagcttgggagcatatcttgacctgtgtttcccgatttgaacatctacatcttctaggagaaggggccccaccagatgccacattctttgcatttcctcgaaatgattctgaaaatacaaaacaagcgaaatcaacaattctccccgttttgaagaaaaagggacctgggaggatgcaatatgcagctgccactgttatgcggggttcatatgatagcactggaatcagcagtaatactactggagctgtcacatcggagcaggtgaacaatctagtttctaatttgaatatgttggaacaagttggaagctcagaaatgaatcgcatatacactcggagtcaaaagctgaatagtgaggctataatagattttgttaaggctttatgcaaagtctccatggaggaactcagatctccatctgatccacgggtgttcagccttacaaagatagttgagattgcgcactataatatgaaccgcatcaggcttgtatggtcaagcatttggcatgttctctctgatttctttgtaaccattggctgttctggaaacctttcaattgcaatttttgcaatggattccttgcgtcagttgtcaatgaaatttctggagcgggaggagttggctaattataattttcaaaatgaatttatgaagcctttcgtcattgttatgcgcaagagtagtgctgttgaaattagagaacttatcattagatgtgtctctcagatggttttatctcgtgtcaacaatgtaaaatcaggatggaagagcatgttcatggtattcacaacagcggcatatgatgaccacaaaaacattgtactcctggcttttgaaattatggagaagattattcgagattactttccatgcatcactgagactgaaaccactacctttacagattgtgtgaactgtctaattgcattcaccaatagtagatttaacaaagaaattagcttaaatgccattgctttccttcgattctgtgcaacaaaactagcagaaggagaccttggatcttcgtcaaggaataatgacaaggaaagttatggaaagatatctgctccatcacctcgaacaggaaaagaggggaaacaagataacggagaggtgacagacaaggatgatcatctctatttctggtttcctttactggctggtttgtctgagcttagctttgacccaaggtctgagataaggcaaagagccttgaaagtcctgtttgaaaccttacgcaaccatggccacctcttttcactacctttatgggaaagagtatttgaatcagtcctatttccaatatttgattatgttcgtcatgctattgatccttcagggagtacctcagaggtcaatgaagtagagactgatggtcagcttgatcaagatgcatggctttacgagacatgcacattggccctccaattggttgtagatctttttgtcaacttctataacaccgtcaatccacttttaagaaaggtgttgatgctcctggtaagctttataaagcgccctcatcaaagcctggctggcattggtattgctgcatttgttcgtttgatgagtaatgctggggagctgttttctgatgagaagtggttagaagtggttttgtcactaaaagaagcagcaaatgcaacactccctaacttttcattccttgacagtggaaactttgtgactgtaaatcatgagtatgcttcaatggctgaagatgacagggatcctgctgagtctggctcacatgataatttagaaagcccgaggactcaaaatctttatgcatatttttctgatgcaaagtgccgagctgctgttcaacttttattgatccaggcggtgttggagatctataacatgtaccgaactcaactttcagcaaaaactatacttgtcttgtttgaggctttgcgtgatgtggcattacatgctcacaagattaacagcaatattattttacgttcaaagttacaagagtttggctctatgactcaaatgcaagaccctccactgttacgcctggagaatgaatcctaccaaatatgtctcacatttttacagaacctcgttgtggacagacctactagttatgaggaggttgaggttgagacacgtctcattagactttgtcaggaggtgttggagttctatattgaagttgcaggttctggaacagtatctgaatcttctcatggtaaacagctgcattggttaattcctcttggctcggggaagcgaagagaattggctgcacgtgcaccgcttgttgtgaccactcttcaagctatttgtaatttgggagagatatctttcgagaagaacctggctcattttttccctctcctctcaagcttgataagttgcgaacatggatcagctgaggttcaggtagctctcagtgatatgcttagtttatcagttggtcctcttttgctacggtcatgctga

SEQ ID NO: 53225 - DNA, 1251 bp, Glycine max
  Peptide Sequence Number=SeqID_144910
atggcagagggaaaaggtagagtttgtgtcactggaggcactgggttccttggttcatggatcatcaagagactccttgaagatggatatgctgttaacaccactattagatctgacccaggacgaaagagagatgttagcttcctcacaaacctaccaggcgcatccgaaaagctaaaaattttcaacgctgatctcagcgaccctgaaagttttgatccagcagttgagggatgtgttggaattttccacacagccacgccaattgattttgcagtgaacgagcctgaggaagtggtaaccaaaagagccatcgatggagcactaggcataatgaaagcaggcctaaaagcaaagacagtgaagagggttgtttacacttctagtggctccaccgtttccttcagcagccttgaagaaaaagatgtggtggatgagagtgtttggagtgatgtggatatgcttaggagtgtaaagccttttggttggtcctatgcagtttcaaaggtgttgactgagaaggctgtgcttgaatttggagaacataatgggttggaagttgcaactgttattgctccttttattgttggtccttttgtttgtcccaagcttcctgactctattgaaaaagctctgcttatggtgttgggcaaaaaagaagaaattggtgtcattcgttaccatatggtacatgtggatgatgtggctagagcacatatcttcctgcttgagcatcctaatccaaaagggagatataattgctcaccattcattgtacccattgaagagatgggtgaacttctttcagccaaatacccggaatttcaactaccaacagtagacgagctgaagggaattaaaggtgccaagcaaccacatttaacctccaagaaacttgttgatgctggttttgagttcaagtatagcttagaggacatgtttcaggatgcaattgaatgctgcaaggaaaagggctacaacaatatcgaagacatgggatgtttttgctcccgagcaccttctgttggaagttgtcatcatcatcatcatggagatggtggtggtggtggagggtgcggaggtggtagtggtggcggcggaggtttcaaattaagcaccgccatatccggtcgcgtgtttcctcgttcggggacattgatgattctgcttgttccgccactggctgctgttgtcgtgttccgcttctgggatcaccgcccagtgcctaaaggaacaatcttttggcgctaa

SEQ ID NO: 53226 - DNA, 1308 bp, Glycine max
  Peptide Sequence Number=SeqID_144911
atggatccagcgttacccattgtagcgctgtcgcttctcttgggtgccatcatcgccttcctcatcttcaacacctacttctgcaagcgccaatccgaaatccgatccatcgccgatccaaatccaaattcaaattcgaatcccaaactcgtgtcttccaaaccccctcccaagaagcctctctccaaaccccattcctccgacaaggatcaaaacaagcgtcaccatccgttggatttgaataccttgaagggtcatggtgatgcagtgacaggggtatgcttctcccgcgatggacgaaatttggcaactgcttgcgctgatggagttgtgagagtattcaagttggatgatgcttcgagtaaaagtttcaagtttctaaggattaatttgcctgccggcggtcatccaacggcagttgcattttccgatgatgcatcctccattgttgtggcgtcttatactctgtccggttgttcattatacatgtatggagaagagaaacctaaaacatctgaagacaaaccacaagcaaagcttcctctccccgaaattaagtgggagcatcacaaagttcatgataagaagtcaataattactatgtttggagcctctgcaacttatggcactgctgatggaagtacaattattgcctcgtgttcagaagggactgacatcattctttggcatggaaaaactgggaagagtgttgggcatgtcgatacaaatcaattgaaaaataacatggctactatatcacccaacggtcgttttattgcagctgcagcatttactgccgatgtgaagatctgggagattgtatatgcaaaggatggatctgtgaaggaagttttaaatgttatgcagcttaaggggcataagagtgctgtgacttggttatgctttacgccaaactctgagcaaataatcactgcatccaaggatggttcaatgagaatatggaatatcaatgttcgctatcatcttgatgaggatccaaagacgctaaaggtgttcccaattcctcttcatgattcttccggtactacattgcactatgatcgcatgagtgtttcccctgatggaaattttttggctgcgacccatggttccacattgcagtggttatgtgttgagactggaaaggttctggatacagctgaaaaagcccatgatagtgacatttcatgcatttcatgggctcctaaaactattccaatgggaaatgaacaagttttggttttagccacagccagtgctgacaagaaagtgaagttatgggcatctccatctatccctgcatcctaa

SEQ ID NO: 53227 - DNA, 393 bp, Glycine max
  Peptide Sequence Number=SeqID_144912
atggctacaaggaggagggaggccatggagatgaaggcatggtttggtgagggagagaaggaagagaggccatggtcatggagattgagtggggcgcttgagttttatgcgactttagagcaaaaagataagagacgtaagaaggagatgtttgatagggaagcaaaaggaaaaagctggtttggaggaccagtgcctccagaaaagaagaatagaggaagaatattggaacatcagagttggttaaacttgtctcctcctagaagaccagcaagataccctgacccagctcattttttatacttagtccttgagaaagcgaaggagaacaagcagagagggcgcaaacatttcagaactcggggacgaagacaatcaaataaaaatcactga

SEQ ID NO: 53228 - DNA, 804 bp, Glycine max
  Peptide Sequence Number=SeqID_144913
atgactatcacatggagagttagggatttgattcccgacaaaggaaatatcaggcccagtcatgattactatttgaagacaggaacttgcaaatttggagccacatgcaggtttcatcatcctagagacaaggctgggattgctggaagagttgccatgaatattttaggctatcctctccgcccaaatgagcctgaatgtgcttattatttaagaactggacaatgtaaatttgggaacacttgcaaatttcaccatcctcaaccaaacaatatggtgctttccatgagaagttctcctgtttatcctactgtccattctccaactacaccaggtcagcagtcatacgcgacaggaatcacaaattggtctagttcatcgtatattcctagcccacgttggcaaggcccttcaagttatgcacctttaattctacctcagggaatggtttcagtgcctgggtggagtgcatacagtggtcaaatgggatcagacagtcctcagcaaacaatgggaaatggccaaagctatggaacttctcggcaaagtgaaccagcaaattcaggatcccagggggcatattctcaatttcgttctggctctgttcctgtagggttctatgcgttgcagagggagaacatatttcctgagagacctgatcaacctgaatgtcaattctacatgaagactggagattgcaagtttggtgcagtctgtcgtttccatcatccacgtgaaaggatgattcctgctcctgactgtgttttgagtcctataggtcttcctttacgtcctgtgagttga

SEQ ID NO: 53229 - DNA, 615 bp, Glycine max
  Peptide Sequence Number=SeqID_144914
atgttattaattttcaatagaatcagtggtcatattcccctcaagattacatccattgaaaatggtacagttctcaaaacattcaaacacctgcttcatcagaataaacaagtggacttcatagagctatttcatgaaaagcttctagtcaagcaagaaaatgagaatcagttgtttcttactttcataaatggaacagtatctgtttggagcttttgtggggagcttgttacccaatttgaggatcaccagctgtggcatccagattgctatacaaataacacatacataacaaaagaccaggatctcattatctcttattgcaaggcagattctgatgatcaatggatggaaggcaatgctggctccattaatgttagtgatatcttgaccgggaaatgcgtggctaaactgaacgcaacaagtagcagcatcaaggcggacgagtgcaacaacagtgcttgcaactgcaacaagcaaagtcattcatgcctattaaggagttcagttgcagaggctttggaggaagtcactgccctcttttatgacgaagatagaaatgaaatatatgctgcaccggatttctctaaaatccaagctgcctcagcattgtaa

SEQ ID NO: 53230 - DNA, 87 bp, Glycine max
  Peptide Sequence Number=SeqID_144915
atggtgaagtgctcaagtggattaaggctttggggaaaatcagaaaaatcaatgatgtttgccaacgcggtcttagctggaccctaa

SEQ ID NO: 53231 - DNA, 195 bp, Glycine max
  Peptide Sequence Number=SeqID_144916
atggcccgtgctacgtctgaccatgccttcaatgccacaatttgggatgtcctagttgatcctggctaccagggccaaggtcttggtaaagctcttatagagaaactgattcgaactcttctgcaaagggacattggcaatataactctgtttgcagatagtcaagtggatacaaagcagtgtcataaattttag

SEQ ID NO: 53232 - DNA, 288 bp, Glycine max
  Peptide Sequence Number=SeqID_144917
gatgataatggggtgataccgatgatgatgggattgggcatgctgatgggagcgaccatggtgacaatgatagtaatagtggtgatgatgatagcgataatgatcaaagtttttgtgatagagatgacaatagtgataatgataacaacaatgataaaggttggtgacaattgtgatagtgttagtgacaatgataacgataatgataataacattcacgacaataacaaaaatgatgattatggccacaatggtggtggtaatgggagtgggggcgatagagggtga

SEQ ID NO: 53233 - DNA, 2352 bp, Glycine max
  Peptide Sequence Number=SeqID_144918
atggaggatgacaagaggaagaggaagaacaagaagaagaagaacaagcagaacaagaatgtggaaaatggggttggagaaactgccaatagggatcagaatctggtgagtaatggaaaggatgagcatactaatctttccgagactgcaaatgagcaaagctcgaatgttgattcgaatggggttggagagacatcaagtagggatcagaatctggtaaataatggtaaggatgaacctgctcttctttcaggagtcacccatgagcaaagtatgaacgcagatcggaacggggttgttgaaacccccaatagcgatcaaaatctggtgaaaagtggaaaggataagaatattccaccattggagtttgcagatgggcaaagcactaatatggattcaaatggtcatctgccaaatggtaaagaatgtgctaaaggaggaattctaataagactagacatggcaacagggcagggcggggcggggatgggtattgcctccccagtccccgaccccgactccccaacatatacccgtaccagtccccgagcatttgtctacaaaaatcatcaagaaaagaatcttaaattatgtaaaaattataaaaaaattaacaaagttgtacatcatatcactccacaggccatatcagaagagacaatcaggaaattaaaagaagaaaatgatatacatattcagaaagagactttatcaaaggagacaatcaggaaattaaaggcagaaaatgatatgcacattcaaaaggaggccataatggaagagacaatcagaaaattaacagaacaaaatgacttgcatatgcagaaagaggctatctttccacagattgcatcagaagagactatcagaaaattgaaagaaaaacatgatgtgcatgttcagaaagaggctatatcagaagatacaattagaaatttgaaagaaaaaaatgatatgcacatgcagaaagagcatatcttaaaacagaccctgtcacaggagacaataagaaaattgaaagaagaaaatgaagggcacattcagaaagaggccatatcaaaggagacaattaaaaaattcgaagaagaaaatgataaactagttcagaaagagactagtctggaaatgagaattgcacaattgcaaagtgagaataattccttacttcaaaaagaggctggattggtggaaagaagtaatcagttgctgaatgaaaaggtagttttgagcatgaaagcttatattattgatgggatattggatcttgggcctaatccagatcattgggctgaacagaacaaggatcaattgctggatccaagccctaaagaaatggagagtctggaaggtttataccaaaaggcagcattatggagagtcatgttttcttacatagggaggaggctacatgttggactggaaacaagattcgcacaattgcacagtgagaataattccttacttcaaaaagaggctacattggtggaaagaaccaatcagttgctgaatgaaaaggaagttttgagcctgaaaggggagagtttagaacaaaaaatatatcttctggagagcgatttgagttctttagtcgagaaggagaattcaactaaagacactatttcaaagctgaatggcaacattgctgtgctacaggtgcaggtggaagagttggaggagtccaggaataatctttttctagaaaaccagcaattgagggaaaaagtgtcgagtctagagtcaacggtccaaaatcatgaaaacagtaacgcttcttcctgctcacgggatgcacctgaaaaggatcttgcttctgaaaacaaggacttgaagtctgaaattgaagcagcctttacgttggtggagaaattgatggctgaaaatgcggaacttgtggagaaggtcaccgagttatgtgttgagttggatcaccaaagtgcagtcactgaacccaatgagatgactgaattcgctaaacctactggtgttgccattcctccaccagaatctgctgagtatgcgtctgtgtcggcccccaagttgaattcattggaagagacttcagtgaaggataatggtaactcttttaatgacgctaagcatgttgttggggtaatgtcaaactcgtcgttgttatctgatgatgctggagaaatcgtgcaaattccattggatgataatgaaatacaagatatagagttgcaggatgctaagaatgtggaaaatgatgctgatgccgtgccaattacagatgctccccttatcggtgctccatttcgtttgatatcatttgttgctaattttgttagtggtgctgacttggttgacccaagctcttcaaacaccgctcgttga

SEQ ID NO: 53234 - DNA, 1065 bp, Glycine max
  Peptide Sequence Number=SeqID_144919
atgatagggtgggaagaagtatacaaagtagtggtagcagtggtaccactctattttgctctactattagggtatggttcactgaagtggtggaacatcttcactagggagcaatgtgaagcaataaacaagctagtttgttacttcactttgccactctttatttttgagttcactgctcacatagaccctttcaagatgaactattcgttcatagcagcagacaccatatcaaagttcatcatcatggtcgtgcttgcactttgggccaagtgcactcccaaagggacctttagctggtccataacgagcttctcattgtgcaatctcaccaacgctcttgttgttggggttccaatggtgaagcccatgtatggagccctaggtgtggaccttgtggttcaggcctcggttattcaggccaccatatggttccctttgcttctctttgtgttggagttttggagaacgggaagtgagggcaccaccatcaccaccaccaccacgttaaaaccaagaccaaaaacaatgatcattgataatgaaagtggaggagggaaagatgtggaggctactactgtagctattgatgtgaaagaggaaatgatgttggaagagagtgttactagtagtaggcttcctttttgcaaggtgatgaagcttgtgtggcgcaaacttgcaacgaaccctaactcctttggctgtgtcattggcatttcctgggcttttatatcaaacaggtggaacttggagatgccaagtatgttagagggatctatacagatcatgtcaaaggccgggaccgggactgccatgtttagtatgggtactttcatggcacttcaggagaaggtgattgcctgtggaccaagtatgactataatcggtttggttttaaagttcattgcgggcccagcggctacggcaattggtgccatcgttgtaggattgcgaggtgacgttttgcgagtcgtaatcattcaggctgctgtgccacagtccatcacatccttcattttcgccaaagaatatggattgcatccagaggtcctcagcactgcgtaa

SEQ ID NO: 53235 - DNA, 282 bp, Glycine max
  Peptide Sequence Number=SeqID_144920
gtgagtacctacgctttgctggttgaggacgtgctggaagtagtatttgacgcagttgttgtgcatgaagctgcagctttacgaattcaaaggctttctaaggggtttttgggcaaccagaatgtgagaatttcagtggatgattttgaagatttagactctgaacaatctgatacatacggtcctatttcaatgagaagaaaaagtaccggaggaaagaaacctaatcaaagagattgggatgatgaagataattgggagcttccgatggactatccttga

SEQ ID NO: 53236 - DNA, 129 bp, Glycine max
  Peptide Sequence Number=SeqID_144921
atggagcagtgcatctcaggcttttgctgcagtttgaagcagaagggtacgaagcttcactatgatgatgccatctcctccattgtgaagaagaacaaccaatactacaatggtaaaggtttgacctaa

SEQ ID NO: 53237 - DNA, 939 bp, Glycine max
  Peptide Sequence Number=SeqID_144922
atggatggtaaagcctttgcatggcaaaggcattatatgctaaacaataacagagggaattcttggcaacaaatcattcataatgctggaagcagattcgacacaagtgcattcgatgatccaatagcagaaattgcaagattgaagcaagatggccctttgatcgattacctagaaaactttgacacattgttagctcgagtatcaattacagaagacgtagcattaagtttttttctttctggtttaaccattgagcttgagaaatcagtaagggttcataggccaaacgccatgatttttggtggttgcatctttttttctggtggtgccattaatggtgctgctgaaaatattgctacgctaatcttgggtcgtatcttgcttggtcttggagtcggtttcacaaatcaagcaacgccaatttcaaaagccgtgaaaggggaaggttttgggatgatgtttgaggagcagtatcagcctaagttggtgatggtgtttgcgattccgatgtctcagcagctcacggggatcaacattgttgccttttatgcgccagacctttttcagtctatgggagttgacaatgacttggcgttgcttttggctgttatattggggcttgtcaaccttggttccattcttgtctcaactgctattgttgatcactttgggcgaaggttcttgtacattataggcagcattcaaatgcttatttgcatgattgttgtggttgttgtgttggcagtggtgaatggtgttcatggtacagaacacatttcaaagctcaacgcacgaatgaagaaaaaaggcagcagagctgtcacggaggtgttgattcaatggcaacataccaacccagaagatgcaatttggaaggaattacacagtatgcaacaccaatttccagattttgattggagagctaacaggccttga

SEQ ID NO: 53238 - DNA, 990 bp, Glycine max
  Peptide Sequence Number=SeqID_144923
atggtggcgggaactgcaaccttgaagcttaatctctccgatttttcttctccaatgtcaagtttcagcgcttcttcctcttcttcttcattcccctttcttctttcaatgcgaaccccttcttcttcttctaaaccccgatttctcagtcagtcacttccttccttaatttcctccctttctccaacagcttttctctcttcgctaacttgcgcctttctttcagggatttacgccttgaccagcaacgacatcaaggtcggcaccaacctcgaagtcgatggtgctccttggcgcgtgttagttttgaattgtgaagcctcttttaacttggcttgcgttgcactgcacggttcagagtttcttcacgttaagccgggaaaaggcgcggcgtttgtgaggaccaagatgaagaattatattacagggaacacggtggagaaaacgtttagagctggaagctcgattgagcaagcagatgtattcaaagaaacaaagcagtttacatataaagatggtgttcaatttgtcttcatggacttgaatacatatgaggagtttcgtctgggtgaaaaggaaattggagacagaacaaaatggctaaaagaaggaatggactgtaatttgctgttatggaatggaaaagtaatcatctcatctcataatatattatgtctttcactattgttgcaagtctcacatcgggtggttaacgagcatgataaaccgttgcttgatcacttcggtgacaaactcacactagaggagcatttcctgattggcagtatggttattgatgttgaactccctatcacaatcaagcttactgtagttgatgtggatccaggacttaagggtgacacggcccaaggcggaacaaaaccagccaccctcgacaccagcgctgttgtcaatgtcccactctttgtaaatgtcggtgatgaaatattggttgattcaagaactgggcagtacatgagccgtgcttaa

SEQ ID NO: 53239 - DNA, 402 bp, Glycine max
  Peptide Sequence Number=SeqID_144924
atgctacaacggcggcttctggagacggagctgagcatgccaccgtcgtacggcggcagcggcggaaacaacacgcgcgacacgttcatcagcgacgcgaacttcgacacaaacatgacggcggagcaggcggctgcaaggctggcggggaccgggctgaagcgccgcgagctcagccgcatcccggtggcggtgtacggcgccgccggaggcgaaaacactattccggcgacggagtgccccatatgcctcggcgagttcgagaaaggggacaaggttcgaatgttgcctaaatgcaaccacggtttccaccgaggtggttgttgtggtggagcaggcgagttgaatggcattaacagtgaaaggtggaaagaaggacaagttttggtgaatggaggttga

SEQ ID NO: 53240 - DNA, 1422 bp, Glycine max
  Peptide Sequence Number=SeqID_144925
atgactaatagtactcaggtgaaagaagagttgaaatcactagccaacattgcatgtccaatgatgatgaccaacgtgcttttgtattctcgatccgctatttccatgctttacttgggtcgccaagggaaagtggagctagcaggaggatcacttgcaatagggtttgccaacatcactgccaattcatttctcaagggtctcaccatgggaatggacccaatttgttgccaagcatatggtgcaaaaagatggtcagttttaagccaaactttttgcaaaaccttgtgcctcctcctccttgtagccatccccatttcactcctttggctcaacatggcacctctccttcattggctagggcaagaccctgaagtcacaaaagttgcacaagtttacatggtcttctctatcccagaattgcttgctcaagttcatctcaaccctttaaggtcttttttaagaacacaagggttaacaacaccattaactattgcagcttcttttgctgccatcttacaccttccaataaactatttcttggctacatatttggaattaggagtaaaaggcattgcattagccacaggtttgaactccataaacatgatactagggttggtgctttatcttgttgtgtcagagaaacccttaaagccttgggaaggtgttactattctctcttcctttcatgattggagaccattgctaaccctagcattgcctagttgcatctcagtgtgcttggagtggtggtgctatgagataatgctcttcctatgtggcttgttgagtaatccacaaaccacaattgctaccatgggtgtactaattcaaacaactgggttcttatatgtgttcccattttcactaagtgcagcattgacgacacaaattggtcactccttaggtgcaggtcaaccttcacgtgcacaaaacacagccaaaataggactcttcattgcatttgcattaggtgtctcagcctttgttttcttattgtttgtgaggaatgtgtgggggaaactcttcacaaacgagacacaaattgttgacatggtcacagccatacttccaattttagggttgtgtgagattggaaactggcctcaaactgctgcgtgtgggatcttatcagggactgcacggccttatgtgggtgcaagaataaacttgtgtgctttttacttgattggattgccggttgcgatttttgctgctttcatgcacaggtaccaattgaggggcttgtggtttggaatgctagcagcacaaatttcgtgtttttgtatgatggtttacacgttggttcagacggattgggggcaccaaagtagaagagctgagcaattggctcaaacaacagatgaggaaaatgtaaataatgatgagaaaagtgggctccttgattctgatttatga

SEQ ID NO: 53241 - DNA, 1077 bp, Glycine max
  Peptide Sequence Number=SeqID_144926
atgactacaagtctagaaaactatctgtgggattatttgcagctattatggcatactcatgtagctgaatatctaaatgttccacttcacatattcttcacaatgccatggacgcctactagtgaatttcctcatcctctttcccatgttaagcaaccaattggctacagactctcatatcaaatagttgatgctttaatctggcttggaatgcgagacttgataaatgagtttaggaagaaaaagctgaagctaaagcctattacttatctaagtggatcttacactcacccttttgatgtgccccatggttatatatggagccctcacttggtccctaaaccaaaagactggggacctaagattgatgtcgttggattttgtttccttgaccttgcttcaaattatgtaccaccaaaatcgctagtagattggcttgaagagggagaaaaacctatttatgttggatttggtagccttcctttacaagaaccagagaaaataacacgaattataattcaagcactggaagaaacagggcagagaggtatcatcaacaaaggctggggtggtcttgggtctttggcagaacaaaacaaatctgtgtatttattggacaactgtccacatgattggccgtttccccgatgcactgcagtggtacatcatgggggtgccggaacaactgccacgggtcttagagctgaatgtccgacaactattgtaccattctttggggaccagccattttggggagatcgggtgcatgctagaggagtaggtcctgcacccatcccggtggatgagtttacatttgataggctggttgatgccatacgccttatgctgaaaccagaggtgaaaaagcgtgctgttgaacttgctaatgccatgaaaaatgaagatggggtgctaggagcggttaaagccttctataaacattatccgcccgaaaaatcaaagttcgatgacgccaagtccaagcaattagcctccacagccgaacccaaaccagttcataaatatttctctatacgaggatgctttggttgctctaaatcttctggatataaatag

SEQ ID NO: 53242 - DNA, 243 bp, Glycine max
  Peptide Sequence Number=SeqID_144927
atggagcactgcatattttacgtccaaactgaaagaggtcccctatcatttgacgcaggtccagagaacatagttgtcaccgttggcaaacagctagaggggtggagccatggtgtattcaaatgtgttcctggggaaatgatcttcatgccgagtttccagagtagccctgcctctttctccatagagcttgacatgattgcgccgtttccatttatttgggtgcctgttgcgtggtcttga

SEQ ID NO: 53243 - DNA, 237 bp, Glycine max
  Peptide Sequence Number=SeqID_144928
atggctcatcaaggacatgaagttaggaacactcttggtgaatatacctatagtacgatgagcagatatgcttccaaaattataagactgcttgtagctgccaacaattttgagacaaacctatacttcctcgtattgtgcaacaaaacaagtttggagggagggaaggaggaggaggaggatcaaaatctccatattgcaaaatttggagagatctgtgatacaattataaaataa

SEQ ID NO: 53244 - DNA, 1740 bp, Glycine max
  Peptide Sequence Number=SeqID_144929
atggagcaactacggccaccaccgttgtcgggtcgtcaactttcattggcggctcggctgaattcgatggtggctcaaagtcgcataggcaagtattttagggttgccgagcgtaatactaccttcaccaccgaacttcgcgctggtactgccacgttcctcactatggcctacatccttgccgtcaacgccaccatcatcgctgattcgggcgggacatgcagcgtctccgattgcatccctctatgctccgaccccaaaacgccactctccgaatgcccgacccatctcctgacccgacccggattgtcttgcaagtaccctcccgtcaacccgggctatgcggcgtgcgtggaacgcacgcgccgcgacctcatcgttgccaccgtggcctcctccctcatcggctccggcataatgggcctctttgcgaacctccccttagccctagcgcccggcatgggcgccaacgcgtacttcgcctactccgtggtcgggttccacgggtcgggtcccgtaccctaccgaaccgcattaaccgctattttcttagaaggcctaatcttcctcataatctcagccgttggatttcgcgcgaaactcgccaaactcgttccaaaacccgtccgagtctcctccgccgccggaatcggtctcttcttagccttcattgggcttcagagcaacgaaggcattgggctcatcggattcagcccatcaacacttatcactcttggaggctgcccgaggaacaaactgacggcgttagctccggtcatcacaattaacggcacagttagtttaattcctggcgccaccgtctccgacaagatactatgttctgggaaccgcatggagagcccaaccttatggcttggtttggttgggtttcttatcattgcttactgcttaatgaagaacataaagggggctatgatatacggcatcgtttttgtaaccgtgatctcctggttcaggaacacgccggttacggtgttccctaatacccaactcggtgacgccgggtatgactattttaaaaaggtggttgacgtgcacgtgataaaaaccaccgccggtgcgttgagttttgatagcatgtggaagggtgcattctgggaagcacttttcacgttcttgtacgttgatatattggacactacagggaccttatattcgatggccagatttgcagggtttgttgatgataacggtgatttcgaggggcagaattttgcgttcatggcggacgcatcgtcgactgtggtggggtccctgctggggacgtcgccggtgacggcgttcatcgattcgtcgacggggatacgggagggggggaggacggggctgacggcggtgacggtggcggggtattttttgatggcgttttttttcacgccgttgttggcgtcgattccggcgtgggcggtggggccgccgctgataatggtgggggtgatgatggtgaggtgtgtggtggagattgactgggaggatatgagagaagcgataccggcgtttgtgacgattgtgttgatgccgttgacgtattctattgcctatgggttgatagggggcattgggacgtaccttgtgttgcatgcatgggagtggggggaggaggtggtgaggaatttttttactaacaacaactttaaggataataataatatatctaatgtaaatgctaatagtcgtgttgttgatgatcatgaacaaggagatgataacaaggtgtag

SEQ ID NO: 53245 - DNA, 807 bp, Glycine max
  Peptide Sequence Number=SeqID_144930
atggcggaagcaaacactcgtcaccaccgcgcaacctcttcttccagtgacatctcagtctatttggacgccgaccactcttctgttcccgctgcttctttcggtcctattgacaggaatccatcatcctctacgccgccgtcgtcgtcgcggaacgccgccgctgcaccggctaatcaagttaacgataagaacgctgctgctgctgttgctaaagttgttggtaggagcaagggaagcagtgcaatggcgcttgccaagttccttgacgagaaagttcccttcagggaaaagatgcaatggataaaacaggcttccatacttaaggatgacggtacagttggaattaaagttccaggagcaggaagtaatattgagcatgatgttaaatgcaatgaatcttatgatgaaatttacaatgcaatacacagtcaggatattcagcctattgagccacttcaaatcgtaatgcttatagttggcacacggggagatgtccagccatttgttgccatggggaagcgtcttcaggcttgtagttttaccctttgggtggagatcccaaagttctcgctggtttgtttcttctctgttcatgctttcaaactatttaaatacatgatttcttcagatatggtcaagaataaaggcttcttgccatcgggaccttcagaaatacatatacaaagatatcaaatcaaggatattattaatagtttgctcaatgcatgcgacagtcgttacccagagtctaatgccccatttcaagcagaagcgataattgccaatcctccagcatatggttag

SEQ ID NO: 53246 - DNA, 2766 bp, Glycine max
  Peptide Sequence Number=SeqID_144931
atggtggggtttgtgtctgaattgatgctattgttggctaaggttctttctgattttgtggctgtccttggagaaagaagtccaagagaatcatggactcttgtggtttatgaatattgtgccttattcagaggtgtcttgaacttctctgatactactagtgatgggaaaaggccatgtttcaaacagccaatttgttcatcattgcttccacttcaaaatatttgtgaccctaagacaggagagcttgtaaattatgatgcaacacaaattagggctactacacatgaatcatcttcagcaacaaatccaagtgaggataacatcaagagggatgttagtgaattacccttagtagaaaatgcttcacagaatgattgtgatacccagagaaattcctatgccgatgaaagctctggtaatggatgtgacaactgttctaataatattaattcccttccagttgaattggatgctggcgatgatttaaatttagtcaaatcagaaacattgatcataagggaattcagttctgcatgtgtcaataaatctcctgtttcaaataattcagtggatgaacctactgattcacactccaatgttaatttcaaaaacccatctggagacatggttttgcagaccaacttgaccagtccaataataaccttcaatcgatgttacaaaagaaaaaagggtttggagcagagcaacttatcgcacaagaaggaaagcatttcggcattaaccaaatggagtatgcttgcaaatggcaatccaggtttgagcaatgagtcatctagtgaggaaagtccagtagataatgtaccagaccttaatcaatcagtgggactttcagaaagagggcaggcattgagtgaaactcaagatgaaacatcttgtagaagctgctctatggttttccaaacagaccttaatcaatctgctgagctttcagaaagaggggagctttgtcaaactgaagaaaaagtaaggcttcctggtaatcttgatcttaaaatctactcagtttctcagagagattttgagtttgtgacttgttttgatgctgaccatcatcgattacagacctcatacatgagagagcaaccttgtcatggggaagactctgtaaaaaatgcctctcatacagacaaaacaggagaaccgagccacaattgtttgattcacaatgaagaccaacatattcttaaggattgccagggagtctctatcatagttgattctagaggtccctatcctgttgccacaaccactgatcaagaactagaaaagtccctgctcttgccatgtgaggccattgaaaatgtttcgtgcaatgacataatgaaaaaaattggagaacatcaacctcagtttgaccttcctgttaactctgcagaagagaacactgttgacttgaacttgggtgctgagaagtatccgcttcatttgaggatgagaactcttggtgccaaattggagtcaacaagcagtagttctgccattgctgaagatcaagtttctgaactagactttttaaactctagaaatacacagctgatatcagaaggaaaggctatagatggtgtttgctcaagtagtactcaacctcagttaatgatgtctgaagaaagaatgaatgttcagcatacaaaaactgatcaaccaaaactcatgccagtgatttctctttctttgggtttgtctttacctatggagcacaaaactggatgcagtgattcagttaatagtttgtcggtattgtctttgtcaaattcaaccactgaagccagagatattgtccaagatggattctgttggtcttcatcagtaaaccggagatcattgcttcccaggcaccaggtagtgcttgacaacattgtacacagaacaagagctttaaatgaaagaggaaattttcaagaatatttgaagccacaccctatcatgtggtctgaagaggagttggattttctctggattggtgtgaggagacatggtaggggcaattgggatgccatgctaagggatccgagattgtggttttcaccattaagggtaccaggggaccttgccgagaggtgggaggatgaacaattaaaacttttgaatgatatcagcgttccacagttcatgtatccagcagcggcgtcattgcaaggaaacttctgctacttggatcctaaatcaagtttctgggagagtaaccccttgaagaaatctcttcccagatataattttcaaagtaacaccactgcacacagtcataggccaactattcattccagaaaggcctcttacaacaatatagacaagtatgaattaggatttttcaattctccaggaagcttgggcatttctagggaaaactcttactcgaacgattattcctttaattgttcggctgtgacaaatagtttgcctcactggctcagagaagcagttaacactcctcctattcaaccaaatatgtctgcagcgatttcgttgagttctcatcctgagataccaggaacttcagatcgatgctttagtgctggtaagtcatgctttgtgcctcaaaattggttcaatggtttgacgccaaatgagatatacatgtcaaatgggtctcactattcaacctattcaagaagaaaatatggggtggtgaagatgaacaagtctctggaacaacgtgtccacaaaccggataacttgatcatcattgatagtgacacttcttctgaagagaccatatctgatgatcaccgttccagcttgtag

SEQ ID NO: 53247 - DNA, 228 bp, Glycine max
  Peptide Sequence Number=SeqID_144932
atgtcaattccaggaagaagagttgagttggagaaaaagagaagaacaggaaaagggagggtctggacttgtgctgactgcgggagaaagagaggaagaagggaatgcgggagaaagagaggaagaagggaagcagaggatcggaagaagatagaagggaaaaacaaggataaaaaattactggttattcagcataaccccgataaagcagttaatgtagcgtgttag

SEQ ID NO: 53248 - DNA, 762 bp, Glycine max
  Peptide Sequence Number=SeqID_144933
atggaggggagaatgggactcttgtttcttgttgaagtcaatagagtggaagaagcatgtattgtacatgacattttcagtcccccatttttagtctgtttggtgaacgtgaaaaatttgaggagtggcagtttgaaatgcaaatgcggtgtaaatatcttgttgacctatcttcaaatttcagaactaagcagaaaaccagatgcgtgtgcactttgtgaagaatattctactaaggtacttgattatctgaatgaaaacaagacccagcaagagatcattgacatcctgcacaacatttgccaccaaacttcctcttttaagcagaagtgcattactttggtggactattatgctcctcttttcttcttagaaatagttacaatccagcctggagaattctgccacaaggtcaatctctgtcagctcattacatatatttccttgctagttcaagaagataccagtgggttttgcaaagatactgtttcaactctatcggctaagttgaaagacagtgacactaagctagagataattgagacatcactgaaggtgtgcaattcagtggagaagtatgcaaataaggtgagaaaaatctggcaaattcgtccattctcctcagttcatattcagtcatatgaagcttcaattttcaaattctatcctagtgaccaaattggaaactatcatgcttggaaccacggtaatttccttgcaatgataatttcatggacttgggtcacttggcagcctccttaa

SEQ ID NO: 53249 - DNA, 1590 bp, Glycine max
  Peptide Sequence Number=SeqID_144934
atggaagctgaaaaagaacgcagcaaatcatcatatcctagtaaggagaaagacagtaagaaggaagctgaaaggaagcgccaggaaaaaagaaaagagaaagataagggttctagtaagagcaactctgatgtagaagaactggatagaagagccagcaaggaaagtgaacggaagtgtgactttgacaaaaagagtgaaactgaccgtagagagcaccagaaatctgggtttgaaagtggcaagggacataatacagacaatacacatagtaaaaatgttgctgcaaacagttacaaccgtggaagtactggaacaaggtaccttgatcgtatgcgtggtacaattttgtcttcttctaaagctcttggtttcggaaagggtgctaatgctcctggatctgtggtgaaagaaaacaaatttaatggctctgtcgatcatattcattcaactgctaccaggaaagatatatatcctcctgattgttcaactgctaaatccaatttgaatggagacgataagaatataaatcactctgttcccccagaaccacagccatggagtccatggactgcacctaaaaagtcatggcagcaattatttactcgttcctcaactgttgctcaatcctcaaactcaaatgtaatatgtagaccaaattccaaaattcaagctgaagccaaaagcccacagttatctggccagtcaccaattacacagccatttaacaatccaattcaatttggtcttccatcaccttttaatatttccagctatccaattggatcaaccggtagcagtcaaggtttttctcctgcaattgaacccttatactctacagttgaaaatatttcacaggactttagacatgaagaacaagagctttttgaagacccctgttatatccctgatccggtatccttgcttggtcctgtttctgagtcacttgataattttcaattggacttgggaagtggctttgtgacagacacaaagatggcaatgcctcactctttaaaaagcacatctgccggttctgacatcagcaaaccatctccaattgagtccccattgtcccgagaaaagaatagctgttctaatcggtttccaagtatctcccaggcccaggatatgcatccatttcctttggataatgcagctgcaaatgagaagggaacatggcagatgtggaatactttgccacttggtcaggaaggtttaggtttggttagtgacccagcaaactggtttttatcccctcaaagggacgtgccaaacaaggatgattttgtgcttccatcatctaagactatggattctcttttcaacaaagatgataacattatttccagtaaccattcttcacaacatttttttcttcctaatggtcagagtggtgggaccttcagcccagttactggttcaaatggttatgatccttggtcacagggtgctttatttccatcgttgtcaggtggacttaaagctcaggagagtgctactcagaatgaaatgatatatgcgagtcagagtgggtctgctagcaaccatgtgcacgagtgttctaaggctaacagttggaccaagtga

SEQ ID NO: 53250 - DNA, 486 bp, Glycine max
  Peptide Sequence Number=SeqID_144935
atggctgcttctagggagaaaagaagagcatctctggaagaaacgttgcaacaacttcgcgatgtcacaaactccactgctgtaattgatatgaagcttgtgcttctgttgaacaaagcctcaattattgtagacgcctcaaaatacatagaggagttgaaacaaaaagtggagggactgaactcagagctggaaatcgcggaatcatcaacaaccactcaaattgatgaactacctatggtaattgtgaaaaccctaaaaaagggtttcctgattaatgtgcttttagaaaagaattgccctggaatgctcgtctctatactcgaagccttcgaagaacttggccttgatgtgcttgatgctagggtttcttgtgaagacagtttccagctagaagctgtgggaagagaaagtcacaagaacgacagtgttgacgcgcaagtggtaaagcaagcagtgttgcaagcaatcaagaacgcggactaa

SEQ ID NO: 53251 - DNA, 3135 bp, Glycine max
  Peptide Sequence Number=SeqID_144936
atggcaccgcaaaaggcattggagtcaattggaaaaactttgagcagtcagtatgaaagatggcaaccaaaggcccgctataaatgtcaacttgatccgacagtggatgaggtgaagaagctttgtactacttgtcgtaaatatgcaaagtcggaaagagttttattccattacaatgggcatggtgtgccaaaaccaactgctaatgacaagatccctggccgtccaaatgaccgaaagacacttctgggtgaattgaattggatctttacagccgtaactgatacgattgcctggaatgttcttcctcatgatctttttcagagactgttcagacaggatttgcttgttgcaacatctactctcttggcaatgtggctagctatatctagttgtggcaagggcatttctgatttgttcactcatcctacagtgcatggattgtactacaatgcttctctcaaagttttacttagtcaatgccatcggtttcgggctttagtactccttggaaggttccttgatatggggccatgggcagtagatctggcattatctgttggaatatttccatatgttctaaagctgttacaaacaacaacacccgaactacgccagatccttgtattcatatggacaaagattcttgcacttgacaaggttgatctagtgaaggatggcggtcatatctattttattaagtttcttgatagcatggaagcatatccagagcaacgtgcaatggctgcttttgttttggctgtgattgtggatggtcatagacgaggccaagaagcttgtattgaagctggtttaattcatgtctgcttaaagcaccttcagagttcatgtcctaatgattcacaaactgaaccccttttccttcagtggctttgcctgtgtctggggaaattgtgggaagacttttcagaggcacaaacaatcggtttgcaggaagatgccactactatatttgctcctctactgtctgaaccccagccagaggttagggcatctgctgtttttgcactaggcacccttcttgatgtggggtttgattcatgtagaagtgttggtggagatgaagaatgtgatgatgatgataagtttagggctgaagttagtatagttaagagtatgttagatgttgcttcagatgggagtccattggtgagggcagagggtgagatggatctgagacatctttctgactctcttttgttccaactgtcagctctagcacgatttgcttttggccacaacaagcacctgaaatctattgctgctgcatattggaagcctcaagctaattctttgattaattccttaccttcgttgactaatataaaaggttcggttggtggatatgctaaacagaaccaacacatgcctcatggaagtattgtttctcctcaaattggtcctatcagggttggaaatgacaactctccagtggttcgagatggccgcgtctcttctagcagtcctctcgctggttcaggaatcatgcatgggtccccattgtctgatgattcatctcatcattctgattcaggaattctgaatgatggtttcagcaatggagtggctaaccacactggaccaaagccctttgacaatgcattgtattcacaatgtgtacttgctatgtgtactttggcaaaggatccatctccacgcattgcaaatcttggtcgccgggtactgtccataataggtattgaacaagtggttgcaaaaccattgaagtctagtggtgttcggactgctgaatctacagcttctccactggctcgttcatcttcttggtttgacatgaatggaggacacttgcctctgaccttcagaactcctccagtcagtcctcctcgcccaagttatataactcgaatgcgtcgagtttgttcattggagtttaggccccacctgatggattctccagactcaggattagctgatccactcttaggttctggtggagcttctgggacttcagatcgaagctttcttccacaatcaactatatatagttggagttgtgggcacttttccaaaccacttttaactgctgcagatgatagcgaagaggtatcagccagaagagaagagagggaaaaatttgcattggagcacatagcaaaatgccagcactctgctgttagcaggctaacaaatccaattgctaaatgggacataaagggtacacaaacagcattgctgcaacctttctctcctatagtgatagctgctgatgagaatgaacgtatcaggatatggaaccatgaggaggcaacactactgaacagttttgataatcatgattttcctgacaaaggaatttctaagctctgccttgtaaatgagcttgatgagagcttgcttcttgctgcttcatctgatggaaacattcggatttggaaagattatactctgaggggtaaacaaaaacttgtcactgcattctcttcaattcatggtcataaacctggtgtgaggaatctgaatgcagttgttgattggcaacaacaatgtggttatctgtatgcatcgggtgagatatcatctattatgctatgggatgttgataaagagcagcttgtcaattctaaatcttcatcatcagattgcagtgtctcagcattggctgcatctcaagttcatgggggacaatttacagctggtttcatagatggttctgtccgactttatgatgtcagaacacctgatatgcctcatacacaaagagtagaaaaggttgtggggattggctttcagcctggattagaccaaggaaagattgttagcgcttctcaggctggggatatccaatttcttgatataagaaatcatagcagtgcctatcttactattgaagctcataggggttcactcacagctttagcagtacatagacatgccccaattattgccagtggttcagcgaaacaactcattaaggtctttagcctggagggtgatcaactaggcaccattcgatactatcctaccctaatggcccagaaaattggttctgtaagctgcctcaatttccatccataccaagtattacttgctgctggtgctgcagatgcatgtgtttgtatttatgctgatgacaacactcaagctagatga

SEQ ID NO: 53252 - DNA, 2565 bp, Glycine max
  Peptide Sequence Number=SeqID_144937
atggccacgtcatcactttctggcaacttcagccttctccgccacagcgagactcaatcccgctcgctgctgttgctcggtggcagctctgtcaagctcttcaggtcgaagcacgaggccagcacgtgccatggcgcacgcgtcgctgccgccgtgccacgtgcttcggcgcctgaggtggcggtggttgagaaggggagggagaaagtgagggtgctgaagctgggcctcatatgtggcggtccttctgctgagcgtgggatttccctcaattctgctagatcagttcttgatcacttgcagggggatgatttacacgtgagttgctattatattgattgcaatctcaatgcatttgcaatttcttcagctcaggtatattccaacacccctgctgattttgattttaaacttgaaagccttgcccaaagtttccagactttgtctgatttagcaaagcatctagcaacagctgtggacatagtatttccagttatacatggtcaatttggagaagatggtggcattcaggaattgctggaaaagtataatgttccatttgttggcacaggatcaaaggagtgctgccaagcatttgacaagcataaagcatcattggagctcaggaagcatggattcataacagtacccagtttcttagttcaggggtatgaaacagacaaatcagaactatcagaatggtttaaaaagcaccagctggacccagacttagggaaagttgtggtaaaaccaacaagaggtgggtcaagcattggtgttggagttgcatatggtgtgaatgattctcttgtaaaagccaatgaaattatgtctgagggaatcgacaagaaagtgctaatagaaatatttcttgaaggaggaaatgagttcacagccattgtccttgatgtaggatctgatttagatagttttcctgttgtactacttccaactgaggtggagcttcaattccgtggtgcaaatgatgtgaaagagaatgatgcaatatttaattaccgtaggaagtaccttccaacccaacaggttgcttatcacactccaccacggtttcctttggatgtaattgaaaatattcgcaaaggagcatctctgttatttcaacggctttgcctgcaagattttgcacgaattgatggatggtttttgccaaattcaagttccaaattatcaccattttcccaaagtgagtttggaagaacagaatctggtgccataatattcactgacattaacatgataagtggtatggaacagaccagttttctatttcagcaagcttctaaggttggtttttctcatacaaacatccttagaagcattattcaccatgcttgcttgcgatttccaaatcttgcatcagttagtggtatatcaggtcagcttccaagcaggtcaaaatccttacaacgtaacaagtctttttctcgccgtgaaggaactcgaaaagtgtttgtcatttttggaggtaacacatcagaacggcaagtatctcttatgagtggtacgaatgtctggctcaatttgctagccttccatgatcttgaggtaactccatgtttgctttcccctacaagtgagtgtgcatctagcattgatatgggaaaaaaggctgatgatgtaatgaatagaacagtttggtcattgccttattctcttgtgctaagacatactactgaggaggtactagatgcatgcatggaagcaattgagccggaacatgctgcaataacatctgaactccggaagaaagtaatgaatgatcttatggagggtttgaaggaccacaattggtttaccgggtttgatattgctgatgatctgcctgtgaaattttcattaaggcagtggatcaagctagccaaggaagtccaagcaacagtttttattgcagtgcatggaggcattggagaagatggtacacttcaatctttgctggatgctgaaggagtgccctacacaggtcctggtgcaatggcatcaaagatttgtatggacaaagttgcaacctctgtggctttaaaacatcttgcaaattcgggagttcttaccataaataaggatgtcaggcaaaaagatgatctctctaataagcccataaatgatacatggcatgacctcaccagaaagctacagtgccaaacattatgtgtcaaaccagcaaaagatggatgctcaactggggtagcaagactatgctgtcccgaggaccttgcaatatatgtcaaagctctggaggactgtctactaagaattcctccaaattgcttatcaaaggcacatggtatgattgagatgccaaaccctcctccagaacacttaatcttcgaacctttcatagagacggatgaaataattgtgacatccaaatttgaggatgcaactggtcatggcctcacttggaaaggacacagcagatgggtggaaataactgttggcgtcataggaaaacgtggatcaatgcactcgctaagtcctagtgtaactgtcaaggaatctggtgatattttgtcacttgaggagaagttccaaggttggtctccatag

SEQ ID NO: 53253 - DNA, 1272 bp, Glycine max
  Peptide Sequence Number=SeqID_144938
atggcattaactatatgcgttttgctcatcgcccgcagcggacctctcgcgctccagtctgccaccgccgccgccggtttagtgcagccggggctttacaccagcaagtactggatcaacggcattcggttctactcgtcggcgttccaggacttcatcgccggcggatacctctcgccggagtcgaaggctctgtgcgtggaaacgccgaccggacgcgacgtcttcgcgctgagggagatcggcgaagccgctcgtgaatcggcgaagccggcagagttcgcggctgagatcggccggacgctgagaccgggaggtttcgcggtgttccatttcgcgatccctaaagatacgtatagtttcaattcgttccttgatttgttcaattgtttcaaagtagttaagttgcatggcttggaaggctttgattcttcgatgccgtatatacgtgaaattgttttgaagaaagagtgtggtgatggtgctgggaaattcgatttcgatgattcaaatggaaagtgttatgttcctggttataagcatgatttggttaagatagctgagccattgattgaggaggagccattgaagccttggattacattgaaaaggaatgtgaggaacataaagtaccttccttcaatggctgatataagctttaagaataggtatgtgtatgttgatgttggagctagaagctatggctccagcatagggtcttggtttaggaaacagtaccctaagcagaacaagacctatcatgtgtatgcaattgaagctgataagacttttcaccaagggtacgggttgaagaaggggatcactctggttccttacgccgcatgggtgaagaatgaaaccttgatgtttgagattcatcgcaatcccagggagcatgttgaggttaagggcagggggatgggtaggattcagcctttgcagtcatcgttggggaagggggagtttgatggcaaagtggagaagatacagggatttgattttgctaattggttgaagaagatggtttcgaagaatgattttgttgtgatgaagatggatgtggagggtactgagtttgatctgattccaaggttgattaaaactggggctatatgtttgatagatgagattttccttgaatgccattacaataggtggcagagatgttgccctgggcagaggagttcaaagtatgagaaaacatatgatcaatgcttgcagctcttcaattcccttagacaaagtggagttcttgttcatcagtggttctaa

SEQ ID NO: 53254 - DNA, 330 bp, Glycine max
  Peptide Sequence Number=SeqID_144939
atggagagcagcagtgggattgagagcacgggggggcgtgcgccactgtcaggggtggtggcagattgtgtgaagcggtggttcaaagacactctgaaggaggctaaggcaggtgatgttaacatgcaggtcttggttggtcagatgtactatcatggctatggtgttcccagagatgctcagaaggctgatgttattggttggggaatgaagggaagaatttggctgactaaagcgtcgagggttaggtcttcagtttggagagttggtggtaaacgtccaggttataatgcaagcgactctgagtctgacgaagaagaagattcttaa

SEQ ID NO: 53255 - DNA, 1413 bp, Glycine max
  Peptide Sequence Number=SeqID_144940
atggtagatacagcaaggctttttgccaggcatggtgctagtgttaccattatcactacccctgctaatgctttgacattccaaaaagccatagacagtgacttcaattgtggataccacattagaactcaagtggttccattcccttcagcccagcttggcctccctgatggggctgaaaacctcaaagatggcacttccctagaaatacttggtaaaatcatgtatggaatatccatgctccaaggtcaaattgagcctctatttcaggatcttcaaccagattgccttgtaaccgatgtgctttatccttggacagtggagtcagctgcaaaactaggcatcccaaggctttacttttacagcgcaagctacttcgcaagctgcgccacatattttatccgaaagcataagcctcatgagaggttagtttctgatacgcagaagttttcaattcctggccttccacataatattgagatgaccaccctgcagctcgaagaatgggaaaggactaagaatgaattctcagatttgatgaatgcagtatatgaatcggagagcagaagctatggaacactgtgcaacagttttcatgaatttgaaggtgagtatgagcttctttatcagagcaccaagggggtcaagtcttggagtgtaggaccagtttgtgcctcggctaacacaagtggtgaagaaaaggtctataggggacaaaaggaggagcatgcacaagagtcagagtggctaaagtggcttaactccaagcagaatgagtcagtactttatgtaaattttggaagcctcaccaggctctctcttgctcagattgttgaaattgctcacggactagaaaattctggtcatagtttcatctgggttgtacgaataaaggatgaaaatgagaatggagacaattttcttcaagaatttgagcagaagattaaagaaagcaagaagggttatatcatatggaactgggcaccacaacttctcatattggaccaccctgccatagggggaattgtcactcactgtggttggaattccattcttgaaagtgtcagtgctggattgccaatgatcacatggccaatgtttgcagaacaattctacaatgagaagttgctagttgatgtattgaagattggagtcccagtgggatcgaaagaaaacaagttctggacaactctgggcgaggttccagtggtcggaagggaagagattgcaaaggctgtggtacagttgatgggaaaagaagagagcacagaaatgaggaggagagcaagaaaacttggagatgcttccaagaagactatagaggagggtggatcatcttacaacaacttgatgcagttgttagatgaactaaagtcattgaaggcatctaaggcaattgagaaagaaacttga

SEQ ID NO: 53256 - DNA, 777 bp, Glycine max
  Peptide Sequence Number=SeqID_144941
atgggttccgaagaagtagtagaagaaccaactccaaaaactccaaaccaaacaacaacaccggaaacgacgtcgtcgagttccccccgaaaaattaaaaccaacactcccaccgaaaacggtcacgtgtccgttactcccaccacgctctcaatcgtgcagccacattcacttctcccaaagccagtgcctccaagaacgacttacactcaaaacgacgtcgtcgtttcctccaccacattcggaaaattcctccgcaagcgcagcaacgacctgtcgtccgcgatcagcaaggggatctccacgctgaagcactccatcaacgaccaaaacgacaacaacggcgtgacggagttcaacctgtcggggctaaaggtcttcgtgacggtgaaaaacaaaaacgacgcgtcgtctaattcgcttgcgcgaatgaaaatcagcttcttctcgcgctcgaactgcagagagtgttgtgcggtgagaaggttcttcagagagagagcgctgaggttcgttgagataaacgtcgacgttttcgcggagcgggagaaggagctgagagagagaacggggagcgcgacggtgccgaagatcttcttcggcgagaggctgatcggaggcttggtggagctgaacgcgctgaggaaggacggcggcgaggagttggagaggcggctgaaggaagcgggtggccaagggccggcggcgccggcgtacggattcgacgaggcggaggaggaggagatgccggaggaggagattgggaaggtgggttag

SEQ ID NO: 53257 - DNA, 294 bp, Glycine max
  Peptide Sequence Number=SeqID_144942
atggatgcttataggaagcgaaggaagccagaagaacccatggtaaagatggttaacaataggaaggataagctagtgaagtcatcttcaaagcaatattgtcagtcaactccaaccccaagcatgaccacatattctcttatatcaaaccatatgaacaaaagtcaagggataccctggcaagatggtaagtatatcataagttctcatcatcgtgaatgcaacaccagtctcttcgattttgaagttcccattcaatttggtcaaggacgaactaaaagcataaactattag

SEQ ID NO: 53258 - DNA, 342 bp, Glycine max
  Peptide Sequence Number=SeqID_144943
atggaggaaaagaaagaagctttaaggaaggctgcttctgaaagcaccatagcagactcaacattgcaagacaaattggctgaactgaactctataaaacctcggccatatggaactatacacgcagctaacgaagtctacaatgaagcgggtatagttggattttggaagggagtcatccctgcccttattatggtatgcaatccatcaattcagtttatgatttatgagagctcattaaagcatctaagggaaaaacgagctgctaagaagcaagggaatacaagtatatctgctttggagctgtgcatatcagtaaataagcatcctcctgtcctttaa

SEQ ID NO: 53259 - DNA, 3213 bp, Glycine max
  Peptide Sequence Number=SeqID_144944
atgagcgacggaggaaaacgacaaggtggaagagcgttgccgccgccgccaagaggccctccgcctcctcccccctctcgccctcgcctcgaacccgtcgatcgcgaaaaggtactcactcttccttcttcttcttcttcttcttcttcttcaggagagagatgcgaagaggaaaaagtgttcactaagattgggagtcaccattccatggaagactttgccgtcagaggcaaagagcccaaagacgaggttcagatttacacctggaaggacgctactctccgagaactcaccgatcttgtcaaagaagttgctccggctgcaaggagaagaaacgccaaactctccttcgcctttgtattccccgacaaaaacggccgtttcaaagttcaagaggtgggcaagacattatcttatggaaatggaagattagatgatggcaaggctttagccgaacttggttttgaagtaaaagattttttttcttcttttctcgaatttatgcttgatcttttcacaaattctgttgctgacccagttcgtaaatgtgcagatcgcgtccgaacgaacttcaccactcagtctgttgcttgtgctgatgcattgcgccgtgaaccctcgctagctcactctccaatcagatccaagtttgtttgtgttgattctccgatccgcaatgacgcagaggaagaacagaggcaaggcttcgtgttttcctcttctcggtttcgtcctcctctgcgttctcgcgccgttttttttcttcctctcccggaggctctacgccgccccgggacacaccttgtttgggtgggaacaatgaaacactattttaaggtgaaaggcatggatgaagacaagaagttggaagcaatgttaagggtagtggagagaaaagctctatcctggttgcagtggtgggagtcttacattgaaaatttgacatggggagagttgaaatacctaggtggaattttcttcagtgtgttgagggttgaaattatgggcagacgtgaggttggatgcttgaagaagggtattggggcaccatggaaggaaatgtgggatccaatagagatggcaacatcaaggaccaggccaagcaacaaaatacctgtttcaaacaatagtcactactcactagaagagattcagaagaaaaggatgaaaggattgtgttttgcatatgatgaaaagttgtctcctatgtgtttaaaaacaagaacctcaaagatcttgatgttggaggaagttgagcctgtgaagccatgggaaatggtagtcggtgaagatgtggtgttggggatggagtggttggaaaatttaggaaatgctaaagaaaactttaaggagttgtccctgaaaaccaagaaaggagtaatacttcctaggataacttacatgtgtaacaagctggatatcacaaatgatttggggcctttcagtcttgacaatttcagaaaaaatttgtctgcttcatggagagttggattaggaaattcaaacgctgaacatgagctaaaccaacaaacaacacatgttagacaagaaaagccagaggtgaaggaagataatccttctcagtggactgatagttccgcacagcaaacccgaaggcatttaatagagaaaaggcgggaaaagcgtgctgctgagttggtaaaaaaggataatgaagtagctgtaagagtcgaaaatacagctattgaacgctcaaaatctgttgagtcagccattataggtaaatacaacatttggaggaaagaatttgagaatgaaaatggcgattctactgttcggttgatgcgagaccagatcattatggctagggtatatataagcattgcaaagttgaagaacaaggttgaactgcatgaagaactaatttcccggctcaaagagagtcaacgtgctttaggtgatgcagtttctgatgcggatctacatcacaggtctgaagccattacacatgggaaaataaaggctatgggtcaagttctatcaaaagcaagagagcaattgtatgactgcaaattggtcactggaaaactaagagcaatgctacagacagctgatgatcaagttaggagtttgaagaaacagagcacattcctcagtcagttggctgccaagaccataccaaatggaattcattgtttatctatgcgccttaccatagattactatctccttcctcctgaaaagagaaagttccctgggagtgagaatttggagaatcccagtctttatcactacgcactgttctcagataatgtcttggctgcatctgttgttgtcaactcaactattatgaatgctaaggtgacttgggctgtctttttaaccataccagatccatcgaagaatgtttttcaccttgttactgataaactaaattttggagccatgagcatgtggtttcttttaaaccctcctggaaaagctacaatccatgttgaaaacgttgatgattataagtggttgaactcatcctactgccctgtcttgcggcagcttgaatctgctacattgaaagagttttatttcaaggcaggccatccaaactcactttcttccggggcttccaatctgaagtatagaaatccgaaatatctctcaatgctcaaccatctgagattctatcttccacaggtttatccaaaattggataaaatcttatttcttgatgatgacattgttgttcagaaggatttgactggattatgggctgtggatcttaatgggaaagtaaatggtgctgttgaaacttgtggtcaaagctttcaccgatttgacaagtaccttaacttttcaaatcctcacatcgcaagaaattttgatccaaatgcttgtggttgggcatacgggatgaacatgtttgatctgaaggtgtggaaaaagaaggatatcaccggcatatatcacaagtggcagaatatgaatgaagacagggtgctgtggaagctggggacgttacctccggggctaataacgttctatgggttgacacatccactagataaatcatggcatgtacttggtttgggttataatccaagtttggatcgatcagagattgagaatgcagcagttgtacactacaatggtaatatgaagccatggttagaaattgccatgacaaagtatcggtcttactggaccaacgtctttgctagaatgatgatcattgtcttaaagcttagaagggatagg

SEQ ID NO: 53260 - DNA, 399 bp, Glycine max
  Peptide Sequence Number=SeqID_144945
atgcagttttcatctttatcaatccctgtaaatatgcacattttaaaacatttgaagcaagaggcagcaaacatgatgaagaagattggccttcttgaagctgcaaaacggaagttcttgggggaagggttgggggcttgctccattgaggaactgcaatggatagaacaacagttggagaggagtttaagtaatgttagaacaagaaagatccaggttttcaaggaacaaatcgagcaactaaaaggaaagcatggaatcaatctacaaacagaaacaaagaatcagaatgtgaatcaaccccaatacaatgcaggtagtccaagttcagatgtggagaccgaattgatcattggacttccggatacaagaacaaggcgcatcgttcatcaggtctag

SEQ ID NO: 53261 - DNA, 459 bp, Glycine max
  Peptide Sequence Number=SeqID_144946
atggaaagggtagctagccccacggtgcacatgaggtgcagtgctatggaactggcctcttttaaagttcaacgctcgatgctggcaacaagggcaagcaatgcaatgccagcaagcacgctcagtagtggtgatcagatgaaagctcaactggctgatggcaaaagtgagaggggtctacacccccaaaaatggaaactggcattaatcttccttgaggaacctgatgacgccgccacttctcaccacgaccattttccagatcccaacccgttcaacgaggacgtcgaggatgatgaggatgactttagagacttcgtcggcttcgaccactcgtcagaggaggcattcaaggagctcgaggtggactataaggacgtcatcattttgaaggtgcacaacttcaccattgtcatcgagaacaaccgttttgtcatggtcaagatctacacgccctag

SEQ ID NO: 53262 - DNA, 399 bp, Glycine max
  Peptide Sequence Number=SeqID_144947
atgaaatcttgccttggatcagaacgtgcaatgatgccaattgatatactcaactgggatttggagaagaaacaagaaaaagttgcaagaaggacaaaaacaagacacaacttcaaagaaccttccaaccagagtctaaacactgacattgacaccatgcgagtcaaaacacatgctaacactctaccctacaaggttacaactatgggaaacacttcacactctcacaaatccctcaccggctacactttcagatatcaaattcaaacgtgtgtccaaccaattccattcacagcacgtctggttaagcaattaatagcacgttcggcaaggttttctgaatctagacaaaaagctatatcagttgtagcatctacacatttcacaaattcaacgtaa

SEQ ID NO: 53263 - DNA, 433 bp, Glycine max
  Peptide Sequence Number=SeqID_144948
atggaagctgtggactttctggataaattcttggccatgaatcctgattccagtctgtatcttgcttacagtggtcgtgttcaatatcatgacttcttgagggttttaagacttaaggcttgcccactatctgcaaagttcttgtatggatctgcccatgtcatgtcacaaccagggttccatcaagcctgtgaagaagcctttgctggctgtggtggtgcagtaaaggcctatgttgttgaacaagagttacgagatttcatccaacctgttatcctcaactggagtgaggatgaggtccatgagctttttatggtatttgacaatgataatgatggaagaattgacaagaatgactttctttcatgccttagaaaaactcctcttctcatagcattttttacacttcaactgcagcaaaaggaatttgaag

SEQ ID NO: 53264 - DNA, 531 bp, Glycine max
  Peptide Sequence Number=SeqID_144949
atggatgtaaagataacaataatgactcaagaaattggagggaatgggacaacatcatcaacttatgcttattggcaaactaggggatgcaacagatatcttttcatgttcttgcataccgattggatgaatgctgcaggaggagttctgagggattggaagggtgaatttattcttggtttttccgatgccttgatcgagtgttcttccgcgttagaggctgaattatgtgccatcaagattggaatgcaaacagcagtggcaagggaagccatccagatcattaatgctgacaagggtgcttttcttcgatcttctatccagcacatgactcggatggttgaccggatttgttggaaccatgtatactgggaaactaattgggtagctaattcggtagcagatggtcttgttaaacatgggttatccttgtctaaagaccagagcattagagtctttgaatctcctcctgatctcattgagtctcgtttgtatggagatagaattggaaaaatatactactgcatatga

SEQ ID NO: 53265 - DNA, 489 bp, Glycine max
  Peptide Sequence Number=SeqID_144950
atgggtgagaatcagatcacaccaccgcaaaatcctaaattcaattttttgatcttgcccgtcgcagccggagtggaaattgggagcaggagggacgaggagcctgccataaacagcaccaacatctttgctgtgctcggaagcctcaagaagaagaaggaccagcagggcccgtccaagcccaatgacaagaaggacgtcttttgggcccccgcgcctctcacctccaagtcatgggctgatgttgacgacgaagatgacgacgactactatgccaccatcgctcctcccgaatctgtttgggtcgcgccgattgtcactctaaacgatgttgctgctgctgaggttggaccccaagcaatctatgtggttggtcgagacgatgatgaatcaattgctgctgggagtgaaataagtgatgctgcaagctgggaaactgttaatgacgatgaaatggaagtctttgaggattccagagaggaagcctaa

SEQ ID NO: 53266 - DNA, 306 bp, Glycine max
  Peptide Sequence Number=SeqID_144951
atgtctctcaatcaagttcctgagaaaagaaagaaagcggaatggtgtgataaaaatattgagattatgttgaaagtgtgcatagaagaggtgaatgctgaaaataaacctcacaatcacttcactaagcttggttgggcaaatattgcaaaaaagttcaataaggcaacaaatttgagatatgaatataaacaattcagaaataggggcggcgtaagggcattcattgaattcaacaatatgttgaccaaggtcgtttcaggactcaaccacggaataatagaattgagtattatggagaactag

SEQ ID NO: 53267 - DNA, 792 bp, Glycine max
  Peptide Sequence Number=SeqID_144952
atggaccctgacatcattgatattccacctccaacgaagaataatgtttctaattccatgaaacagaatgaggcttcttcttcttctctttttttatgtcgtcgtggcatgcaatttgtggagtttgagttgttagggagaaagaggaagcgatccaatacactcccgaagcctgttcccactgcgccaccaccaacaccatcaccctcacctactaccaccgcggcggcgtgcggtggcgcaccccccacctgctttaactccggcacgctctccgccctcatccggtgcccctccggcgacacgagcggcctcaacttcaacctctacctctcctccctggagggaaacaagtcccaggacgagatcgacttcgagtttctcggccgcgacaggaacatcgtacaaacaaactacttctccgaaggtgtgggaaacatggaaaaggtccacgttttagggttcgatgcttccgatgggtttcatgagtatgggattgtgtgggggagcgacgcgatcgagtggcgcgtggatgggaacctggtgagaaggctatgtttttgtacgcttcgatgtgggatgcaagttgggttaatgaagggaagtggtgtgggaagtactaatgctcttgaaacaaaacatgtgaggcatgcaacgtttaccatcaggcattctcttgatgagtccaatactgcagaaaggaacacagatagtgatcagaggctagttgaacttgattctagtaacgactcccaacaaccaactttgggagaaccagaagctagacagtga

SEQ ID NO: 53268 - DNA, 852 bp, Glycine max
  Peptide Sequence Number=SeqID_144953
atgccgatgacgaagccgaagccgatgccagaggagcagaagatggaatacttcatgcaagtcactgaagcaccgttgtccgtcgccgttcagaaattagagaaacatggaggcaatctaaataaagctcttgaagacttttatcaaaaggattcgctccgaaacccaagtcaaaatgagcaacatcgtagccaaaagggcttaacagtggcggagtttttggaagcatatcccaaaaaaacactggcggaattgttggacgaaagcactgagggatctttttcgtggaagaaatgggcagctcccaaaattcctccaagtcattctcagaaaacagaggcggaattgttggacgaaggcactgagggatcttcttcgaggcagaaatgggcagttcccaaaattcctccaagtcattctccgaaaacactggcggaatttttggccgaaggcactgagggatcttcttcgtggaagaaatgggcagttcccaaaattcttccaagtcattctcagaaaaaacaaaaagctaagtcgggccagcttccaatgtcctcgtcctcaaagggccctgtcaaacaaaaagctatcgatccattaacacggcctaaatttccgtatgctcgcataccagctgataaacgatgggagtacttggaacgactttggagggattatgcggatacacgtgataatattcatattgctgttcacataccgggtggtggttgcgttcaacgtatctttctcaaaactgacaaacttaagtttaaaggaatggatctcagctcctttttcgtcccaaaacagagaaagaacaacaagaaaacaggaacaaacaccacaggatag

SEQ ID NO: 53269 - DNA, 132 bp, Glycine max
  Peptide Sequence Number=SeqID_144954
atgatcatcgtatgctacacagataatgctccgatggtgtcagaatcttattggttccctcacgcaaatgccataagctttgcattaaatgatggcaacgcttctcccaacagcttctgcaccctcatttaa

SEQ ID NO: 53270 - DNA, 375 bp, Glycine max
  Peptide Sequence Number=SeqID_144955
atggggattttgaaggaagatgcggaagtgaaagactttaggagagatcccaatgatcaatatcttccactagcatttgttgtggttgagaatgaaataaatgattcgtggaagtggtttttggagttgctagtgcaagacattggagaaattgatggattggtgcagactttaagatcaatgggagcaggtgatgaacaccatcagacccaatcgacgaagcttcaactaatgccatccatgatgaacacgaacaccatgaactctattcgaccctctcaaaccaccacgagccaccaccaactcggatttgttctcatcaacaacctagcttctattattctcctcgtccttgtctcagatcaacaaccttaa

SEQ ID NO: 53271 - DNA, 231 bp, Glycine max
  Peptide Sequence Number=SeqID_144956
atgactggccttaatgtcaccgtcgtcagggttagagatattcttcataaactaattacagcccaaagactcacaatgacacctccctcacaagtatacttgtgtcatggctacaatgtcatcttccaccgcataaactcatgcacgcaccctcctcacaacaccgcaccaccacctcctttctttgcgtgttaccatctatgggtttgggtttctggtgtggaacaataa

SEQ ID NO: 53272 - DNA, 423 bp, Glycine max
  Peptide Sequence Number=SeqID_144957
atggatacgaatcaggaagaagaaaggtttcaagaagcaaggaagaagaaaggtttcagaagcaaggaagaagaagggttttggaagaagctgagggggttttttgtttggagttctggcgctattcatggagttacgcctttaaaaagggaaaaacaatataataagaatcaaggattcccaagtgcaaggaagtatttacgaagtacaaggctaagacaagaaagagggcttcgaatcattgggcgattcgaactggtgtatactcgagtcgaagtcaaggcagccagatttctggacttagtgcaatttctgacaaaacttcacaaaatcagttcgacttcgagcaatgtgggtaaccgttctaaggagcagttatgtgcatgcaaggtgtacgtggcaggacacttggcattaggatag

SEQ ID NO: 53273 - DNA, 1560 bp, Glycine max
  Peptide Sequence Number=SeqID_144958
atggctaccacttctgcttcattcgctcgcttctccgtcatatcgcgaccttcttcgtcaaatccccaattcatcctcttcaacgccgctccccgaaccggaacccctcattcccgaaccggttcggcccggttcaggtgcttggccggccagaccgggttcttcacgaaactagggcggttgataaaggagaaggcgaagagcgacgtggagaagctcttctcgggattctccaagacccgcagcaacctcgccgtcatcgacgagcttctcctctattggaacctcgccgacaccgaccgcgtcctcgacgaactcgaagaggagcgttcggtgaataagccttccctggcgtggaactcttacttgcttgatgctttccagtggttctgcttaggggcttatgagagattgatttggcaagtcaagctaggatttgaagtcaggatgaggggatttaccttgcccgattctttcctactgatgcacgtagaactagttgccctttcttccacactagaagtgaaagtccagccaagttcttggagaatctatagttctaccaaccgagctatctcgatcattcttgacgcaaagtacaaagtatcgctagtaaggcagcaagaagaagaggaggctaggccattaacgggttcgttagaattgcctctccatccaccactgaaggaagaatcccaccattctgctgctcttttagtgtccgattttggaccaagaatcactattaaaatagtggagaatttgcgtgaggatatattttcagggaagcttaaatcagggaatgagataaaggaagcactgaagaggaacgttttggaattattaacttccaaggggagtaaaactgaacttcaacttggatacaggaagccagctgtaataatgatagttggtgttaatggtggagggaagactacatctttgggaaagctggcctatagattgaagaatgaaggggctaaggttagattgcattatttgagtgttgctatggttcatgattttgatctccatttgaaaatattgatggcagctggtgatacatttagagcagctgctagtgatcagttggaaatatgggccgaaaggactgggtgtgagattgttgtggctgaatcagagaaagcgaaagcatcatcagtgctttcacaggctgtaaaaaagggaaaagagctaggttttgatattgtattatgtgatacatctgggcgtttacacactaattacagcctaatggaagagttgatttcctgtaaaaagtctgttgctaaagtcgttcctggtgcacctaatgagattctactggttctggatgggactaccggtttgaatatgttgccacaagcgagagaattcaatgatgttgtgggtgttactggtttagttttgaccaaactggatggttctgctagaggtggctgtgtggttagcgtggttgatgagcttggaatccctgtaaaatttgtgggtgttggtgaaggtgttgaagaccttcaaccttttgatgcggaagcctttgtcaatgccatttttatgtaa

SEQ ID NO: 53274 - DNA, 783 bp, Glycine max
  Peptide Sequence Number=SeqID_144959
atgagtaaggtgaagattttggttgtgggagggacatgttacttgggtcagcatctgctacaagtctatgcacatgccaatgccaatgccaatgccaatattagtggaactccttttgttttcgatctcgctttcacccatcactcctctcctcctccccaccctctcttagatgccattccttcctcccttcctttccaagtggatttgaaaactggccttggatttgaagccatttccaacacttttggccaggttcctcgtgcttgtgaaatcgatcctgccactgcacatgctattaacttgccatcatctcttgtaaaatggttgcaaagctttgaaaagagaactactcttctcattcatctctccacagatcaagtttatgaaggggagaaatccttttacaaggaagaagacattgctgttccagtaaatgtttatggcaaaactaaagtggcagcagagcagtttatttcagaaaattgtccaaactttgcaattttgagatgcagtatcatctatgggccacaaacagtctcaccagttccaaaatctcttcctaatcagtggattgatggtgcccttgctaaagtagaaaaagtggagttctttcaagatgagttccgttgtccaatttatgttaaggatcttgtaaatatcatactagctttaactactcaatggatatcagagggcaagcaaatgcaattgttacttaatgttggtggagctgatagggtgtcacgtgttcaaatggctgaggctgttgcacaattttga

SEQ ID NO: 53275 - DNA, 645 bp, Glycine max
  Peptide Sequence Number=SeqID_144960
atgagtttgaggaatgaattgcatggtccacgccaaaatctgcgtgattggtacaggtacatgagccaagcagcactagccatacacaaggcaaacccaaatgtgctagtggttatctcaggtttgaactatgacactgagttgcagtttctaaaaagtaaaccattgaagatagacttggctaagaaaatggtgtttgagacacatttgtactcatggtctggaattgggaccctcaaattgaaagagatatggacaaagcaaccattaaacaggatatgtgccaatagtattaaagggataaaccacagaactgggttccttaccactgacaagaatgcgactcctttgatctttacagagtttgggtttgatgagacaggttcttcagaggaagacaacaggttcttgacatgccttcaaacctatcttgttggaagagatatggactggggtttgtgggcatttcagggtagctactatgttagaaatgacaaggttcaacttggtgtaatggatgacacttggcatcacctgagaaaacccaacttcactgacaagtttcaacttttgcaaaggaagaatcatggtaagcattttgagttattaaatggagttattgcactagctacttcagttggttga

SEQ ID NO: 53276 - DNA, 474 bp, Glycine max
  Peptide Sequence Number=SeqID_144961
atgaaaattccaagcaaggtagcacactttgtttggaggctggttaaggatagactaccatcaagagcaaacctaaggagaaggaacatgcagctagatgactaccattgcctgttttgttcgagtcatgaggaggaagcgtcccacatattttttggctgccaaagaataatgcctttatggtgggagagccttgcatggacagaggttgtaactgtgttccctacatcacctaaggaacactttgtacaacattcatacggtaattcatcaggaattgtccaaaacagatggtggatttgcaaccactgccttgacagcagccagaccaagagcttcagcaatggcttggaaaccaacctggaaacagagattggtatttcacaaaaagacaacatagatgatgatgacaatgagagaagtaaggtgaagtcattggctttcaatcaagcatttaacatgaaccacctctaa

SEQ ID NO: 53277 - DNA, 918 bp, Glycine max
  Peptide Sequence Number=SeqID_144962
atgttggagggtgcaagaagaacagcacactttagggttgtgattgtggatgcatggcaagttgagaggtttcaaggctcaaatgctcccactccacccttgttaaggtattgctcggatcagtggaacttggatattgtgttccctgattggtccttttggggatgggctgagataaatataaaggcatggaaacatgtcctaaaagaaatcaaagaagggaacgagaagaccaagtggaaggacagagtaccatacgcctattggaagggtaacccttttgtgactccaactaggaaagacctcatgaaatgcaatgtcacagaaaaagatgattggaacactcacctatacatacaggattgggatcaagaatcaagtcaagggtacaagaaatccaacttaggagaccaatgcacccataggtctggcttccatgatttttttgtccgaggcatggtgccattagagcactattggcccattagagacaatagcaagtgcaggtctcttaagtttgcagtggaatggggcaacaacaacactgataaggcacaagcaataggggaagctggtagcaaattcattcatgaggacatggacatggactacatatatgattacatgtttcatctactgaatgaatatgcaaaactccaaaggttcaaaccaactatacctccaaatgctgtggagtattgtccagaaacaatgacatgtggtgtagatggtacacaaaaaaggttcatggaggactcattggtgaagtctcctagtgattcaaatccatgcactcttcctcctccatatgagcctattaacctacaagactttctagagaagaaagctaattcaacaaggcaggtagaaacttgggaagaccaatactgggagaataaaaaaaggggacaattatag

SEQ ID NO: 53278 - DNA, 1281 bp, Glycine max
  Peptide Sequence Number=SeqID_144963
atggagcaggcatttaaaagtttttttatcctccaaaggataagctctatatttatgggtacattaggaaggcatctccttcgacctatatataagcagattgcagagaatcaaaatgcagaaatattttctgccaatacactctttgttattcttgggaccagccttctcacagccagggctggactttccatggcattgggggcatttttggctggtttactactggcagaaactgagttttccttacaggttgaatctgatattgctccatatcgtggccttctactgggtctcttctttatgacggttggaatgtcaattgatccaaaacttcttgtttcaaactttccagtcattacaggggccctgggactcttgatatttggcaaaactttgttggtttctttaatcggaagagcttttggtatttctctcatttctgctatcagagtgggtcttcttcttgctccgggaggagaatttgcatttgtggcttttggtgaagctgttaatcagggcataatgtcttcccagttgtcctctttactgtttcttgttgtgggaatttcaatggctctcactccatggctagctgaaggaggtcagctccttgcttcccgttttgagttacacgatgttcgaagtttattacctgtggaaagtgagacagatgatctgcaaaatcatatcattatttgtggatttgggcgagttgggcagatcattgcacaacttctttctgagcaacttattccttttgttgcactagatgtgagaagtgatagagtgacaattggacgttccctggatctccctgtgtactttggagatgctggtagtcgagaggtcctacacaaggttggggctgaaagggcaagtgctgctgcggtaactctagattcccctggagcaaattatagaacagtttgggctctgagcaagcacttcccaaacgtgaagacttttgttcgtgctcatgatgttgatcatggattaaatttagaaaaggctggagctactgctgttgtcccagagaccttggaaccaagtcttcaactagcagctgccgtgcttgctcaggctaaacttcctacatcagagattgcagcgactataaatgaattcagatcccgccatctttctgagctcactgaactatccgaaacaaatggaacttcttttggatatggatataatagaactacgagcaaagccaaatctcaatccccagattcatcagatgatactcaagtctctgaaggtaaactggcgacatga

SEQ ID NO: 53279 - DNA, 626 bp, Glycine max
  Peptide Sequence Number=SeqID_144964
aaacacttgtgtctgtggtggaggaaggttctccatcttcagatcttggtgtggaggaagtgacgacgacaaccatggcacccatcatgacaacgacgacgattagcacccacgtgtgcgacgattatagccatgtcgcggccaacatggtcgtcgctctgctcattgacgtaatgaggaaaatcttggcggcggatcgatatttgaggactcagcagagtcgcgacaatacgccttgggattttttcacattcggctccaagtcttttggttgcattatcttatacaactctaagcataaaaaagcttcggtttcgtatcctttctattctagcattgttgatcttgcaactactagcgacgctcgaagaggaggtcttattgatgaaaaggaattggtcaagtgtttgatggaaggagaaattggaggtgctggtttggatgtctttgaaaacgagcctcgtgttcctgaagagctccttgaaatgaataatgtggttttatctccacatgctgctgctttaactgtggaatctatgatgaatttgtgtgaacttatgggagggaatttagaagccttcttctcaaacaagccacgaataactccagtaatgttggctgaataa

SEQ ID NO: 53280 - DNA, 192 bp, Glycine max
  Peptide Sequence Number=SeqID_144965
atggtgtactcgttgttgccatggaaggaagagtcgctgcactttgatgttgtcgtcgtggtgtcgttgtcgttagctcatgtggcggtggagcggtggttcattgatgtcgtgcggtgggtcgacgccgcttggtgggtcatcgtcgcagtgttgcggcggtgcggtggttcctccacgcggggatgctag

SEQ ID NO: 53281 - DNA, 165 bp, Glycine max
  Peptide Sequence Number=SeqID_144966
atgtcttttcaagagattgactctctgggattaagagaccgagggtttcatgtggtaaagaaatctgacacaaaggaagggttgtccttgtgtggttcagaacttgtaaagggattttgcaacatagtggaactctcaagcgggttgcttagggactggacgtag

SEQ ID NO: 53282 - DNA, 250 bp, Glycine max
  Peptide Sequence Number=SeqID_144967
aatgttgctaagcaacgtcatctatatctgtgtaagagtggtcaagttggtgcgcatgatccacactcgtctctttgcagtggcacaggtgaaatcttgcctcggtatgcatagtagctgcgtgatagcctccctctctggttgtattcgcacaggttgcaccctccaatatcagggggtggcccaggaactaataaaagaaaactactggccccttaaccgggagtacaagtctcggttaagcatttaa

SEQ ID NO: 53283 - DNA, 242 bp, Glycine max
  Peptide Sequence Number=SeqID_144968
gccattcgacagggagactcggaagttgcggagtcttggtttaatcaagccgctgaatattggaaacaagctatagccctaacccctgcggccgccaccgcggggggagctccaattcgccctatagtgagtcgtattaaaattcactggccgtcgttttacaacgtcgtgactgggaaaaaccctgggcggttacccaacttaatcgccttgcagcacatcccccctttcgcccagctggc

SEQ ID NO: 53284 - DNA, 372 bp, Glycine max
  Peptide Sequence Number=SeqID_144969
atgttgcggaactttacggattgcgcaacaatactctttttgacttccggaatgttgcggagctttacggattgcgcaacaatgcttgttttgacttctagaatgttgcgagactttacagattacacaacgatgggtgttaaaaattttgaggtggtcaagcgaaggtcgcatgccaacaaacaatggtccccagacgaaattaggagcctaagtgaagaacttcgtgactattatgaaggaaggcatagggcatatcctagacctcactcccattgtagagaaaaggaaagaaagcctcaagaggctaacattaacctcctatacttccatgggaaggacaatgtagaggctaacttagattggaaataa

SEQ ID NO: 53285 - DNA, 57 bp, Glycine max
  Peptide Sequence Number=SeqID_144970
atgggacaccttagggtgttgaggaaaaagccagagtttccaggaacctcggattga

SEQ ID NO: 53286 - DNA, 1959 bp, Glycine max
  Peptide Sequence Number=SeqID_144971
atgatcatcaagaaagagtacggcggtctggaattctctccttatgctcaggcgatggtgctgcaaaaactggccggcgtttccggcatcctggcgatcaccgtcggcgtgccgaactccctcggcccgggcgaactgctgcagcactacggtaccgaagaacagaaaaaccactatctgccgggcctggcgcgcggcgacgagatcccttgcttcgcgctgaccagcccggaagcgggttccgatgccggcgccattccggacgtgggcaccgtgtgcatgggcgaatggcaaggcaagcaggtgctgggcatgcgcctgacctggaacaagcgctacatcacgctggcgccggtcgccaccgtactgggcctggcgttcaaactgcatgacccgaaccgcctgctgagcgacaacgaatccccgggcatcacctgcgcgctgatcccgaccagcacgccgggcgtggaaatcggcaaccgccacttcccgctgaacgtgccgttccagaacggcccgacccgcggcaccgacgtgttcgtcccgatcgattacattatcggcggcccgaaaatggccggccagggctggcggatgctggttgagtgtctgtcggtaggtcgcggtatcaccctgccgtccaactctaccggcagcctgaaatccatcgccctggcgaccggcgcctacgcgcacattcgccgtcagttcaagatctccatcggcaagatggaaggcatcgaagagccgttggcgcgcatcgccggcaacacctatgtgatggacgccgccgcttcgctgatcacctatgcgctggtgcagggcgagaagccggccgtgctgtcggccatcgtcaaataccactgtacgcaccgcggccagcagtcgatcgttgacgccatggacatcgccggcggtaaaggcatcatgctgggcgaatccaacttcctggctcgcgcctatcagggcgcaccgatcgccatcacggtggaaggcgcgaacatcctgacccgcaccatgatgatcttcggccagggcgcgatccgctgccatccttatgtgctggatgaaatggcggcggcgcagagcaacgatctgaacgccttcgataaatcgctgttcggccatctgggccacgtcggcagcaacaaggtacgcagcttctggctgggcctgaccaacggccgcaccagcgccacgccgaccaaggacgcgacccgtcgttactatcagcagttgaaccgcctgagcgccaacctggcgttgctgtcggacgtttccatgggcgtgatgggcggcagcctgaagcgccgcgagcgcatctccgctcgcctgggggacatcatcagccagatgtatttggcttccgccgtgctgaaacgctttgacgacgaaggccgtcagaaagaagatctgccgctggtgcattggggcgtgcaagacagcctgcataaagccgaacaggcgatggatgatctgctgcgcaacttcccgaaccgctttatcgccggcgcgctgcgcttcgtggtcttcccgtttggccgcgtgcataccgcaccgtccgaccgtctggatcaccagttggccaagatcctgcaggtgccttccgccacccgcagccgtctggggcgcggtcagtacctgacgccgagcgagcataacccaatcggcctgctggaagcggcgctggccgacgtgatggccgccgagccgattcacgagcgtctgtgcaaggcggccggcaaaaatctgccgttcacccgcctggatcgtttggcggagcgcgcgctggaagaaggcaagatcagcgccgatgaagcgagaattctggtgaaagccgaagagagccgcctgcgctccatcaacgtggacgactttgcgccggatgcgctggcggccgccaagccggaaaagccggcggcgcagtctaagcgccaacagcagaccgaagcggcttag

SEQ ID NO: 53287 - DNA, 291 bp, Glycine max
  Peptide Sequence Number=SeqID_144972
atgatgacacatcaaaaccccccatacttagccttttgcactcctgggcaaaatgaaacaaagaacaaaatccaaggatatcaaagggagacaaacaaaaacattcacatatttctcaatgaacatcaagcttgtagtgagcttcaaaacaaggaaagggaaacaaggctcaaaagggctatcaaaggaattaattcaaaggacgcattcaaccaagaaatcaaagccaagggctatttggtgcaaagcaattcaatgggggccaaaaccacacccaaaatggattattaa

SEQ ID NO: 53288 - DNA, 578 bp, Glycine max
  Peptide Sequence Number=SeqID_144973
atggtgaaagttggaacctcttacgtgccgatcaacgtctcattttcgccaaaagttggcccagggtcttccgcggtaccattcatgagcagaggagaagtacaggaagctgcatcacttttgttcacaaaatgcgaactacatcacagtcttattcggcaataccgtgcgcctcgaggggggatgcccggaccacttattgattctagtgtagtgagggttaatttcgaggctccagtggcgtatcatggtttctatcagctgttccctcctgttcagctactgacggggctgccccattcgccattcaggctgcgcaactgttcgggaaagggcctgatcggtgccagggccttcgctattaatgaatcgccaacgctggcgaaagggggatgtgctgcaagaaaaggctcgcaccggtgcgtcgctcagaatagtggatcccccgggctgacaggaaattccgctctaactctcatcttgactcagctacctcggatcgttcctgcggcgagcgggaaagttacgaacggggcggagatttcctggaagatgccaggaagatacttaacagggaa

SEQ ID NO: 53289 - DNA, 191 bp, Glycine max
  Peptide Sequence Number=SeqID_144974
atgatgtttttgataaattttgtgaagaagctggcattgagcaccaactcaccgtaccttacaccccacaacaataatggtgttaaaagggacgaaagcttgataaaaaggcagaacccggagttttcattggatacagcaacacctccaaagcttactgaattttccaacctcaaaatgggaaaattctt

SEQ ID NO: 53290 - DNA, 546 bp, Glycine max
  Peptide Sequence Number=SeqID_144975
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgaattggagctccaccgcggtggcggccgctctagaactagtggatcccccgggctgcaggaattcgatcggtctcgctcattctttcaccggatgggccaacaggatcgtggtccggaccatgttgcgcttccaggccggcttttcggtggtcagcgcctcggcggcgcgcgcgtcggtgcggagcgtctcgacgaggtcgagcgtccagatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 53291 - DNA, 168 bp, Glycine max
  Peptide Sequence Number=SeqID_144976
atggcttcctatggtggtgagcttcttcttgactcatcttctccttggagtgacgtctccaatcatctttcttccttcttcattccgctgccattcatcttcaagaagcaaaagacttcgttgatgaagaagatccaaggactccacaatgtaggtagggtaccctag

SEQ ID NO: 53292 - DNA, 534 bp, Glycine max
  Peptide Sequence Number=SeqID_144977
atgcaatcacagggacttgcactacctccggagccagagattggtccctcaggtgctcgtgttagcacaaaggagagttgtgttgctccctcagggaacgatctagggatgggtgactcagacaaatgcaggctatacattgaagaaaatctctcacgcctggttgccctaggaagactttatgagggatccacaatagttcacaacatccctttgttgcatggccaagtcaaggttggtgttgaggaggttaaagatgcagaggctctcgttcctgtacccactgacgaggctgctgtgtctccagcaaaaccttcagaaagcccggatgatgaggtcgatgatcccctgtacctgatgacattaaccatcccacaactgtttttgaagcctctccaggttatgtgggatgctaccatattcggggtgtttaatcaaaacttcccgttgtacataaagcacgaagatctctctgctattgcacatggtggtcaatgtctcagtatatctgttatacaattgtggattctgtaa

SEQ ID NO: 53293 - DNA, 303 bp, Glycine max
  Peptide Sequence Number=SeqID_144978
atgcacaatttgaaggagaacaacacatacaagaagatagtcatgtttagtctcatacttctcttgaaagtgcaagtgaaagttcaactaaaggacttgctagatggagaattcatacttgttggagtagatcattggggttatcctatgggttgggaagagaaaactccactgaatgcaattgggagcttggtaaggagacaccaatgtgctcctatcaattttcttagctggaaagacatgcctaaggactatattactgacatggttgaattaattcaggtctggtataaaactttataa

SEQ ID NO: 53294 - DNA, 286 bp, Glycine max
  Peptide Sequence Number=SeqID_144979
gggaggagcttgccacccagctcgcccaggcgagccaggtttcttcctccagaagcaatcgccttctggaggaacatccttgaaggcccaagtgggtctgaacttcacgtattgtgcaacaaagggtgccaagtaccttgaagcggcggcacagtgccccatgtgtgcagttaagaaggtgatatggaccttccagcttcccatgacaaaagacgagaccaacatacaacgcatgcgtgacgacatgatgcagatgcgcaaaaatgcaacagggggatggacatag

SEQ ID NO: 53295 - DNA, 945 bp, Glycine max
  Peptide Sequence Number=SeqID_144980
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatctctgtaggtgaaaaatcacccacagaaggatcagatcatttggtccattataacgtggctgataagtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 53296 - DNA, 392 bp, Glycine max
  Peptide Sequence Number=SeqID_144981
atgatctgttccgtcacactaactcatctcagtctgaaattaattttgacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcg

SEQ ID NO: 53297 - DNA, 303 bp, Glycine max
  Peptide Sequence Number=SeqID_144982
atggtaatattgtttaaagctctacaatcagagcacatcctccaagaaccatctttttttggaaccaaaattaccaggacagcacatggactcatgctatctcttacctatcctttaccaatgagttcttccacttgtctttgtgatgagaatcatgaaactggccaaatacaggctaaaggcccaagtggagaaggacgaaggcctaagtggagaaggacaaagccccgagtggagaaggatgaagacccagaggtagagacactatcaagactattaattgttgctgaagacccaaactaa

SEQ ID NO: 53298 - DNA, 259 bp, Glycine max
  Peptide Sequence Number=SeqID_144983
ttggaactcttacgtgcccgatcaacgtctcattttcgccaaaaagttggcccagggcttccccggtatcaacagggacaccaggatttattttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 53299 - DNA, 357 bp, Glycine max
  misc_feature (40)..(40): n is a, c, g, or t
  Peptide Sequence Number=SeqID_144984
atggagaaaaacgtggccactgctgccgccgttagtttgnctgccaaagcgaacccaactctcctagctaccgcgcaccatcctcccccaaatacgataggacgagaaaagagtacacaggggcacaacagcaacccccatttgggatacaaccgggtggcttttaaatacaaggtccaacatttgatagatgctggatggctgacatttcaagaggatcggcccaatgtgaaaaccaacccggtcgccaatcatggaaggggagcgattaatgccattgagtcagataggccgcgcaggtctaaacctttaaaggacgtggcaacccctaggaggtttatctttgaggccctataa

SEQ ID NO: 53300 - DNA, 444 bp, Glycine max
  Peptide Sequence Number=SeqID_144985
atgtctacggatggcattatttcttctgaggtgcatggtaattccaagatcattgatcaatctttgttcttttctttgacaaaattacccagtcaaggtgcaccttttgagggcaccattgttgatgactggaaatttgattattctagtcatgatgctcgccgtatgatcgacagggctcacttggttcggtaccaaatgcataaggcattacgggccaatgcacctctcccttaccctcaattggtcactctgtttctccgtcattttcaaattccgcttgatgatgaaccttttgttcaagtcaagcgttcctttgctataggtgctggtgcagtcacttcatttggataccataaggatcggaatggtcaatggctgaagaaagatgcacttcctccacaagatgagcatactccttctcctcctcctcagcaaagatga

SEQ ID NO: 53301 - DNA, 69 bp, Glycine max
  Peptide Sequence Number=SeqID_144986
atggacagcagaaaccaatcaaggtacttaggaacggatgcaagtggggatggggtcacgaccaattga

SEQ ID NO: 53302 - DNA, 289 bp, Glycine max
  Peptide Sequence Number=SeqID_144987
atggctagaacacgaggtttaggtcgtgctatagatagacttataggcagagatagacaggatgaccatgatgcagttgatgttcctgagaggcgtaggcttactgcatcagcccataggcaacgtgttcatcagatgactgtggatgcacctgatatggctgcggatgttcctgacatgactgaggatgtccctgatatggctgaggatgcacctgagatgactgtggacatacagggtgatgatggtgctgaggggtcacatgctgatgatgctgagggattcctag

SEQ ID NO: 53303 - DNA, 297 bp, Glycine max
  Peptide Sequence Number=SeqID_144988
atggcatctaagaaatggaaggctcattctacaccctcccaggccagatatgacagatccaggttcacatcttcaaaagcttgggagaggtatacagatattgtggtacctaggaaactactaccagagaggaatattgtagtttattacactgagtttgatgagttcaaggaggaactcgagagaagacactgggatgaggagttgactgattttaatgacaacagcatagacatcaccattgtgaaggaattttatgccaacctctatgaccccgaggataaatcacgtaagcag

SEQ ID NO: 53304 - DNA, 1023 bp, Glycine max
  Peptide Sequence Number=SeqID_144989
atggcgcggctgacggcgccctgggtcacgcacagggtctcggccgccagggtgaaactgcccagccgcgcggccgtcatgaaggcgtgcagctcggacatggacggcgagtgcaggcgcatggcgcggcggtccccggggccaggcgacaggcccctcagcatgagcgttggtaatgaaggcgtgcaatatagtcgtttgaaaggggatcgtaaagttcggacactggcggcctcgcagcaagacctgcacctttttccggagtcgctccatgtcccgccgctttttcggctgttccgcgcgcatcgcgctcgccggcgtctgcgccgcgctgtcctttgccggcccggcgcaagccgccgactatccctcccgccccatcaaactggtggtgccgttcgccgcgggcggttcgaccgacattgtggcgcgcctggtggccgagtggcgcgctcgacccccgacggctacaccatcggcatggcgacgatgagcacgcacgggtcgaatccggcggtctatcgcaagatgaactacgacccgctcaaggacttcgagccggtggccaacgtgctggccgtgcccagtatcttcgcgatcaatccgcaggtccccgccaagaacatggccgagttcgtcgcgctggccaagggtcaggcggacaagtacagctttgcctcgccgggcgtgggctcgctgggccacgtgaacatcgagaacttcatgatgctggccggcatcaagctgctgcacgtgccgtaccgcggcgccggtccggcgctcaatgacgtgatgggcgggcaggtggacgccatcaccgacaacctgtcctcgaccctgccgcaggtgctgggcggcaagctgcggccgctggcggtgctgggcgccgaacgctcgccgctgctgcccgacgtgccgacctatatcgaactgggctaccccgacatgggcacgggcggctggttcggcctcgtggcgccggccggcacgccgccggcggtgatcgagcgcctgaaccaggcg

SEQ ID NO: 53305 - DNA, 546 bp, Glycine max
  Peptide Sequence Number=SeqID_144990
atgatacgcggagataccttacggttattcgcacccttttgtcatccagaggcggcgggcccgatgacaagcagagaccaagtttggtcattctgcacccttgtatcatccagaggcggcgggcccgatgatacgcggagataccttactgttatccgcacccttttgtcatccagaggcggcggacccgatgacaagcagagaccaaaggcggcgggcccgatgatacgcggagataccttacggttattcgcacccttttgtcatccagaggcggcgggcccgatgacaagcagagaccaaatttggtcattctgcacccttgtatcatccagaggcggccggcccgatgatacgcggagataccttacggttatccgcacccttttgtcatccagaggcggcgggcccgatgacaagcagagaccaagttttggtcattctgcacccttgtatcatccagaggcggcgggcccgatgatacgcggagatacctttacggttatttcgcacccttttgtcatccagaggcggcgggcccgatga

SEQ ID NO: 53306 - DNA, 1404 bp, Glycine max
  Peptide Sequence Number=SeqID_144991
atgccggttttccgcccacgcaaccgagttgaccgcatgtcatccaacgccgccccggcccgtatcgccatcgtcatgggttccaaaagtgactgggctaccatgcagttcgccgaggaaatccttaacagcctggatgtcccgttccacgttgaagtggtctctgcgcaccgtacgccagataagctgttcagcttcgcagagcgcgcagccgacaacggttttcaggtgatcatcgccggtgccggcgcctctactccatcgtgcagatgccgcgcggtcattccggtcggtacgctggccatcggtaaagccggtgccgccaacgccgcactgctggcggcgcagatcctggcgattcacgatcgcgagctggctgcacgcctggccgcctggcgtcagagccagaccgatgaagccggcgagccgctgggcatcgccgtgtatccggtcgggctggacgcggagccgtcggcactgccgatcgcgcaaagcgtaatcaccgcggaaatcgagcgctggccggaaaccgcgctgacgcgcgagctggctaaccatccggcgttcgtcaaccgcgatatttttccgcgcctcgccgatcgcctgacgcaaaagcagctgctcgaccagctcaacctggcaaccgcgccgtggcagttactggctgataaaagcgagtggccggcggtatttagcacgctgggcgagctggcgatcgtcaagcgccgcaccggcggctacgacggccgcggccagtggcgcctgcgcgccgacgaaaccgcaacgctgccggatgagtgctacggcgagtgcatcgttgagcagggtattaacttcagcggtgaagtctcgctggctgatgccgcaaaacaacatcagggagaagcgatgctgagcgcgatcatgcatgagctgaagtacgtgggcgtgatggccatggagtgtttcgtcacaccgcagggcttgctgatcaatgagctggcaccacgcgtgcacaacagcagccactggactcataatggcgcctcaatcagccagtttgaactgcacctgcgtgcggtgctcggtctgccgctgccgcaaccggtggtgtttgcgccgtcggtgatggtcaacctgattggcaccgacctcaataccgactggctgcagctgccgctggtgcatctgcactggtacgacaaagaagtccgcgccggacataaggtcggccacctgaatctgaccgacagcgatccggcacgtctcaccgccgcactcaatgcgctggtaccactgctgcctgatgcctatgcgagcggaattgcatgggccgtggcgaatctgtatttctgcggtgttcccctcacccttgccctatcccacaagggagaggggattatagggtgcgatttttccgtttga

SEQ ID NO: 53307 - DNA, 450 bp, Glycine max
  Peptide Sequence Number=SeqID_144992
atgggaggatacgtaggagcaaaagcctcgcttttgtcgaccgcaccgctttctgttaccatgacccaagagctggtagcccgcagagacaccttacgaggccaatatggtcatctgcgccctttccggagatgtaggcatcttctggtggagactttttcaagtctcacaagttatccagaactacgtaggtctgagttcctcattggaggatacgtaggagcaagagccttgcttttgcgccgccccatatttgtcatactgacaagcagaggtcatgtgacgtgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 53308 - DNA, 324 bp, Glycine max
  Peptide Sequence Number=SeqID_144993
atgagcaaatattatacgcaaggcgacaaggtgctgatgccgcaggcgattcaggttcatcatgccgtttatgatggcttccaggtcggcagaatgcttaatgaagtacaacagtactgcgatgagtggcagggcggggctcaccaaaacttgtcctttcagtttagccttaaccggcgcatgacttcaagactaactcctctaaatcaattaccagtggctgctgccagtggtgctttagcattccagcttggagcgaactgcctacccggaactgagtgtcaggcgtggaatgagacaaacgcggccataacagcggaatga

SEQ ID NO: 53309 - DNA, 729 bp, Glycine max
  Peptide Sequence Number=SeqID_144994
atgaatgtcgtcgtcgtagaatctcctgccaaagccaagacgatcaacaagtatcttggctcgggctataaggttcttgcatcctttggccacgtcagggaccttcctgccaaggacggatcggtgttgcctgaccaggatttcgaaatgtcctgggaagttgacagcgcctccgccaagcgcatgaaggatattgccgatgcggtaaaatcctccgacggcctctttctggcaaccgacccggatcgcgaaggggaagccatttcctggcacgttctcgatcttttgaagaagaagcgggttctcggcgacaagccggtgaagcgcgtcgtcttcaacgccatcaccaagaaagcggtgctggacgcgatggcgaacccgcgcgacatcgatgtgccgctggtggacgcctatctcgcccgccgagcgctcgactatctcgtcggcttcaacctctctccggttctgtggcgcaagctgccgggtgcgcgttcggccggccgggtgcagtccgtggcgctgcgtctcgtctgcgatcgcgaatccgaaatcgagcgtttcgtttccgaagaatactggaacatcagcgcacttttgaagacaccgcgcggtgacgagttcgaggctaggctggtttcggccgatggcaagcgattgcagaaccgcgccatcaagaccggcgacgatgcgaaccggctgaaagcgctgctcgaaggcgcgacctatgtg

SEQ ID NO: 53310 - DNA, 180 bp, Glycine max
  Peptide Sequence Number=SeqID_144995
atgaccaaatgcccctctactatgaacttcagtttttggtggagtgtagagggaatgactcccaccgagtggatctacgggcgtcccaaaagacagctgtatgggggcctatctgtacagggaggtcgatctctcgcttcacctctcagcggcttccgtcgaaggcacggaccaccatag

SEQ ID NO: 53311 - DNA, 441 bp, Glycine max
  Peptide Sequence Number=SeqID_144996
atggagcttgcatcactttatagggcagcaatagtgagctcaagctccgaagaggatgagctaaaggtttgccttaggtcgaaaagaaatttgtcccaacagttaagcgagactgaagggaatatgtgggccatcatcgataagtgcaaagagaggctaaatctagcggcgactcacgagcaaaggctagaggatgagtacgccaagatatcagcagaaagggaagcaagggaaagggtaattgattcattgcaccaagaggcaacaatgtggacggaccgatttgctcttactttgaacaggagtcaagaacttcccccattgctagccaaggccaaagcaatggcggacacctactccgcccccaagaagatccacggacttctcagctattgtcaacatatgatagacttaatggaccatatgattagaaatcgctag

SEQ ID NO: 53312 - DNA, 315 bp, Glycine max
  Peptide Sequence Number=SeqID_144997
atgaccagaggcaatccatctgacttacaaccctttgatcctgagatagataggacatttcatagattagttaggcatcattttataccttttgatcattctgagcattccataactggtgaatctgtacattctgttattggtgattttgaacatcctgatcttgagcattataattttgagcattctgattctgagcattctgattttgcacattctgagaacatgacacaacctccacctcgtgagaggactctaagggaaatggctgcacctgatttcacctatgaaagcttgtgcatccaataccctgat

SEQ ID NO: 53313 - DNA, 291 bp, Glycine max
  Peptide Sequence Number=SeqID_144998
atgttagttcaggaagaaacaaggcttaagaatcaaggaagtcacccaatccattatgtaagccaccaaaggaatcaaggagctgaaaagaaatttatgaagaagcatgataaaggcaaagggtctttaaagatcaatgacgactctttgcaaatccataagaaggtatcaaaaggcaacaattgccaattttgtgggaaatctggacacttccagaaggattgcctaaagcgtaagccttggttcggaaagaaaggtattccttacaatccaaaccataagctcaaataa

SEQ ID NO: 53314 - DNA, 648 bp, Glycine max
  Peptide Sequence Number=SeqID_144999
atggcagaatcgtcaaagaagagaaagggatcatcctcctccgccgctgctgctggccatcgccgccacggaccatccgaagcacccagaacacctatccatccttccttgtcatctctaagatcatccactctattttcttacgatgatcaacgtctacgtcaaggtacaccttttgagggcaccattgttgatgactggaaatttgattattttagtcatgatgctagccatatggtttgcaatgaccaggctgaaatgaccgcctctgaggaggacttgattttgatgtgggctttccttaccaatcgtcagatcgactgggctcacttgcgttcctttgctattggtgctggtgcagtgacttcttttggataccgtaaggatcgaaatggtcaatggccgaagaaagatgcacttcctcctcaagatgagcgtactccttctcctcctcctcagcaagatgattcagccctcatgactaaagttctttccgagttacggggtcttcgtacttatgttggcgaacattttgattctctggatacttgctttgctggcatggatatccgtctcacacaacttgaagaagatgtgggttatattcgtcagagcttcaaccttccaccaccacctccaccttcttag

SEQ ID NO: 53315 - DNA, 261 bp, Glycine max
  Peptide Sequence Number=SeqID_145000
atggaggttgatgaaccttggctagggttatggctaccattgaattatcaagtagatatgggatcaagtttagcatatgacaacggaatttggggctttgtggttgatttagggatggcctttgtggataactgggtggtgggtaaggaggaggtttgttattggctgagtaatgacattgttgggatgattaaatttgcctcttttcagatccacttcgatcctttcactggcgaagaccaaatccgcaaagcttttagg

SEQ ID NO: 53316 - DNA, 147 bp, Glycine max
  Peptide Sequence Number=SeqID_145001
atgaagaatgcgttcgacaagaaggtgcgcttgcgcaagttccatgagggggcttttttcggaggggccctggtgctcaccaacatggatggcgaggagctaccttcacccgtgaactccgatgttgtcaagcgatactacgcttag

SEQ ID NO: 53317 - DNA, 279 bp, Glycine max
  Peptide Sequence Number=SeqID_145002
atgttggtgcgcatgatccacactcgtctttttgcagcggcacgggtgaaatcttgccccggtatgcatagtagatgcgtaatagcctccctctctggatgtgctcgcacagttggtcgccctccaatatcagggagtagcccaggaaccgttgaaaggaaaccgtggccccccacactgaaaatgaggacgcgtagccctctaaaggcgagggcgtgcagccctctgcaggcgaggatgtgcagtcctctgatgccgaggacatatggtcctctaaag

SEQ ID NO: 53318 - DNA, 330 bp, Glycine max
  Peptide Sequence Number=SeqID_145003
atgagtgagataggaaggtttggaggtttgggaatggaggaacgtcgcaaggaggaaggggctgcgcaggggattctgaaaatgaggaggcagcctactggtaatcgattacatgaatactgtaatcgattacaggccatctgttctagtgtaatcgattacagtattcatgtatacgatcaagaaggataccatagtcagataattgttgcttcatccataaaatctgtgcacaacaactgccggcagaagtatattctgcttcagcagtggataaagcaacactgttttgtttcttactatgccatgagacaagagcggatccaatga

SEQ ID NO: 53319 - DNA, 438 bp, Glycine max
  Peptide Sequence Number=SeqID_145004
atgaatggcataacagaatgccttgcacgaatgccaaggctgctatttaaaaagagtcactcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 53320 - DNA, 276 bp, Glycine max
  Peptide Sequence Number=SeqID_145005
atggtgaaagttggaacctctttacgtgccgatcaacgtttcattttcgccaaaagttggcccagggcttcccggtatcaacagggacaccaggatttatttattttgcgaagtgattttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacccccgccgcgcttaa

SEQ ID NO: 53321 - DNA, 124 bp, Glycine max
  Peptide Sequence Number=SeqID_145006
ggctccgaaaaaagtggagaatggagaattggcgaacagcactgcgcaaaaacttcgcagggctgcagactcgaagggctccagactcgaaggtggaggacacatgaacagtgctaggcaataa

SEQ ID NO: 53322 - DNA, 222 bp, Glycine max
  Peptide Sequence Number=SeqID_145007
atggtgttggatcttgaagtcctcgcacaattccttcatcatcttgttattcagattggtggcattgtctgtgataatctttttgggcagtccataccggcagattatttcctttttaatgaacctaactaccatgcttcttgtgacgctggagtacaaggcagcttcaacccatttggtgaagtagtcgatcgcaaccaagataaagcgatgctcgtttga

SEQ ID NO: 53323 - DNA, 465 bp, Glycine max
  Peptide Sequence Number=SeqID_145008
atggtgaaagttggaacctcttacgtgccgatcaacgtctcattttcgccaaaagttggcccagggcttcccggtgatcaaacagggactctgacaccaccactggatttacgtctacatgagttgaccaacaaactcgatcaagcttatcgaataccgtcgacctcgagggggggcccgctactgaaattgttatccgctcacaattcgcacacaagcataccgagccggaagcatcagcgcgcaagtgtaaagcctggggtgcctaatgacgctgcagctaacctcacacccgcccttaattgcgttgcgctacagggctgcccgcttctccagttcagggaaacctgtcgtgccaactgcattaatgaatcggcaacgccgggcgatcgaggcggctcttcgctattacccagctggcgtaaagggcggatgtgtgcaactggcgattactatgttgggtaa

SEQ ID NO: 53324 - DNA, 273 bp, Glycine max
  Peptide Sequence Number=SeqID_145009
atggagcggtattttcagcacttggttcgccagcaggtgcagatccatgagtgtctctaccagctcagcctcagtcagcagagccagggtttcgctccttttgcgtgccctactctagatcagtttagggctgagctcgcatggcccggagattggcctgaggaccagacagaggaggcacctgcaggagctcccgacggtgcagaggacacccgcatggatgaggagatgacagatttactcggcttcatgagaggaagcggagccacgtga

SEQ ID NO: 53325 - DNA, 201 bp, Glycine max
  Peptide Sequence Number=SeqID_145010
atgaatcagatagtgccatacgtcccaccacaaccgtccgatcctctgatggagaagatcagtcgccttgaacgggcagttaataagttgagtagggacaagtatgatgttgcagatcttgagaatctctccttataccccaaaatgatgatgtccactcctggctcgatgcgcttaacgaaagggaactccctagattaa

SEQ ID NO: 53326 - DNA, 670 bp, Glycine max
  Peptide Sequence Number=SeqID_145011
caggcgcttcgccctctccgggtacagcgaccaggacctcacgcgcgagatcgttcgccgcctcgaccacggcaccgcgaccgctgacctcaccgacccggtggactcagccctggtcgacgaagtgctcgccgaggacgtgccgtacatcggccgagtcaccgagaagcctgagcgtctcgcggcagacacccgaccgaagaagatcgacgagccgcacgcggaggaggtctgcatgcgtgaactgctcgcccacgcctctcggctgggtgtctcagtgcacgtcgcccatctgcccgcgccctatcgcggctggtacgacatcgacgccgcacaagtcgtctacgactgggacctcacgcccgacgaacagcgagaagtcctcgcccacgaactcggccacgtccaccacgggcacgcctgcgaggggaacccggaccacgaacggctcgccgacacctacgccgcgcgcctactgatccacccagaggagtacgccgccgccgagcgagtggcggagaacccgacctacatcgccgaggagttgagcgtgtccacgcacctcgtcggcatctaccaacgccactgcctgacgcggcttcgcggcgtcagctatgcctcgtcgcgaatgggcgtcggccagtggagattccggagggcgcatgcgtag

SEQ ID NO: 53327 - DNA, 216 bp, Glycine max
  Peptide Sequence Number=SeqID_145012
atgcccttgaggtcgggtggcggttgtgatagtgattatggtggtgggggtggaatggtgacgatgatgatggtagtgatagtggtggtggaggggtggaataatggtggtagtggtagcaatgacagtggtggtaacaacaatgacggtaatgttgtggcggtggcagtggtggtggtggtggtagtgacagcaacaacatggtggtggcggtga

SEQ ID NO: 53328 - DNA, 354 bp, Glycine max
  Peptide Sequence Number=SeqID_145013
atgcggaatgaccacaatttgtctccacatgtcatcgggctccgtcgcctctggatgacaaaagggtgcagaatgaccataatttgtctttgcgtgccatcggacacactctccgtgatggcaaaaggtgtgcggaatgaccataatttgtctccgcatgtcatcgggcctcgccgcctctggatgacaaaaggctgcagaatgaccataatttgtctctgcgtgccatcggacacgatcatcttcggatggcgaaaagggtgcggaatgaccataatttgtctccgcatgtcatcgggctcgcctgcctctaggatgacaaaagggtgcagaatgaccataatttgtctctag

SEQ ID NO: 53329 - DNA, 456 bp, Glycine max
  Peptide Sequence Number=SeqID_145014
atgagggacttagcaacatggagaagagtatttgatgctgccagtggtggagctcttggtgatatgactcctgttgaggctaggaatttgattaagaagatggcttcgaactcccaacaattcagtgcaagaaatgatgctattgttcttagaggagtccatgagatcaccatacagatctttgtccttctttgcagcaatctggagtcaatgagcaacctgaagcttatgctgcaaacatttataatagaccccctcggctgtaaaaccaacaacagcagaataattatgatctttcaagcaacagatacaatgtatgtcctccacaacaacaacagcctatccctcctttccagaatgttgctggtccaagcaagccatatgttcctccttcaatatagcagcagtcacaacaaagacaacaagcaactgaggctcctcctcaacattccttag

SEQ ID NO: 53330 - DNA, 114 bp, Glycine max
  Peptide Sequence Number=SeqID_145015
atgggtgttaaacattttgaggtggtcaaacgaaggtcgcatgccaacaaacaatggtccccagacgaaattaggatgaggacattgtcgcctttgaaggcatgcaatgactga

SEQ ID NO: 53331 - DNA, 264 bp, Glycine max
  Peptide Sequence Number=SeqID_145016
atgtgggtgcaagccattggtcagtttgctcaagcgacctgtgctcctgagtttggacttccaagaccgttcaatcagagattactcctcttgcacgttggtgtgggtgccgtaaaacaacgagaatcatctacaacaagagactctcggtctcttagtcccttttcagaagtaagaagaagagaagaagaaatctctcttgaaagagatagattgtacaatgaagatcaatcaaaattccttattgaatatgcaagtggttga

SEQ ID NO: 53332 - DNA, 900 bp, Glycine max
  Peptide Sequence Number=SeqID_145017
ttggaactcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgccaaagaagaaaaggttcaagcagctgatgactcacttagcgaggcagatccgttcagcgagtgacatttgcttagcgagacattcagctcgcttaacggatgagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53333 - DNA, 96 bp, Glycine max
  Peptide Sequence Number=SeqID_145018
atgggtaaatggctccgaagaaactctccacgaagaggtctagaagagacgccacaggagaagggtccaatgccgcccccgagtttgatagtcatc

SEQ ID NO: 53334 - DNA, 723 bp, Glycine max
  Peptide Sequence Number=SeqID_145019
atgacgacacctccaccatcacctatacaggccgagattccttttgatgggacgtctaggaaaactagacaagccactcggctaagaaggttgacagcaagaacattggatcaaccaagggcaacagtcagtgtcaatccagcccctgttgtggcacaagacaagattccaattgttcactctacctggaatgatgtaccagaaacactgaagaacatgatatgggatgacatattggcaaaattcgacatccccgagggtgataatgccaaaaagaaggtcatgtcaacggtgacaacgcgttggaggaaatttaagtcgtcgttgacaacaaaatatgtgtatggtaatagtgacgggcaaccaaaagatgatcctttggttaaatatgtcattgatgcaaaagattgggtcaagtttgcaaaaatgaggcaaacccctacctggcaggggatacagaaaaagggacaggagattcaaaaatacaatgactcttcgcacttgttgtctaggggagggtatgagctgctagaaaaaaaattaatggctgaaaaaaggaagatacaagaagaacaagcagcatttactgaggacccttcattgtaccttccatcatccccaatttctagacacgagaagtggaagagtgcgtgcacaaaacaatatggtcagatgacgtctcaagccaccaaagaaatagctgacaaaattgtgagcaactaa

SEQ ID NO: 53335 - DNA, 211 bp, Glycine max
  Peptide Sequence Number=SeqID_145020
atggtcatctgcgccctttccggagatgtaggcatcttctggtggagactttttcaagtctcacaagttatccagaactacgtatgtcatgtgacgtgcacccttgtatcatccagaggcggcgagcccgatgatacgcggagataccttacggttatccgcacccttttgtcatccagaggcggcgggcccgatgacaagcagagaccaa

SEQ ID NO: 53336 - DNA, 327 bp, Glycine max
  Peptide Sequence Number=SeqID_145021
atggtctctaagaccttgaccagatacgactttgtcgcaacctacccttcggcgggagggcgacgcgtgactcgcgggatgcgtgttccacgaaaggaatacgcgcggagtcgccaccaacgtttatttgaggaaaacgtcggaaaaaccggaaaggacgcgatctacgaacttttaagtgaaaggttcgggagttgtatttacgcacggggaaggagagaaacgttaaggcgttggaccattaacgatgtctcggggtggtcgacaaaagtggggcttttgctcctacgtatcctcaattgcgatgaggaaatcagatctacgtag

SEQ ID NO: 53337 - DNA, 240 bp, Glycine max
  Peptide Sequence Number=SeqID_145022
atgtatctggagaattcaaccacttcaaggaaggatcaagaatcgaagctcaccaccaacttaggaagccatgaatggacaattattatgaggctaggaaagcatgactctgagggagaaggagcacaacattttgaatgcaaacccaactactctaacaagacaagtccaagattctccacaagatggttaggtgttatgagcatggaaaagatgaaggacaagatgcacaaagtgtga

SEQ ID NO: 53338 - DNA, 795 bp, Glycine max
  Peptide Sequence Number=SeqID_145023
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataagaccaccacttcacttcatgaaaggcactactgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53339 - DNA, 345 bp, Glycine max
  Peptide Sequence Number=SeqID_145024
atggataatgaagagggagtgcaagaacagatgaaggccgacctatcgaccttaaaagatcaaatggcttctatcacgaaggccatgctaaagcttcaaaaaaccatagaagataatgctacgaaggttgcttccaatacagctagggaagcagagccggtgttacagcccacaataaacttgggccgagacaagaacacaacgagttccagtcggaggtatagtcctcaagcctacccttatggtttgcctctggacttcactccccataccgttccagacgatttgagccaagcccctaccttcgagggacagctccctcctcatgctgactatcctctgtaa

SEQ ID NO: 53340 - DNA, 516 bp, Glycine max
  Peptide Sequence Number=SeqID_145025
atggccacaatgatggaggccatgatgagcatgaagaagataatggaagccaatgcggttacagttgccgctaccagcgctgttgctaaggtgaacccgatgccctcatctggccttaaccaaatgaatcatccaaccttagatatggtaggcaaagatttgggaagtacgggcggcccccatcatgcgcaaattgaaaacaagcatgccttcccaccatatggcttgcctcccaactatacaccacccaatgtggcatacactcccaatgaggatactcatgaaatgccccaccacaatctagcagactttgagccttgcctcggatatgccactgaagggcaagcagttggtggtatacccatgccaaacactttggagggccctcaatttcgcccacaaccacaacccttgcattttacggtgggaagagcccctcctgctatggttgaaaaaggagagttggatcatatagaggaaaggctcaaggacattgaaggaggcaaagattatgcc

SEQ ID NO: 53341 - DNA, 526 bp, Glycine max
  Peptide Sequence Number=SeqID_145026
atggcgcctaccaggcaccctctggacccagataagtccaacagggccctgggatttcccgccttgatcacaggactctgtcagtcgttcggcgtccccatcacacctagcaaggtgatttggccgcccatcacccgagcttttattgagaagtactgcacgcagagacaggtcccgggtgatgcaccacaggccgcggacgtgccgccacctcatcaggctggtccagccggattgtttgatacagagcagtatttgcggcatttggttcgccagcaggcggccaaccaccgggcacatgtacagactcatgattgtctttatcagatgagtctcagcctgcagagccagggctttacttcttttccgtgccctactccggaccagttcagggcagaggtcgcatggcctggagattggcccgaggcccaggcaggagaagcaccagcagaggctcccgacgaggcagatgaggcccgcgaggacgaagagatgaccgatttacttgatttcttaggagggagcg

SEQ ID NO: 53342 - DNA, 180 bp, Glycine max
  Peptide Sequence Number=SeqID_145027
ttgaagaccgaagaaaacgaagaacgaacgatggatgtcgaagaacggttgaaaaccttcgcgctgaactctttcctcttcactcctttccctatttatagcaaaataagggaggagcttgccacccagctcgcccaggcgagcaaggttgcttcctccagaagcaaccgccttctggag

SEQ ID NO: 53343 - DNA, 408 bp, Glycine max
  Peptide Sequence Number=SeqID_145028
atggaacttccagactctattcctacagtagagcagtttaatgagatggtagcctggcccggaacccaaccttctcttcataaggaagacgaaggtcccacagcccaggtacctcagcatatggaggatgagtcatctgaggccaccatcccagagccatttgatataggagaagaggcagaggagacacaggtgagacaggtagctgctaccactcctgagcgatcccttgaggctacttcaaagccttatgcaccagtggtaaacctaccctcacctcagtctgcagcagacccctccactcctcttctacaaatgccaaaggacccaactacactagtcctagctgtggacacttctcctccaactactccagtgcttcagctgacagatgaggaggatggttag

SEQ ID NO: 53344 - DNA, 252 bp, Glycine max
  Peptide Sequence Number=SeqID_145029
atggcaaatcttcgtgcggacttagctgaaacatggatgctagtgtggcaatttatgaaattccaggacatgccgaaaaaccaaaaagatgttgatgcacaatcccagaggggggtgtacttagtaaaaatgggggtgcaaatagcacccaggcccatttgggccctccagaagattcctccagaaggcggttgcttctggaggaagcaaccctgctcgcttgggcgagctgagctcgcctgggcgagctga

SEQ ID NO: 53345 - DNA, 1551 bp, Glycine max
  Peptide Sequence Number=SeqID_145030
ccgtcagagggctgcacggccctcaccttcagagcactacacgtcctgaccatcatagggttccaagccctgacattcagaggactacatgtcctcgcaatcagagggctgcacaccctcgcctttagaggacttcacgtcctcaccatcagagggctgcacgccctcaccttcaaaggacaatacgtcctcaccatcagagggctgcacgccctcagcttaagaatacaacacgtcctcgccatcagagggctgcatgccctcacctttagaggactacacgtcctcgccatcagagggctgcacgccctcgcctttagaggactacaagtcctcacaatcggagggctgcaagccgtcaccttcagaggactacacgtcctcgcctgtagaggactacatgtcctcgccatcagagggcagcaccccctcacctttagaggacaacacgtcctcgccatcagagtgctgcacgacctcaccttcagaggactacacgtcctcgcgattagagggctgcacgccctcacctttagaggactacacgtcctcgccatcagagggctgcacaccctcgcctttagaggactacaagtcctcacaatcggagggcagcaagccctcaccttcagaggactacacgtcctcgccatcagagggctgcacaccctcgccattagaggacttcacgttctcgccatcagagggcagcacgccctcaccttcagaggactacacgtcctcgccatcagagggctgcacgccctcacctttagaggactacacgtcctcgccatcagagggttgtccgccctctccttcagaggactacacgtcctcgccatcagagggttgcacgccctaagcttcagaggactacacgtcctcgccatcgaaggcctgcatgccctcacctttagaggactacacgtcctcgccatcagaggactacacatcctcgcctgtagaggactacacgtcctcgattgtagaggagtagacgtcctcgccatcagacggctgcatgccctcaccttcagaggactacatgtcctcgtcatcagaggactacacgtcctcgcctgtagaggactacatgtcctcgccattagagagttagggctgcacgccctcagcttcagaggaatacacaacctcgccatcgtagggctgcgttccctcaccttccgagggctacacttcctcgccatcagaggattgcccttcctcgccgtcagagggctgcacgccctcaccttcagagcactacacgtcctcgccatcagagggctccaagccctcaccttcaaaggactacacgtcctcgcaatcagagggctgcacaccctggcctttagaggacttcacgtcctcgccatcagagggctgcacaccctcaccttcaaagggcaatacgtcctcaccatcagagggctgcacgccctaagctttagaggactagacgtcctcgccatcacagggctgcatgccctcaccttcagaggactacacgttctcgccatcagaggactgcacttccttgccgtctga

SEQ ID NO: 53346 - DNA, 748 bp, Glycine max
  Peptide Sequence Number=SeqID_145031
tgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcataattcttggccatcacactcagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53347 - DNA, 417 bp, Glycine max
  Peptide Sequence Number=SeqID_145032
atgttcgttatatttgaatttgtaattattgagaatgatttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 53348 - DNA, 672 bp, Glycine max
  Peptide Sequence Number=SeqID_145033
atggtggaaccatcaaagaagcgcaaaggttcttcaagtagaagccaacggcactccgagactcagaatattcctattccttcctctatttcctcctcctcattgttctcatcggaagaacaacgtatacgtttcgaatgcattcaagcatttcaaaactcaaatctcattccctttatgtctctgaaattgcctgtatactctgaattggtaaaaactttttattctaaccttgaaattcaagaaagtaccttgattccagaagtttatgggataaagatggtcattgaccaatccttcttctgtgatttgacccaattatctagtgctggtgtaccatttgaaggtacattggatgatgattggaaatttgatttttctgtgcatgatgctcgccggttggtttgcaccaaccaagcggatatgaccggaaggctacttaccggttcattggctcttgaaagccgcatcctttactatcttattattcgtattttacttctaagatcttcaaaccttactcaggtttctgaaaaagatcttatagttatgtgggcttttcataccgaccgacaaattgattgggcacatttagtccgatatcgcatgcataaggcattgcgattaaatgctcctttaccatatccacatttagtcactcttttcctttaa

SEQ ID NO: 53349 - DNA, 489 bp, Glycine max
  Peptide Sequence Number=SeqID_145034
aggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaagaccaagtttggtcattctgcacccttgtatcatccagaggcggcgggcccgatgatacgcggagataccttacggttattcgcacccttttgtcatccagaggcggcgggcccgatgatacgcggagataccttacggttattcgcacccttttgtcatccagaggcggcgagcccgatgacaagcagagacaaagtttggtcattctgcacccttgtatcatccagaggcggcgggcccgatgatacgcggaaatacccgagtg

SEQ ID NO: 53350 - DNA, 467 bp, Glycine max
  Peptide Sequence Number=SeqID_145035
atgactagaggcaacccatctgacttacaaccctttgaccttgagatagataggacatttcatagattagttaggcatcattttataccttttgatcattctgagcattccattactggtgaatctgtgcattctgttattggtgattttgaacatcctgatttagagcattataattttgagcattctgattctgagcattttgattttgcatattctgagaacatggcacaacctccaccccgtgagaggactctaagggaaatggctgcacctgatttcaccaacgaaagcttgtgcatccaataccctgatgaggatgtcccatatgttcttaaaactggactgattcatttgcttccaaagtttcatggccttgcaggtgaagacccgcacatatttctgaaggcttttcctcattcattagagggagtggcaaaggactggctgtattaccttgctccaag

SEQ ID NO: 53351 - DNA, 195 bp, Glycine max
  Peptide Sequence Number=SeqID_145036
atggtttctgttgctagtgctgcaaatgtatctgctcaagtgaacaatatttctatgctgaatggaacaaattttaaggtcgaaaaggaagccatagaaattgttctcagttatatgaatttggatttgacactgagaacgaaacaacccacttccactctaaaagcctccaatgaggtaaaaattgagaaatga

SEQ ID NO: 53352 - DNA, 501 bp, Glycine max
  Peptide Sequence Number=SeqID_145037
atgattatgaggggccaagacatttatagtagccaagatgaggctactacttcaccttcctctagtgaaagtgaaaaagcaaaaggggaagaatctagtgaagaaatctacccccaagaagaaggacaaccattagtggttaaagagaagtgtaaggagggacacctgaggtttgagatctcttattgtggaaagaaaaacaagagagaaaagaaaaaggaaagattgaaagaaataagtcaagatgaaaaagagaaaataagagaagaagaaagaaggaaaatactaaaaaagttaagaaaagaaaaacatgccttctatagtagtcataactcttgcaagagcctaagtgaagaacttcgtgactattatgaaggaaggcataggtcacatcttagacctcactcccataggagagaaaaggaaagaaatcctcaagaggctaacattaacctcccatacttccatgggaaggacaatgtagaggctaacttagattga

SEQ ID NO: 53353 - DNA, 558 bp, Glycine max
  Peptide Sequence Number=SeqID_145038
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatggccgggacagtgacgacgaccgggcgggtgcgttacttggcccagaatgcccatgtgttcgcaacgtcaatcagcgaaaatgtacgcatcgatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 53354 - DNA, 156 bp, Glycine max
  Peptide Sequence Number=SeqID_145039
atggtgaaaaagaggctaagttttgaattgcaaaaagtagcaattgggctaagctcaacagttgggctaagtgcttatccaccgttaagcatggcttctaagcgcttagtgcaaaggagaatctggcagagcatcaacatcaaagccgcacgctaa

SEQ ID NO: 53355 - DNA, 804 bp, Glycine max
  Peptide Sequence Number=SeqID_145040
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatccccactcgaagctgcgaggaatcgattttcttaagcatggggatcaaaccgggatacaactattccccaatggaattgcgtcagcttcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53356 - DNA, 540 bp, Glycine max
  Peptide Sequence Number=SeqID_145041
atgaccattcgaggccttgggctcaatggccccgatgacatctattccccacatggagaaaggccaaggggcggacatgacattcagaggatgcggtggggcattgacattatccgcgaatgcttgacatttgtggcacttcctcacatggacacaacaatcactttccatggtaagccagtaataacctgctcttcaagcatcttccgttggtatagcatcccgggctcctccggttccaaacgagcccttcgagtggcttcctcgatcatggattgcgtccttgcatccacagcatgggagcatttgtttctttatgcacaggtctccgctcatgaagaaactggctgccgtaagctcgtactttcttgtcgcaatgcctctcgggtattctttgctggtataagcgcccaatgctctggtcgtaaccttaccatgaggcttgagctgatcacgtcccgttctgacttccactctggcaacaatccggagttctgccacgacactgaagatcctcaatgtacgggactagtcccctga

SEQ ID NO: 53357 - DNA, 118 bp, Glycine max
  Peptide Sequence Number=SeqID_145042
atggagaggagtatgattgatgctgccagtggtggagcccttatagacatgatccctgctgaagccaaaaatttaattgagaagatgacttcaaactcccagcaatttagtgccataa

SEQ ID NO: 53358 - DNA, 438 bp, Glycine max
  Peptide Sequence Number=SeqID_145043
atgggacctctccaaaggcaagccttccgcaaagtgtacgggaagattctagatttgaccgcagcggaggtatttacagaagctgtcgtatccctcgcccaatactatgaccagccgttgaggtgtttcacgtttggggacttccaaatggtcccaactattgaagagtttgaggaaatattaggatgccctcttggggggaggaaaccgtatcttttctccggctttcttccttccttgagcaagattgtagctgtgattggagattcagcaaaggagttggatcgcacgaagcaaactcagaacgacgtagtgggccaactagggtaccccatgcgggggtgtattaattataatcccgcactcgccataagacaactagggaaccccatgaggggagcgccaaccgaagaaagtctctctcgcctttccttgtga

SEQ ID NO: 53359 - DNA, 333 bp, Glycine max
  Peptide Sequence Number=SeqID_145044
atggctgaggaggagtgtaaggaggtaaatgtctcctccaagaggttagctaagaaggaaagtcattttgcaataaagagaaacattaaagaaacttcccttcttagacaacctccacattttctcctttgtaaaaagacacttgttagcactgccacacctcttggccttgaggttattcctttagtaaaagagttgttggatgagggtttggttcataagagcttaaatccttgtgctttgttggtgcccaaaataggtattattaggcaccaaatccctaaaataggtgatatgatgaatgtgttgagtggtgcaaccctctttttgtaa

SEQ ID NO: 53360 - DNA, 249 bp, Glycine max
  Peptide Sequence Number=SeqID_145045
atgggtgaagtagaggaggtgcaagagcaaatgaaggccaacatggaagccatgaaagagaaaacggccacgatgatggaggccatgatgagcatgaagaagataatggaagccaatgcggttacaattgccgctaccagcactgttgctgagaggaacccgatgcccccatctggcctcaaccaaatgaatcatccaacctttagttatggtaggcaaagatttgggaagtacgggcagcccccatga

SEQ ID NO: 53361 - DNA, 765 bp, Glycine max
  Peptide Sequence Number=SeqID_145046
atgggctacatggctcctgaatgtgctacctcgggcagggctagtaaggagtcagatgtctacagtttcggagttgttgctttagagatagcttgtggaagaaaacccataaaccatagggctcaagaaaatgaaataaatattgtggaatgggtgtggggactctatggagaagggagaattcttgaagcagcagatcaaagactagaaggggaatttgaggaggagcaaataaaatgcttgatgattgttggtctttggtgtgctcaccctgaccataacaataggccttcaatgaggcaagcgattcaagtgcttaactttgaagctcccttgcctaatcttccatcaagtttgcctgttcctacatatcttgaaggccccttgcactcattcatagcaccattcagcataacttcttcggaggaaggtcaaagccagatcacaggctccagttccaacacaaactccaccgggttcaccacaaaatctgatgatgcttctccttctgtgtcgcttctgtactcacgagattcatgggtggtggaactgttaccatattttgaaagccttgataacggagtattctatgtctgcatattacagttaattttcttgaaagattcgatttttaggataaacttcttgcatttatttgattttgtcaaatctttaaaagaagaaaacaaagacaatgtaatcaacaaactagaacctcctcagtccacacattatgttaacctcagctggtcacaacaacaataa

SEQ ID NO: 53362 - DNA, 192 bp, Glycine max
  Peptide Sequence Number=SeqID_145047
atgggtggtctccttgcaaaagtcgacatccgcaatgccttgagctttcacaagaacgactcggtggttgaccccccgctgcgtttagcatccttaattttgtcttcactccagaaggtagcccaaggtgatcctgcccctgtttataccacaacccctaatatacatgcgtatgcgtatgcgtatgcatga

SEQ ID NO: 53363 - DNA, 636 bp, Glycine max
  Peptide Sequence Number=SeqID_145048
gaattagaccatagaaagcaagtcaaaaatggggtggttggaataccgagaaagtgtttgaaggaaaaagcaagaaacttggcaggcaaaggagaatgggtcccgttcatagacattctcgcactgttgatcttcggaggagtcctctttccgaatgtggatgggttggtggacctagcagcgatcaacacttttctcgcctatcatgaccacaaggaaagcccgattgtcgctatgctagccgacctgtatgacaccttcgaccgaaggtgtgagaagagcagtacgaggattgtttgctgtactccagctctttatgtaaggcatgcttgcccgctggaaagccaccgttcatgcacggagaaaggaggggcaagttgggaccaactcttagcaaacaaagaaggagcgtccgtcaaatggttccctcgatggaaaaaaggaagaaccggagttcttattttgtgtggaggatttccgaatgttcccttgatggggacgaggggttgcatcagttacaatcccattcttgctataaggcaacttggctgccctatgagaggggcgctactagaggaagagctcgcgcctatcatttcacgaggtttcaataagaccaacaaggagacactttag

SEQ ID NO: 53364 - DNA, 814 bp, Glycine max
  Peptide Sequence Number=SeqID_145049
atgcctaatatttacaacgctctgatagttaagggtcgagatactgttggtcaacaaattaatgtgacttgtgaagtacagcaattattaggaaataatcgaattagagctgtagctatgagtgcgacagaaggtctaatgagaggaatggaagtgattgacacaggagctgccctaagtgttccagtaggaataaaagtagtagatcttttagctccttatcgtcgtggaggaaaaataggacttttcggtggagctggagtgggtaaaacggtactgattatggaattgatcaataacattgccaaagctcatggaggtgtatctgtatttggcggagtaggtgaacgtactcgtgagggaaatgatctttatatggaaatgaaagaatctggagtaattaatgaacaaaatattgcagaatcaaaagtagctctagtatatggtcaaatgaatgaaccgcccggagctcgtatgagagttggtttaactgccctgactatggcggaatattttcgagatgtcaatgaacaagatgtacttctatttatcgacaatatctttcgcttcgtccaagcaggatctgaagtatctgccttattgggtcgaatgccttctgctgtgggttatcaacccactcttagtactgaaatgggttctttacaagaaagaatcacttctaccaaagaggggtccataacttctattcaagcagtttatgtacccgcagacgatttaaccgatcctgcgcctgctacgacatttgcacatttagatgctactactgtactatcaagaggattagcggccaaag

SEQ ID NO: 53365 - DNA, 777 bp, Glycine max
  Peptide Sequence Number=SeqID_145050
gagttgctagaggaggctctctctgaatgcattaagccatcttctggagaaatcgatattagtaatttacctgttaaaagtcttagttctacttctcgaaagtaccctaagaatataaccgttccaaggaaatcgggcaatatatccctgaggccgttcttggtggccgatactgagaccataattaacaaaaatagtcaacatgtaccctatgcggtcggtgtcatggttgttaatccggggattcccgttagtaggcgtgaaaggatcgatacttacttcagcgaagattactcttcaagaatcttcccaacctttgaagaaaggagctgccaaatgctcaaatcatttatctttagggtcgcggctattactcgacaaaataggtctgctaaaacaatctactttcataatttaggtcgattcgatggcattttcctacttaagcaccttgcattatatcatcctaattacacggtcaccccccttatgagagacaatagactctacgaggtagctgtctattctaaaaaaaggctattatttacgttccgagactccttacatctactccccggcaaactagatgaccttgctaagaatctatgccctgagttgggttctaaaggatctatttcctatgaggatgtaagacttgaaagtcttagtattatgaaagagagtttgttagagtatatggagcaggatattcttctgctagggggaattatgcagtccttccaggacatatattataaggcttaccaggcagacata

SEQ ID NO: 53366 - DNA, 354 bp, Glycine max
  Peptide Sequence Number=SeqID_145051
atgccgatctccccctgcggaaggatcacacccacaaagacacctagtggacccagagaagtccaacagggccttggggtttccagctctagttacgggcctctgttagtcctacagggtgcccgttccccccagcaagggatcgcgcccgcaagacacccagtggacccgaagaagtccaacagggtcttggagttgccagctctgattacaggcctctgtcaattctacggagtgcctgtcgcccccagcaaggcgcagggtgaaacaccacagcaatctggggatggtcggcagcgggcaacagacgcactgccaccacctctagagttcacctcagctcatccagaaaag

SEQ ID NO: 53367 - DNA, 603 bp, Glycine max
  Peptide Sequence Number=SeqID_145052
gaaattaggggggttccaccattcttaacatatttcacggcaagagaatgtatatccttgtcttcctcgagttcaaggatgttgtcaaatcaggaattgcatgaggctggacaaactaagttttggtttccaggagcaactattccagagtggttcaataaccaaagtaggggacattcaagttctttctggtttcgtaatgaattccctgtcaatgttctttgtcttcttctagcacgtgtggaacgcatagatgtagatgatattttcatgcctgcggtgttcatcaatggcaaacttcataaaaatccctctcggggcactaaagtaagaaaggtgaaattggattatacatatctatttgacctaaaatcagctttggagcttaatgatatatctgaagtggctttagaaaaggaacggaaccaggtggaaattacatacgcaggtctgatagagacctcactggttaaagcaaccggaacccatgtattcagacaggatgatattcgatatgatgatccttattatggtaagagaaaattagagcatgatctcaacagttgtgaatcacgtgttggaaataagactttttatgtttag

SEQ ID NO: 53368 - DNA, 185 bp, Glycine max
  Peptide Sequence Number=SeqID_145053
gggttatggctaccattgcgttatcaagtagatatgggagcaagttagcatatgacaccggaatttggggctttgtggttgatttagggatggcctttgtggataactgggtggtgggtaaggagaaagtttgttattggctgagtaatgacattgttgggttggtgggaaacttggctgtatag

SEQ ID NO: 53369 - DNA, 380 bp, Glycine max
  Peptide Sequence Number=SeqID_145054
cctaagtgaagaacttcgtgactattacaaaggaaggcataggtcacatcttagacctcactcccatagaagagaaaaggaaagaaagcctcaagaggctaacattaacctcacatacttccatgggaaggacaatgtagaggctaacttagattgggaaataaaggtgacaccttttaagcccaaagatgataaggggaagacaatagaaaagcaagaccctaaggctagtatgcaagagaaaactagctctataaagacacttgctagcattgccacacctcttgggcttgagtttattcctcaagtaaagaagttgttggatgagggtttggttcgcacgagcttaaatccttgtgctttgttggtgcccaaaatag

SEQ ID NO: 53370 - DNA, 585 bp, Glycine max
  Peptide Sequence Number=SeqID_145055
atgaagcacttcactgacaccctcatcagtgccaacataggaacaaaagctggtaccgggccccccctcgaggtcgacggtatcgataagcttgatgggcgcgggcgtggccccgggcctcgtcgagccggccgtcgagccccgcggcctggcccaggacgaggtgcagcaggtgcgtctcgagcagctcgggccgcgtccggaaccggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 53371 - DNA, 673 bp, Glycine max
  Peptide Sequence Number=SeqID_145056
caaggaaagtccggtcattgctgttttggccgatgcctatgacacatttgaccagagatgcgagaagagtggcgcaaggattgtttgttgcacacctgctctttatgtatggctagtctctcacctctttcatcatgaaagtagacctgtttgtcccttacaaggtcactgcatgtgtaccaagaaaagggaagcaaattgggagcagctcttggttggcatgcatggggcatctattaattggttccctcgatggaaggaaggaggggccagagttttatcctcatgtgaagggttctcaaatgtccccttgatgggaacgaggggttgtatcaattataaacccgtccttgccataagacaacttggctatcccatgagaggagcgtcgtcggaagaaagtgtcacgcctttcatcacacgaggtttcagtgaccccaatgcaaggacatttcaaaaggtccgaaaggcatggggtgcggtgcaaaggaaggataaagagcttaggggaagcaacaatgggatcatcggcggctatcacaagtggttgaaggctagaacacaagagatatcttggctcccgaagctaaagatctcaagtgaggaagaggctgaaacccctgaggagagcgaagaggtgcaagccttgaaggcagaacttgaaagggcgtaa

SEQ ID NO: 53372 - DNA, 486 bp, Glycine max
  Peptide Sequence Number=SeqID_145057
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatgcagggtcaaatattacctggtgtatcttcaatgaagcagtatccttcgtcaggaccaggtggaaggaatcaggtacctaatagagctgccatgggtgagcatgccgagggagcatgctcatcaagcttatcgataccgtcgacctcgagggggggcccggtaccagcttttgttccctttagtgagggttaa

SEQ ID NO: 53373 - DNA, 441 bp, Glycine max
  Peptide Sequence Number=SeqID_145058
atgcggagacacctcatggttatctacatcttcatcatccagagacggcaagtacgatcacacgcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 53374 - DNA, 495 bp, Glycine max
  Peptide Sequence Number=SeqID_145059
atgaagtcgttgagaggaaaggagatcgcgttggtgaaggtgcagtggggaaactatgagggtgattctacatgggagttggaggataggatgagagaattgtacccaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaatggcttacgaacggggcggagatttcctggaagatgccaggaagatacttaa

SEQ ID NO: 53375 - DNA, 510 bp, Glycine max
  Peptide Sequence Number=SeqID_145060
atggcgttgccccacctctacagccccattcatctttggccgataaggggtagagttatgatgctggatcttgaaatccccgcacatctcctgcatcattttgttgttcagattggtgccattgtcagtaatgatcttcctagggagtccgtatcgacaaatcagttccctctttatgaatctgaccaccacacttctcgtgacattggtataagaggccgcttcgacccatttggtgaagtaatctattgccaccagaatgaagcggtgaccattcgaagctttgggttcgatggccccaatgacatctatcccccacatggaaaaaggccaaggggcggacataacattccgaggatgtggcggaacattgacattgtccgcgtatgcttgacatttatgacatttccttacatgggcgcatcaatcgctttccatagtgagccagtaataacttgctctaaggatcttcctggccatagcatgcccattggcatgtgtcccaaatga

SEQ ID NO: 53376 - DNA, 487 bp, Glycine max
  Peptide Sequence Number=SeqID_145061
cgctgttcatgtgtcctccaccttcaaagagtttggagctatgcttcatgattgcctaagtgtggaccctcaagtgcaatcctccattctccacttttttcggagatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 53377 - DNA, 303 bp, Glycine max
  Peptide Sequence Number=SeqID_145062
atgcgggaaccatttggtcccgcacttttaaactttcttttgctatctctaagactcaatgatgcaagctccattggagcttgtaggcctaggatcttcttcatcaatggattcctttgcttcttggaagatgaatggcagcggaatggagaaagggagagagagaggagacgccacttcaaggagaagatgagtctagaagaagctcaccaccataggaggccatggataagagcttggaggaagaatgagatgaatgaagggagagggagagaagagcacgaaattttgtgctctaaatga

SEQ ID NO: 53378 - DNA, 348 bp, Glycine max
  Peptide Sequence Number=SeqID_145063
atgtggctgaaaggggtgaagaccctgtggttctgtttggaaatcgcgatgaacgcactaagcgcgcctgctgcgtttagcatgttcatcacaactgttaaaattttggatttccagatgaacgcgctaagcggaccatgtcgcgctaagcgcatggcatctaagaaaaggaaggcaccttctacacctacccaggccagatatgacagatccaggttcacatctcaagaagcttgggagagatatacagacattgtggtgcctagaaaactactaccagagaggaatgtggtagtttattacactgagtttgacgagttcaaggaggaactcgagagaagacattga

SEQ ID NO: 53379 - DNA, 332 bp, Glycine max
  Peptide Sequence Number=SeqID_145064
atggctaccattgcattattgagtagatatgggagtaagttagcaaacgacaccataattggggcgggttttgtggttgatttaggggtggcctttgtggatgatttggtgttcttggctgatagggtgatgggtgttagtcggttcggcaacaacccgtgcctacatccagtccccaagcaaccaccgattcttgagatttccaataaccttgtaaaatcctttacaagcaaagatccacaagggattattacaacccaagtagatgtacgctctacttgtaccacagaggatgtaccctccaatgtgttaagacaaagaattcttaggcg

SEQ ID NO: 53380 - DNA, 477 bp, Glycine max
  Peptide Sequence Number=SeqID_145065
atggaggccatgaaagagcaaatgaccacattaatggaagccatgatgagtataagaaggatgatggaggtcaatgcagctacagttgttgccacaagtatcaccatagaagtggacccgactcacccacctagtttcaatcaaaacaagcattccttcccaccatatggcttgccacccaatgttgcacaaactcccgatgagaatgttgacaactccgcgcccatacccattgagagccaacaaccccaatatgatcatgcacatatctctctacccctgggggacacacatgaagcaccccgagaccacaatctagccaactttgagcctcgcctcgaatatgccgctgaggggcagacattttgcgacgtacccatgccaaacactttggggggccctcagtatcgcccacaacacaaccctagcattttgtggtggaagagttctcttgctgacatggcagaattatgccta

SEQ ID NO: 53381 - DNA, 411 bp, Glycine max
  Peptide Sequence Number=SeqID_145066
atgggtgaagtagaggaggcgcaagagcagatgaaggccgacatggaagccatgaaagagcaaatggccacaatgatggaggccatgatgagcatgaagaagataatggaagccaaagcggttacagttgccgctaccagcgctgttgctaaggtgaacccgatgccctcatctggccttaaccaaatgaatcatccaacctcagatatggtaggcaaagatttgggaagtataggcggcccccattatgcgcaaattcaaatcaagcacgccttcacgccatatggcttgcctcccaactatacaccacccaatgtggcggcaagcagttgtagatatacccctgcaaaacacattggagggcccgcagtatcacccacaatcacacctcttgcattccacaatgggtaa

SEQ ID NO: 53382 - DNA, 468 bp, Glycine max
  Peptide Sequence Number=SeqID_145067
atgacgaaagataacccaaagccttacactagggcaatgaagggcatcgtgcatgagcctcaaggtggacccttgggcactagtaccctcgtcttcagagggttgctcgccctcgccttcagagggctacacgccctagcctttgtagggctacacgccctcaccttcagaggactacacgtcctcgccttcagagggtcatgtaccttcaccttcagaggactacacgtcctcacctccagaggactacatgtcctcaccttcagaggactacacgtcctcgccatcagaggactccacgtccttgccttcagaggactacacatcctcaccttcagagggctacgcgccctcaccttcagagggctacatgtcctcgccatcaaaggactttatatcctcaccttcaaaggactacacatcctcgccgtcagaggattacaagtcctcaccatcagaggacttcac

SEQ ID NO: 53383 - DNA, 821 bp, Glycine max
  Peptide Sequence Number=SeqID_145068
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccagtcaacaatcatcgatatgttggtgattgtattgactacatgattgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53384 - DNA, 330 bp, Glycine max
  Peptide Sequence Number=SeqID_145069
atgacattcatggggctccaaaaaagggggagaatggaggattgccttgaggtggacgtcgttttacaacgtcgtgactgggaaaaccctggcgttacccaacttaatcgccttgcatcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtaa

SEQ ID NO: 53385 - DNA, 870 bp, Glycine max
  Peptide Sequence Number=SeqID_145070
atgcagatatttgtcaccggggccaccggctgggtgggttcagcggtggtggaagagttgatcgcggcgggccatcaggtaacagggctggcgcgttcggcggaaaaagccgtggcgctggccgtcactggcgcacaggttattcgcggttcgctggaagatgctgacgtgctgcgtgacgccgcgcaatccgcggacgccatcattcataccgcctttaaccacgatttctcgcgcttcgtgcagaactgcgagcaggaccgtcaggtgatcgagctgctcggcgaggcgattgccggatcggatcgcatgctgctggtgacgtccggcctgtccggtatggcgcgcggggcgacggagctggatcagccgcagccggtgtcaccgcgtcagtcggaagcggcggcgcaggcgctgtcgcagcgcggcgtgcatgtggcgacagtgcggctggcgccgtcagtgcatggcctcggcgaccacggttttgtgccgattctggtgcggctggcgcgtgagagcgggatttccgcctggtgcggcagcggtgagaactgctggtccggcgtgcaccgtcgcgatgcggcgcgcgtctatcggctggcgctggagcagggcgtcaccgaacgcgtttatcacgcggtggccgatgaggcggtgccgttccgcgcaatcgcggagacgattggacgccagctcggattacccagcggcgagcgcgaccgggcacattttggctggttcgccaacatggcggcgggcaacatggcggtctccagccagcgcacgcgcacgctgctggactggtctgcaacccgcccggacctgctgagcgagctcgatacgcctgcctattacacccatctctga

SEQ ID NO: 53386 - DNA, 237 bp, Glycine max
  Peptide Sequence Number=SeqID_145071
atgagggacggcaagagatcttcgtacgtcattgggatcagggtgaattctggaattggcctcgggggaaagttcctcatcgcgttggaaccgatgccaaagtgggcattgccgaccgagcgagtcgtggttggagccggagcttggggggcctccctctggatgggggcgggcgctctaggctgtacgggtgctgaattggaggagttcccggcgcgagctaagaagctcggatga

SEQ ID NO: 53387 - DNA, 803 bp, Glycine max
  Peptide Sequence Number=SeqID_145072
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcctagcctatcggcgacggattcggagatacgagtgaaggttataaattggatgagggacgaaatccaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53388 - DNA, 288 bp, Glycine max
  Peptide Sequence Number=SeqID_145073
cggtatttacggcatttggttcgccagcaggcggctaaccacagggcgcacgtacagatccatgactgtctctaccagctcagcctcagcctgcagagccagggtttcgctccttttccatgccctactccggatcagttcagggcagaggtcgcatggcccggggattggcctgaggcccaggcaagggaggcacccacagaggctcccagcgatgcaaatgaggccctcatggacgaggagatgacagatttactcaatttcttgggagggaccggagccacatga

SEQ ID NO: 53389 - DNA, 720 bp, Glycine max
  Peptide Sequence Number=SeqID_145074
ttggaactcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53390 - DNA, 369 bp, Glycine max
  Peptide Sequence Number=SeqID_145075
atggctgatgcattagccaccctggcatccatgtttcaacttgccccctatggggatctgccgtacatgtgtgaattgggaatctcatgggtaggccagcgtgttggttcgcacgatgaggaagagtcgatgggaaataaggattgtcaagccatcaatatgtggaacaagaagtttactgacatgggtaaagggaagtgcttacatattgaacccctgtcaggaatacgcgaacaatgcaatgttccgccacatcctttgaatgatatgccaccccttggccctgtttccatgtggggaatgagatcaggggccatcgagacccaaagacgtcgaatggtcactgcttcattcttgatggcgatttag

SEQ ID NO: 53391 - DNA, 177 bp, Glycine max
  Peptide Sequence Number=SeqID_145076
atgtctcagcatatcagtgttacagttgtggattctagttcaaaatgcgatgtccctcattttaggataccttttaggaataatggaaggtattttcgatcactggcagaccatggtggtagccagagagataaaggcattgcggatctagtggacaaattttatcgttcgagttag

SEQ ID NO: 53392 - DNA, 612 bp, Glycine max
  Peptide Sequence Number=SeqID_145077
atgtccaaatcttttggatttgggatgaccgatcctctcgatgagtcgatctcttgctttctcataagggtgaacccttggaggactacacatcctcgccttcagaggactgcacgtcctcaccttgagaggactaaacgtcctcgccttgagaggactacatgtcctcaccatcagagggctgcacaccctcacctccagaggactacacttaccctcaccttcagaggactacatgtcctcaccttcgtagggctacacgccctcacctttagaggaccacacgtcctcaccttcagagggctacacgccctcgccatcagaggactgcatgtcctcaccttcgtagggctacacgctctcacctttagaggactacacggcctcgccaacagagggctacacgccttcacctttagaggactacacgtcctcgccaacagagggctgcacgccctcaccttgagaggactacacgccctcacctccagaggactatacatcctcgccttgagagggttgcacgccctcacctttagagggctacgtgtcctcattttcagtgtgctccacatccgcaccttaagagaatttaaggtcctctatccttaa

SEQ ID NO: 53393 - DNA, 780 bp, Glycine max
  Peptide Sequence Number=SeqID_145078
atggcatcgttcagccagatgcagtcccaatttcagtcccagatgcaatctcagggacttgcactacctctgaagcctcaggttggtccctcaggtcctcgagtaagcacaaaggagagttgtgttgatccctcaaggaatgatcctaagacgggtgactcagataggtgcggcttgtacatcgaagcaaatcctgcccacctggttgccctgagaagagtttatgagggatccactgttgttcataacactcctttgttgcctagtcaagtaaatgtgggtgtggaagaggttaaagatccaaatgctcccgttcttgtacccactgatgaggtttccttagtggggcaggcaattcacaccttccttgcctggccgacacatctggtcaagcctttatcacagcaggcaattgtgtctccggcaaaaccacctcaaacgttggatccagaggttgatgatccgctttatcttatgacattgaccatcctagagcttttcttgaggccttaccaggttacatgggatgccgccgtgttcgaggtctttaatccagacttcctgatctacacaaagtatgaagatctctccgaaatcgcatacagtggtcaatgtctcatcatatcagtgttacagttgtggattttgcatctgactaaaacaagtatgcgagcggggaattctgatctatatggattcctcgagccacagtccattcagaggtatgggaagtcacagtttgaggttgaaagatacataaagaattggatgcagaattaa

SEQ ID NO: 53394 - DNA, 249 bp, Glycine max
  Peptide Sequence Number=SeqID_145079
atgagaattgttgaaactggaaatgcaaagttaattgaaaatgatgaaattagtgggagtacagttccacgagaagtggaaattaaagaagttagagtgcaagtccctttagcttgtgcctgtagtagtaagcaaagctaccatgataattcaccaagatgttttgatgatgccaaagctcaaagagttgtttcaagattaaagaatgaagtattcaagattccactcaaagattcaagaatcaaatga

SEQ ID NO: 53395 - DNA, 243 bp, Glycine max
  Peptide Sequence Number=SeqID_145080
atggtgaaagttggaacctcttacgtgccgatcaacgtctcgatgttgaaccacgccaaaagtccgcgccggggttccgcggatgcgctcaacagggccctgcagcaggatttatttattctggaagctcctgcatcacagctgttccctcctgttcagctactgaggggtggtgccgctcacaattcgcacacaagcataccgagccggaacatcagcgctggcaagtgtagcgggtgctaa

SEQ ID NO: 53396 - DNA, 830 bp, Glycine max
  Peptide Sequence Number=SeqID_145081
tggtggccgagtatcgccagaccatagaccggttgctcgcagggttgaatcgcgacaacctggcgcaagcagctacaatcgccgcccttgcagaaaccatccgcggcttcggccacgtgaaggctgcgaacgtcgagaagtacaggacggagctggcccgcttgagcaccaacccgaagctgaaggcgcgctgcgcccgcgcgatgtacccaggtggtgcaacgcatgctcgcgccggaaaccattctcctggagcgcgccgtaggcgcgcccagtgcatttacctaccgcgaggtggtcgaactacatcttgtggtcgccagcgcgctgatggagctggcgccgacgccaggattcgccgcgctgccatggcgttggcgaccccgctgttcaagcccagcttcaaggccatgcgactacgatgcctgctgtccacaggcccgccgatcttcgcgcgcaagaccgatcccgcgtgccgcgcaaggcgggcaatgggccagctacaacatcatgccgcgcaagctcggtgcgggttcgacccgttcaagatcgccatcgcggcactggttgatccgttcggctcaaccggccaagggcgcgcgcctggtgggcgagcccagcagtgctgcagctggttgaacaacgacgacccaggccgtcaacgcgctggtgcgcaaccgccccggtggcggcaccttccatatcgaagacatccaggaccaggtcgaactggccctgatgcgctcgggccagcacgacgtcgcccgcgcctacgtgctctaccgcgagaagcgcacccaggaacgcgccgccgccgcggccgcctatag

SEQ ID NO: 53397 - DNA, 423 bp, Glycine max
  Peptide Sequence Number=SeqID_145082
atgtcggtctcatgccttcactcaatcgatctttgttactgtggtcgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 53398 - DNA, 125 bp, Glycine max
  Peptide Sequence Number=SeqID_145083
atgatgcatggctccaaactctttggtggaggatgcatgaatgaaaacgcaattcatggggctccggaaaaaaaggcgaggatggaggattacactaagcaatcactacgcatggctccaaactc

SEQ ID NO: 53399 - DNA, 189 bp, Glycine max
  Peptide Sequence Number=SeqID_145084
atgattatgatgggccaagacatttatagtagccaagatgaggatactacttcaccttcctctagtgaaagtgaagaagcaaaaggggaagaatctagtgaagaaatctaccccctagaagaaggacaaccattagtggttaaagagaagtgtaaggaggtattatttggcaccaagtccctaaaatag

SEQ ID NO: 53400 - DNA, 181 bp, Glycine max
  Peptide Sequence Number=SeqID_145085
atggtgagggcgcgtagccctctgaaggtgaggacgtgcagtcctctgaaggttagggcgtgcaaccctcttaaggcgaggacgtgtagtcctctgaaggtgagagcgtgtaaccctcttaacgggaggaactcaaaggcttttagtgataattcccaaggtggtcatatctctcttgatg

SEQ ID NO: 53401 - DNA, 399 bp, Glycine max
  Peptide Sequence Number=SeqID_145086
atgactgaggagccactagcactagcaccatcaccatcaccaacagcagcagaggaggagaccactccagatcagaccccacagccatctccatcctctgcatctgcacctgaggagactcagccatcagcactggatcttaatgaagatcagtcacaggaggaacatgacgcaaagcttgatcttgaattaatcttgaagcaatgcttatttgttgaagcaacctttgaggcagattggctaagcgagcctcattcgctttgtgaggctgccaactcgcttagcggatgcaaaaccctagaagaggataggttagagagtagcacacttagcacacagccagcccgcccaacgaggatgttgtctcttcttgcgcttagcgtgctcagactcgcttag

SEQ ID NO: 53402 - DNA, 768 bp, Glycine max
  Peptide Sequence Number=SeqID_145087
atgccgcgaaactgcacggattacctaacaatgggtgttaagtacctcgaagagatcaagaaaagatggcttctaggaaacataaaagtattggttcaagacccacagtgtagtatgacacaaggagataatgatttggggagaaacatcttacctgagaggaaggtagagcgctatcacactgagctagatgattttaaaactgaattggagaggcgtaatttccataaatgcctcaccaattttgttgatgggagcatagacttggctttggtgaaagagttctatgcaaacttatacagctctgagggctcttcaccaaagcaatccagagtcagaggccatttagtgaagattgatgctgacagtctcaacacattcctggagacacctgtggtattagcagagggggaaaccttacctgcatactccagatactgcaggttgcctatagactacagagagatagaggctgccttatgcatacctcgccgagggttcatcttgaactctgagggccatcctgggaaaattctcaggaaggatctgactacactagctcaggtgtggagtgtcctctcatactacaacttggcccccacatcacacacttctgacttgatagtggatagagctaggctgatctttggcctagtctttcgcatggatatgaacataggagtgctgatctctggccaaatgacctctatagccctgtctaacacttctagacttgggtttcctactctgatcaccgcactatgtaga

SEQ ID NO: 53403 - DNA, 737 bp, Glycine max
  Peptide Sequence Number=SeqID_145088
gggcattcgtaaaggcatcatcgctggttatcatgaatggctgaaagttcgtacacgagggttagattggctctccaagttgaaaattatcaatgaggagaacttcgaagctccggaagaggatgaagaagtccgagctctaaaaacagaactaggaaaagcaagacttgccaaagaaaaattcaagttagtcgctacagacgtccagaaagagtgtgccgagttacgagaagaaaatgcagctaccgcaagagcccttgaacaagaaaccaagagggctcgcaaggaagagcatggccgagacaaatttcgtggagctttttggggcatcaacaatgagctcaagcttcgaagggaagagagagaccagtcacgagcacatagcatggtcttgaaagaggagttagctgcttgctcaaggtccaagagaagcttgtctcagcgtttatgcgagacagagaccaacatgttagccatcgtcagcaagtaccaagaagaattaaatctagccatggcccacgagcacaaagtggtggacgagtatgcccgagtgtacgcggaaaaggaggctagaggaagggtgatcgactcgttacatcaagaggcaacaatgtggatggaccgatttgccattactttgatcgggagtcaagaacttccccgattgctagccaaggccaaagcaatggcggacacttactccgccctcgaggatatccacggacttctcagctatt

SEQ ID NO: 53404 - DNA, 632 bp, Glycine max
  Peptide Sequence Number=SeqID_145089
atgggaacaaatcaaaccggaaaaagattctatcaagtcaagattcaaggcctagatgtcaccagccttaaggagttggggcggttgatgggacctctccaaatgcaagccttccgcaaggtgtacggaaagattttagatttaaccatagcggagatattcacggaagtcgttgtatccctcacccaatactatgaccagcctttgagatgcttcacgtttggagacttccaattagtaccgactgttgaagaatttaaggagattctcggaagtcctcttgggggaagaaaaccgtatcttttctccgggtttcttccctccttgagcaagattgcagttatggtcaggggttcagcaagagagttggatcgtgtaaagcaaactcggaacgatgtagtgggcctaccacggaagtacttggaaggcaaggcaagggatatggtgaatcaagaggagtgggtcccgtttgtggatgtattagcgttgctaatctttggggttgtcctccttccaaacgtagacggtttggtggacctagccgcgattgatgctttccttgcatatcaccatagcaaagagagcccggtggtagctatcttggcggacttatttgatacatttgaccgaag

SEQ ID NO: 53405 - DNA, 811 bp, Glycine max
  Peptide Sequence Number=SeqID_145090
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatgggaatgtaatggaacggaatgcaatggaatggaatcatcaggaatggaatggaatggaatggaatggaatggaatggaatggaatggaatggaatcaacccgagtgcaatggaatggagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53406 - DNA, 111 bp, Glycine max
  Peptide Sequence Number=SeqID_145091
atgacacgcggaggcggcgggcccgatgacacgcggagataccttgcggttatccgcacccttttgtcatccagaggcggcgggcccgatgatacgcggagataccttacg

SEQ ID NO: 53407 - DNA, 141 bp, Glycine max
  Peptide Sequence Number=SeqID_145092
atggagaaaaataaacaacaatgtaagagaagcggaagacaaaggagaagaggtgagaggaggcgccatccactagggaataagccatggaagaaggagcttcaccaccaagatgagccttggatagaagcttggagatga

SEQ ID NO: 53408 - DNA, 507 bp, Glycine max
  Peptide Sequence Number=SeqID_145093
atggggatgaggggttgcatcagttacaatcccgttcttgctataaggcaacttggctaccctatgagaggggcaccactaggggaagagctcgcgcctgtcatttcacgaggtttcaataagaccaacatggagacacttcagaaggtccacaaggcatgggaggttgtgcaaaagaaggacaaagaacttaggggcagtaacaatgggcccatcggtggctaccgtaagtggttgaaagcccacgtgcaaggtttggattggctctcaagtttgagaaccgctaaaacagaggaagttgaggcaccggaggaagacgaagaagtgcaggcccttagggcggaacttgagcaagcccaaatagttaaagaaaggttcaaatcagcagctctaaaaatccgaaaggagaataccgaactgagagatgtaaatgtggctaccaccaaagccttggaacgagaaaccaagagagcttgtagggaagaacacggctggaacaagttctga

SEQ ID NO: 53409 - DNA, 528 bp, Glycine max
  Peptide Sequence Number=SeqID_145094
tcaaggtcaagagcctaggaaccaccagtctaaaaggattggggcaattgatgggtcagctccagcaacaagcgtttcacaaagcttacggtaaaatctgggacctagccatggcagaagtctccacagtggccattgcctccctcacccagtattatgatcagcccgttgagatgcttcacctttggggacttccagctatcacccatgctaggatttctaagatagtccaaatctcggcacaggaattagactgcggaaagcaagtcgaaaatggggcggttggaatactgagaaaatgtttggaggtaaaagcaagaatcttggcaggtagaggccactgggcctcgttcatagacattctcacactgttgatcttcggaggagtcctctttccgaatgtggatggtttggtggacctagcagcaatcaacgcttttctcgcctatcataaccacaaggaaagcccggttgtcactatgttagccgacctatatgacaccttcgaccgaagatgtgagaagagca

SEQ ID NO: 53410 - DNA, 468 bp, Glycine max
  Peptide Sequence Number=SeqID_145095
atgaagcacttcactgacaccctcatcagtgccaacataagttgtaagatccttcctcaagagcttccacggcaagccctcggtgttaagaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 53411 - DNA, 543 bp, Glycine max
  Peptide Sequence Number=SeqID_145096
atgacaagcagagaccaagtttggtcattctcacccttgtattatccagagcacggcgggcccgatgcatacgcggagataccttacggttattccgcaccctcttgtcatccagaggcggcgggcccgatgacaagcagagactttttcaagtctaacaagttatctagaactacaggcggcgggcccgatgatacgcggagataccttacggttatccgcacccttttgtcatccagaggcggcgggcccgatgacaagcagagaccaaaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatga

SEQ ID NO: 53412 - DNA, 537 bp, Glycine max
  Peptide Sequence Number=SeqID_145097
atgactagaggcaatccatctgacttacaaccctttgatcctgagatagataggacatttcatagattagttaggcatcattttataccttttgatcatcctgagcattccattactggtgaatctgtgcattctgttattggtgattttgaacatcctgattttgagcattataattttgagcattctgattctgagcattctgattttgaacattctgagaacatggcacaacctccaccccatgagaggactctaagggaaatggctgcacctgatttcacctacgaaagcttgtgcatccaataccctgatgaggatgtcccatatgttcttaaaactggattgattcatttgcttccaaagtttcatggccttgcaaaatttgaaggaatttcatattgtctgctccaccatgaaaccctcagatgtccaagaggatcatatatttttgaaggcttttcctcattctttagagggagtggcaaaggactgcttgtattaccttgctccacggtccatcacgagctgggatga

SEQ ID NO: 53413 - DNA, 111 bp, Glycine max
  Peptide Sequence Number=SeqID_145098
atgatgacaatgatagtaaacacattaccagtattctactatgaaaagatggtgggctacacaccttcaagctttgcggatttggtcttcgccggccataacccctgctag

SEQ ID NO: 53414 - DNA, 468 bp, Glycine max
  Peptide Sequence Number=SeqID_145099
atgaatgttttgggtggtgcaacactcttttgtaaaatcactcgtgcacccaacatcttcaagatttgtgcacatagggactcattaggtaggaataatcaacatgaaaatacagaaaaaggggttcccatgaaccctaagagaataaaggtcattcctgagtggcccgctccaccaagtgtaagaaaaatttggggcttccaagacttaacaaacttttacaaaaggtttgccccatatttttctatacttgtagcaccactcattgagttggtgagtgtcgcaacctacccttcggcgggagggcgacgcgtgactcgcgggaggcgtgttccacgaaaggaatacgcgcggagtcgccaccaacgtttatttgaggaaaacgtcggaaaaaccggaaaagacgcgatctacgaacttttaagtgaaaggctcgggagttgtatttacgcacggggaaggtattag

SEQ ID NO: 53415 - DNA, 217 bp, Glycine max
  Peptide Sequence Number=SeqID_145100
ttgtcccaacgtgccctttgcgggcgagcgagggcgaggctcgtgcgctttccaaaggaggaaagatgcgcggagtcgccaccaatgaaggtattagcacctcttacgtcgacaaaagcggggcttttgctcctacgtaccctcctttggagaggaaatcaaacctacgtagttctttcttatgcgtgaatcaagtgattgattttttacttgaggg

SEQ ID NO: 53416 - DNA, 819 bp, Glycine max
  Peptide Sequence Number=SeqID_145101
accacatttcgagaagatccaacggttaacgcaggctgggaagtgtttttaccaaggcagcttcatgtagctttctctagaagcttcattaagaggattcctccagaagcttcctcgaaagataaagaacttaggggcatccgtaatggcatcatcggtggttatcatgaatggctgaaagttcgtacacgagggttagattggctctcccagttaaagattatcaacgaagagaacttcgaagctccggaagaggatgaagaagtccgagctctaaaaatagaactaggaaaagcaagacttgccaaagaaaaattcaaggctcgcaaggaagagcatggccgagacaaattccgtggagctttgtggggcaccaatagtgagctcaagcttcgaagggaagagagagaccaatcacgagcacatagcatggtcttgaaagaggagttagctgcttgctcaaggtctaaaagaaacttgtctcagcgtttatgcgagatagagaccaacatgctagccatcgtcagcaagtaccaagaagaagtgaatctagccacggcctacgagcataaagtggcggacgagtatgcccaagtgtactcgaaaaaggaggctagagaaagggtgatcgactcgttacatcaagaggcaacaacgtggatggaccgatttgctcttaccttgaacgggagtcaagaacttccccgattgctagccaaggccgaagcaatggcggacacctactccgcccccgaggagatccatagacttctcaactattttcagcatttgatagacttaaatggcccatataattag

SEQ ID NO: 53417 - DNA, 241 bp, Glycine max
  Peptide Sequence Number=SeqID_145102
atggcaagtgccatgtatataagagcacaacacttacgatgcaaacaagactcatcaaacccaagctttgcgcttgttgatccttataggtccacaaaatccaaggctcgtccttggtatgcctcagcacaactccataggcttgacaaaacacaaggcaaacatgtcaccagtccaaggctcgacaaatccaaggttcatcctttctttttactaagtctcgtctccataggaactaaag

SEQ ID NO: 53418 - DNA, 759 bp, Glycine max
  Peptide Sequence Number=SeqID_145103
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatttggctctgtcacacaggctgcagtgcagtggtgcaatctcatctcacagcaaccttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53419 - DNA, 411 bp, Glycine max
  Peptide Sequence Number=SeqID_145104
atgcattcatgggtgaggggtcagtggattccttttgacgcagatgccctcaaccagttccagggtgacccactagtattggaggaaagccaggagtgcgagttcagtcagaggagaaacagggccaacgagttcgacgaggaggccattggccagctgttatgcacaccggggcaggatttcgcccgaaccgctgcagggaggcgggtgcggatcatgcgcaccagcatgaccaccttgacccagacgtggatgacattgctgctcaacaatgtcttgcctagcgatcataactccgatctccctctgccgaagtgtatgccacccactaggcatcctctagacccggataagtctaacagggccctggggttttcggcattgatcatgggtctctgccagtcattcagg

SEQ ID NO: 53420 - DNA, 246 bp, Glycine max
  Peptide Sequence Number=SeqID_145105
atgaaggagaagaagttcaacaaagtgatgaacagaatggacaggcacggcagaagccacgatgtccagaacatccctttcgacatcaggaaagcgcagcagaataccaaaagaggtcaagaaagccatcacagcaaaggattcagctactggtggcaaggctatggtcacataaagcccttttgcatcatactaatgcctccacatcatggaactcaaagtagcaacagcagaaagaagatttga

SEQ ID NO: 53421 - DNA, 495 bp, Glycine max
  Peptide Sequence Number=SeqID_145106
atgtgtgctatcaggcttttcgtcttacagacagcaaaaaagaatgtttatacggataaccactcgggtatttccgcccgtcagcgtggctccaatgttagtatgacagatcttgtgagcgcggaagatgacataaatctccgcgtgtcaacgggcttgtcggccgcgattgacgaagggcgcaaaagacgactaaaaaagaatgtttatacggataaccactcgggtatttcctcctgtcagcatgactcaaatgtcagtatgacagatcttgtgagcgcggaagatgacgtaaatctccgtgtgtcaacgggcgcagaagacgacacagcaaaaaagaatgtttatacggataaccactcgggtatttccgccggtcagcgtgactcaaatgtcagtatgacagatcttgtgagcgcgaaagatgatgtaaatctccgcgtgtcaacgggcttgtcggccgcgattgacgaagggcgcagaagacgacgttag

SEQ ID NO: 53422 - DNA, 213 bp, Glycine max
  Peptide Sequence Number=SeqID_145107
atggtctcagtaaaattacgatctcggtttcgggagaaaacgaaatcatatgaagacagtacaagtggaggtttcaatcccttctccgtatctctgacgttgggaactccatcagagcagtcggaggaaaaactggaggaatctcagggaaccgctagagatatcgttgtcgttgttggaagacacgtgagcccgcttagaggtaagagatga

SEQ ID NO: 53423 - DNA, 204 bp, Glycine max
  Peptide Sequence Number=SeqID_145108
atgcaaaagaatgcacatgcaaatgcatgtacctcagtcataacagttgattcattagaagatataaattgtgaatctccacaagcatctgattctaattctttctctgacgatgaaaattgcgaatccaatactaatgaagctgcaatcgatactgaaggtaataattatagctctgatataacgttaaccgatatcaactga

SEQ ID NO: 53424 - DNA, 501 bp, Glycine max
  Peptide Sequence Number=SeqID_145109
atggagccggacactaccgataccgcaccaaattcgccgatggcgcgcgcgttggtcagcaccacgccgtacagcagcgcccagcgaatgtttggcagtgttacgcggcggaacatctgccagccagacgcgcccagcagcacggcggcttcatcttcgtggctgccctggctcagcatcaccggcaccagctcgcgcaccacaaacggacaggtgacgaaaatcgtcgccagcaccatacccggccaggcaaacatcacctggatgttgtgcgcatcaagccagccgccagccgggccgttcacgccccagaacagcagatacatcagaccggccaccaccggcgacacggcaaacggaatatcgaacagcgtcagcagcagctggcgaccggggaaagtgaagcgcgtcaccagccaggccagcagcgtgccgaacaccaggttaaccggcacggtaatcagcgccaccagcaccgtcagccaagatagcatgcagcat

SEQ ID NO: 53425 - DNA, 497 bp, Glycine max
  Peptide Sequence Number=SeqID_145110
atgagtcatcattcatctagtgttaatggcaagggtactagtcataaggaccctctatctagaatcttagatgagttgagttctctcaagttatcgaaagaaaaactagaaagaaaagaaaaagaaaaagaaaaagagagggtaaaaataaatcaagatgagagggaacaaataagggaagaagaaagaaggaaaatactaaaagaattaagaaaagaaaaacatgcctcctatagtagtcataactcttgcaagagcctaagtgaggaacttcgtgattattatgaaggaaggcataggtcacatcttagacctcactcccatatgagagaaaaggaaagaaagcctcaagaggctaacattaacctcccgtacttccatgggaaggacaatttagaggctaacttagattgggaaataagggtagagcaacaacttaaaaggaagtctacttcaaaattttatggctctcactcttatccaaagaaagaccaagg

SEQ ID NO: 53426 - DNA, 604 bp, Glycine max
  Peptide Sequence Number=SeqID_145111
atggaagagggattttcccatggttcagttccaattattttaggcatgccatttatgaaaacatcccgaaccaagatagatgtttatgctggcacattgtctatggaatttggtgatattgttgttcattttaacattcttgatgccatgaaacatccatctgaggattattctatttttcgtgctgtgataattgatcagattgttgatgattatatgtttgattttgattttattcttcatggtaggaaacatccatttttgtctgatctgcatgcttgtcactccttatgcattgaatctgaatctgagtttgaatctgatcctgtatctaatttttatgctgagaatgaatctaaatttgagtctggttctgattttctgggtgttgtacctcttgatgttgattttttagagtcagaatgcactaaccatgttgcaggaagtacatatacttctgacttgctttatgaggtacaggctaaggaaccttctttttctcctaccctagttcctcccactgctcagccaccacccacactaaagttgaagcccttaccagcaaccctcaaatatgcttactggaggacaaggaaaattccca

SEQ ID NO: 53427 - DNA, 393 bp, Glycine max
  Peptide Sequence Number=SeqID_145112
atggcacagaagaagagcactccaatcactcctaccacatccagaaggagcaaagttgcaatcccttccaagaagaggaaagaaatttcctcatctgattctgatgatgatgtcgaaccagatgttcccgacatcaagagggccaagacatcagggaaaaagacttccccaacaggaactctcagaaggatcttacaaatcattccaaggctgctggacttcctggctgaaaacagtcaccaaggggaggagaaagcctgtcagctcctggattcattgtcaacattccctcatccaccaaagcaccataacaaaccagaacgacctgaattcagagtatccagccatacaaagtgtttgtccaaagtggttcagattctcccctgcctgtaa

SEQ ID NO: 53428 - DNA, 204 bp, Glycine max
  Peptide Sequence Number=SeqID_145113
atgccaaaagatagggggacttgtcttgatttcagggattgtcctcatcaaaaagggggagattgtagacaaaggatcaagctgaatgttttgatgatgccaaagtttcacatgcgtctcaaagctttattcaagacaaagaaattaaagatattcaagatggatgatcaagacaagtctctagtcttagaaagggtatattaa

SEQ ID NO: 53429 - DNA, 395 bp, Glycine max
  Peptide Sequence Number=SeqID_145114
atgggtgccaagtacctcgaagtggtcaaacaaaagttgcatgccaccaaacaatggtccccagacgaaattaggatatctctgcatgcaactgactcgttgtccctggatgacaaaggcgcagaattcgtctatgcgcgtttaccaccgaacttgctactcttgaatgataaaggtaaaaatgcgggaccaactggttcccgcatgtcatcgggcccaccgcctctggatgacaaaagtatgacagaaattttctgcgcagaagatgacgtaaatctctacgtgtcaacgggcttgttggccgcgattgacaaaggtatgacagaaattgtcgacgcggaagatgacgtaaatctccgcgtgtcaacgggcttgttggccgcgattgacaaagg

SEQ ID NO: 53430 - DNA, 438 bp, Glycine max
  Peptide Sequence Number=SeqID_145115
atggtggtttacaaaccttcaagctttgccgatttagtttttgtcggtgaaaggattgaaatgggtctgagaagaggcaaatttgagtatcctgctttgatgaatgggaagcctagggaaaatggagagaacaagaaggagggaggaacccatccaagaaggccacccctaaatcatccacaaaacccgtctgccgcacatccgatatcaaacaccacccttaacacaaaccaaaacatcaactacggaaggaattttccagaaaagaagcctgtagaattcaccccaattctgttgtcgtatgctaatttgctcccatatctactcaataatgcaatggtagccataataccaacaaagattcctccattttcccgaggatacaactcgaatgcaacatgtgcttatcatggaggagtttcagggcattccatttag

SEQ ID NO: 53431 - DNA, 688 bp, Glycine max
  Peptide Sequence Number=SeqID_145116
gactacacgtcctcgccttgagaggactacacgtcctcaccaccagagggctgcacgccctcacctccagaggaccataagtcctcgccttgagaggactacgcgtcctcaccatcagagggctgcacgccctcaccatcagaggactacacgtcctcgccttgagagggctacacgccctcatcttggagggctgcacgccctcaccatcagaggactacacgtcctcgccttgagagggctacacgccctcaccttgggactacacgtcctcaccatcagagggctgcacgccctcacctccggaggactacatgtcctcgccttgagagggctacacgccctcaccttgggactacacgtcctcaccatcagagggctgcacgccctcacctccagaggactacatgtcctcgcccagagggctgcacgccctcacctccagaggactataagtcctcgccttgagaggactacgcgtcctcaccatcagagggctgcacgccctcaccatcagaggactacacgtcctcgccttgagagggctacacgccctcatcttgggactacacgtcctcaccatcagagggctgcacgccctcacctccagaggactacatgtcctcgccttgagagggctacacgccctcacattggtactagttccctcaccgtgagaggactacac

SEQ ID NO: 53432 - DNA, 453 bp, Glycine max
  Peptide Sequence Number=SeqID_145117
atgaagtcatggacagctatggttaatatctcccgcgagacctttgagcaaactgagcgacgtctacgccaggtcatcactaaggcacgactacgcatatatccgggcacatacgcgttcgttgaatttccgttggatagatttcccagcgctgtccgcgcagatgcacttgctctggtgcgagatgacgacgtgtggagtcagcttgtgcccagtgacgggacgcacgacgaacagttcgggttatttcgattccatttccctccgggtgccgacaatagcggcttcgtagggtggctagccacgcatttcaagaatcggtttggcaccggggtatttgtcacgtgcggccagaatcagtcggatggtgggatattcgactactggggtgtgccgaagacgctcgcggcagaagtgtttaatgaggttcagcggctggttgaggggcgctag

SEQ ID NO: 53433 - DNA, 678 bp, Glycine max
  Peptide Sequence Number=SeqID_145118
atggagtataacatcatgaatacactccaacatatgaccatggtagctacagcctaccaaacctcccatgaatgttcggaagaaaccattatagacattttagtggcaggattttccgaacaattaaaagctcaacacttcattggagacccatctatgtggaaagataggtctgcagaattgttgtcaaaccttaagtgtagaaccttagcagactttaggtggtacagagatactttcctaactagggtttacaccagagaagatagacaacaacctttttggaaagaaaaatttctagccagtcttcccagatcattaggagacaaggttagggataaaattcgtagtcaatctgccaatggagacattccatatgaaagtttgagctacggtcaattaatttcttatgtccagaaggtagccttaaaaatttgtcaggatgacaaaattcagagccaattagccaaagaaaaggctcaaacaaagaaagatttaggttatttctgcgaacaatttggtctaccggcctgtccaaaacaaaagaagaaacaatcctctaggaaagaaatccatgagaataaaccggtcaataaaaagagattttcaagaaggagatattcatacaaaccctcaaccagtaaagaaatggaaaatcctaaacaaaaaataaaataa

SEQ ID NO: 53434 - DNA, 322 bp, Glycine max
  Peptide Sequence Number=SeqID_145119
atggccacaatgatggaggccatgatgagcttgaagaagataatggaagccaatgcggttgcagttaccgctacccacgctgttgcttgggtgaacccgatgcccccatctagcctcaaccaaatgaatcatccaacctcaactagggtaggcaaagatttgggaagtacaggcggccccatttatgcgcaaattcaaaacaagcatgccttcccaccatatggcttgcctcccaactatacaccacccaatgtggcatacactcccaatgagaatgtcaataactgcactcccatactcgttgagagccgacaaacccaaa

SEQ ID NO: 53435 - DNA, 225 bp, Glycine max
  Peptide Sequence Number=SeqID_145120
atggggatcgcacccacaaagacacccagtggacctgaagaagtccaacagggccctggggtttccagctctgggattgtgcccgcaagacacctagtggacccaaagaaggccaacagtgtcttggagttgccagctctaaatacgggtccctatcagttcaagggagtgcctgttgcccccagcagggtcatcaggccccctaccaatcgagttttcgtctag

SEQ ID NO: 53436 - DNA, 815 bp, Glycine max
  Peptide Sequence Number=SeqID_145121
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattctgagacctgataaacttgatgggcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53437 - DNA, 317 bp, Glycine max
  Peptide Sequence Number=SeqID_145122
gtatgctagaagtagtgtctaatccttggaggtttacagtagggaactggttatgtgactcagatctggttagtcctactggaattgaacgggttctaaccgaaaaagaccttctggctgactcatattcagacctagaggcttctatccttgatgaaaaagaatttctcctattgaaggttatctctacctttccggagttatcttgcttaatatgctctatggttggagcgggtcggggaatagacgattgtttatctctgtttggagatcttgaattgtcattggctttgttgaagaattttctagtctcttga

SEQ ID NO: 53438 - DNA, 342 bp, Glycine max
  Peptide Sequence Number=SeqID_145123
agcttgagacacgcatggattcttatgagaagatcgtctctgatcttcaagaatcaatgcaaaattcattcgagatgatgcagaaatctatcgagggactaatggtttcgcttgcaacccaacataagggacctaaaatcacaactgaggatggaaatcatagtgggactcatgaacccattgtctcggtggtggatagggcgcaaatcccttttccctcttttgatgaacttgcgagattgaagcaagaagattccctgattgagtatcttgagaggtttgacacacttttggctcgtattgctataccagaagagttagcattaagtttctttctctctg

SEQ ID NO: 53439 - DNA, 866 bp, Glycine max
  Peptide Sequence Number=SeqID_145124
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgattctgcacacaattaacgtgacagtaactgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53440 - DNA, 456 bp, Glycine max
  Peptide Sequence Number=SeqID_145125
atgaccatgattacgccaagctcgaaattaaccctcactaaagggaacaaaagctggtaccgggccccccctcgagaatcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 53441 - DNA, 633 bp, Glycine max
  Peptide Sequence Number=SeqID_145126
atggctccgaagaaactctccacgaagaggtctagaagagacgccacaggagaagggtccagtgccgaccccgagtttgatagtcatcatttccggagcgccgagcaccagcagcgcttcgaggccatcagaggatggttgttccatagggagaggcgtgtccagctcagggaggatgagtatacggactttcaggaggagatagctcacagacgttggacgtcgctggtgactcccatggccaagtttgaccctgagatagtcctagagttctatgctaatgcttggcccacagaggagggagtgcgagacatgcgttcgtgggtgaggggtcagtggattccctttgacgcagatgccctcagccagttcctggatgacccgctagttttagaggaaggtatggcgcctaccaggcaccctctggacccagaaaagtccaacagggccctggggtttccggtgctgatcacgggcctctgccagttcttcggagttcccatcactcccagtaaagtaatccgaccgccgatcacccgggccttcatcgagaagtactgcacggctaggcaggcgcagggtgatgcacataacgccgcagacgcaccgccaccacctcggcaggccgattga

SEQ ID NO: 53442 - DNA, 111 bp, Glycine max
  Peptide Sequence Number=SeqID_145127
atgctagcggtttcaggcaatggagtagcagattcccttgatgatggtgaatcagcttcaatttctaagtccagaggaactaaattgcctgtgggagatctatgcaaataa

SEQ ID NO: 53443 - DNA, 114 bp, Glycine max
  Peptide Sequence Number=SeqID_145128
atgtggaaattcttcatcgttcttcacgtcgttcttcatccgttcttcgttccttcttcgttcttcaacggttttcttttcttcccttttgacgtgcttaagccatttatttaa

SEQ ID NO: 53444 - DNA, 207 bp, Glycine max
  Peptide Sequence Number=SeqID_145129
atggaagagaagatgataacaaaagatgatgacaaaggtgatgacaaaaagctcaaaggtcaatcaaagaatgagttcaagatattcaagagatcaagatttcaagaatcaagattcaagagatcaagattcaagactcaagattcaagaatcaagaaaaagcttaatcaagataagtatgaaaaggttttttcaaaaactgagtag

SEQ ID NO: 53445 - DNA, 417 bp, Glycine max
  Peptide Sequence Number=SeqID_145130
atggaggtcgacatggaggccatgaaagagcaaatggtcgcaatgatggaggccatgatgagcgtgaagaagataatggaagccaatgcggttgcaattgccgctaccagcgctgttgctaaggtgaacccgacgttcccatccggcatcaaccaaatgaatcatccaacctcagatatggtaggcaaagatttgggaagtacgggcggcccccatgatgtgcaaattcaaaacgagcacgccttcccgccatatggcttgcctctcaactatacacacccaatgtggtgtacactcccaataagaatgtcaataagtccactcctatacccattgagagccaacaaccccaaactgatcatgcacatgtctcttaaaccgtgggggagacacatgaaattccccatcataatctag

SEQ ID NO: 53446 - DNA, 411 bp, Glycine max
  Peptide Sequence Number=SeqID_145131
atgaacttctttgcctacgatgataacaccattttatatctacattttacacctcccctgaatcaacagacatgtggtagacagatacttcattcccgtctacatgcctggacaactaaaataacccaatatatactgggtgctccccaaccactggaaatcccatcacatgcaaggaaatatctgaaacaatgtgagaatcacttgacaattttaaggaagaatgcacctcctctgcaatgggacgtcgttacacttgaccgcggcattaaagataaaagtatcgtccggccatggtacaagtttctcagggaaaacgatttccatcacggagacgaggtatcattctactatcggccacatgaaagaatttgggaaatagtcatcagaagagaaaagaagtggcaataa

SEQ ID NO: 53447 - DNA, 214 bp, Glycine max
  Peptide Sequence Number=SeqID_145132
ggctttttccggaggagccctggtgcttaccaacatggatggcgaagagctaccttcacccgatcatcttgagctaccttctggggtggggacaaaacgtggacagcagaaaccaatcaaggaacggatgcaagtggggatggggtcacgaccgactgattattgccctttctctgcgctagacaagcagagaacgtcgctgcaaggcagccct

SEQ ID NO: 53448 - DNA, 255 bp, Glycine max
  Peptide Sequence Number=SeqID_145133
atgtcgggaaaccatgtcaggctgcgcaactgcttagaatcggccaacgcgcgggcgatcgagtgcgggcctcttgcgctattacgccagctggcgctaaagggcggatgtgtgcatactggcgattactatgttggcactgataacgagggtgttcccagtcacgaagtgcgttcatgtggcagagaaaaaggctgcaccggtgcgtcagtcagaatatgtgaatacgatatattccgcttcctcgctcactga

SEQ ID NO: 53449 - DNA, 1191 bp, Glycine max
  Peptide Sequence Number=SeqID_145134
atgtcctcaccttcagggactacatctcctcacctcagagggctgcccgatctcgtcttcagaggactacacgtcctcactttcggaggactacacgtcctcgcctttagagggctgcacaccttcgccttcagaagactacacgtcctcaccatcagaggactacacgtcctcaccttcaaagtgctacatgccatgactatcagagggttacacgccctcaccttcaggggactacatgtcctcgccatcaggggactacacgtcttccccattagagggcttcacaccctcgccattagaggactacacgtcctcgccatcctagggctgcacaccctcaccttcagaggactacaaatcatcgccatcagtggactccacgtcctctccatcagagggctgcacgccttcaccttcagaggacaacacgtcctcgccttcagagggctacacgttctcccattcagagaactacacgtcctcgccttcagagagctacacgtcctcaccttcagaggactacacgtcctaaccttcagagggctgaacgtcctcaccttgagagagctgcactccctcatcttcttagagctagatgccatcatctttagggagctacataccctcgctttcagaggactacatgtcctaaactttagagggctacacggtctcaccttcagaggactacacatccccactttcagaggactacacgtccccactttcagaggtctacacgtcctccttttcagaggactacacgtcctcgccttcagaggactacatgccctcaccttcagagggctacacgtcctcgccttcaaaggactacacatcctcccctttagaagactacacgtcgtcgccttcagaaagccgcaagccctcgccttcagagggctacatgtcctcggcttgagagggctacacgccctcgccttcagaggactacacgtcctccctttcagaggactacacgtcctccctttcagaggactagacgtcctatccttcagagggctacacgtcctcacctttagaggactacacctcgtccctttcagaggactacaggtcctctccttcagagggctacacgtcctcaccttcagaggactacaccccctcacctcagagggctacatgccctcaccttcagaggtctgcacttcctccttttcatag

SEQ ID NO: 53450 - DNA, 579 bp, Glycine max
  Peptide Sequence Number=SeqID_145135
atgagtgagatagaggaagtgcaagaacagatgaaggccgacatggaggccatgaaggaccaaatgacctccatgatggaggccatgttaagtatgagacagatgatggaggacaacgcagccgcagttgccgccaccagcgtcgccactaaggcgaatccaactcacccatccggcataaaccaaacaaatcatccacccatagatatggtaggtcagggtggagaagtgttgagaagtatgggcggcccctgtatggtgcaaagtaagaattctttcccattgtacggcttgccacctaactatacaccacccaatgcgatgcatgtgcctagcaaaaatgccagtcacttcgttcccattctccttgaaggccagcaaccccaattagggcatgcaccctttgctcaacctatgggagaagcccgcgaaaagccccgagatcacgctctaggcaagttcgagtcgtaccctacatatgccgctaagggaccagcctttggtggcatgcctcagcccaatgccatgggagccccacaacactgctcgctacaacccctacatttctcagtgggatga

SEQ ID NO: 53451 - DNA, 369 bp, Glycine max
  Peptide Sequence Number=SeqID_145136
atggtagtctgttctgggtcccaaccttctcttcacagggaacatgaaggtcccacagcccaggtaccacaacatctggaggatgagtcatctgaggccaccgtcccagagccattcattgtaggagaggaggcaggtgagacacaagtgagacaggtagctgcagtcactcctgagagatctcttgtggccacttcagagcctcttgcaccagtggtggacctatcctcgactcagcacgtagcagacctctccactcctatcctagagatacatgaggacctaaccacaccagtcctgactatggacacttctcctccagctactccagtacttcatctgaaagatgcggacggtgttcagacatag

SEQ ID NO: 53452 - DNA, 318 bp, Glycine max
  Peptide Sequence Number=SeqID_145137
atgtcatcaagcaaaggtccccggacgaaattagggtatgacaccacccctaagactagttcccaagcaaggactagcaacattaaatgcttcaaatatcttgggagaagtcacattgcctctcaatgccccacaaagaaaactatgattatgaggggtcaagacatttatagtagccaagaggagactacttcttccccttcctttagtggaagcgaagatcaagtaaggggtgaaaagtctagtgaggaagtctacccccatgaagaaggtgacctcctaatggttagaaagctccatgggaggtcaatcttgtga

SEQ ID NO: 53453 - DNA, 477 bp, Glycine max
  Peptide Sequence Number=SeqID_145138
gcaatccccaagagactcaacgtaaggatgcacatgccaaagttgagtatctgaaaacattgtatgaccaagtgaaggtgcaaattgcaaagaagaatgaaagctatgccaagcaagccaacaagaaaaggaaggaagtgggaatgatgagaatcatgaaactagccaaatacaggctaaagacccaagtggagaaggacgaaggcccaagtggagaaggacaaagcccccgagtggagaaggatgaaggcccaaacttatcttccttcaccggaagtggcgtctatcctgacttgtcttccttcactggaagtggcgtctaccctgacttatcttccttcactagaagtggcgtctaccctgacttatcttcctccaccggaagtttatcttccttcaccagaagtggcgtctacccggacttatcttccttcaccggaagtggcgtctaccctgacttatcttccttcaccggaa

SEQ ID NO: 53454 - DNA, 750 bp, Glycine max
  Peptide Sequence Number=SeqID_145139
gactacacgtcctcgccttcgaggactacacgtcctcgtcttagaggactacacgtcctcgccattagagggctacatgccctcgccttcagagggctgcacgccctcgcctgcaaaggactgcacgtcctcgccataagaggactacactccctcgccatcagaggactacacattctcaccttcagtgggctacacgtcctcaccttccaagggctacacgtcctggccttcagagggctacccgccctcaccttcagagggctacccgccctcgccttcagaggactacacgtcctcgccttcagaggtctccacgccctcgcctttagaggactacacgtcctcgccttcggaggactacatgtccacaccttcagaggagtacacgtcctcgccttcagatggctacacaccctcgccttcaaaggacaacacgttctcaccttcacactactacacgtcctcgccttcagaggacaatacgccctcctcttcagagggctacatgccctccccatcaaagggctacacgtcctcgacttcagaggactacacgccttcaccttcagaggcctacacgccctcgcctttagaggactacacatcctcgtcttcagagggctgcactccatcaccttcaaaggactacacgtcatcgccttcagatggctacacgccctctccttcagagagctacacgccctctccttcagagagctacacgccctttcctaccgaggactacac

SEQ ID NO: 53455 - DNA, 525 bp, Glycine max
  Peptide Sequence Number=SeqID_145140
atggcttccaactcccagcattttagcgccagaaatgatgctatggtcattagaggagtgcatgaggtagctacaaactcagctgcttcatctgaaactaagaagcttgaaggcaaactggatgcattggttaacttggtaacccagcaggccttgaaccagaaatctgtacctgttgcaagggtctgtggtttgtgctcctctgctgaccaccatacagacctttgcccttccatgcagcaacctggagcaattgagcagcccgaagcttatgttgcaaacatttacaatagacctcctcaacctcagcagcaaaatcaaccacaacagaacaattacaacctctccagcaacagatacaaccctggatggaggaatcatcctaatctcagatggtctagccctcagcaacaacaacagcagcctgctccttccttccaaaatgttgctggcccaagcagaccatacattcctccaaccaatccaacaacaacaacaacagccccagaaacagccaacagttga

SEQ ID NO: 53456 - DNA, 62 bp, Glycine max
  Peptide Sequence Number=SeqID_145141
tatgagtaacagtggtgatcattgtggcttagtcaagctaaattgtgatgaaaactgcagtg

SEQ ID NO: 53457 - DNA, 375 bp, Glycine max
  Peptide Sequence Number=SeqID_145142
atgaaggatatgtctatcctttatgaagatgctccagttcctgtacccactgatgaggttttcttagtggggcagacacttcacaccttccttgcttggccgacacatctggtcaagtctttatcacagcaggtagctgtgtctccggcaaaaccacctccaaagcccgatccggaggtcgatgatctgctttatctgatgacattgaccatcccagagcttttcttgaggccttatcaggttagatgggatgctaccgtgttcggggtctttaatccagatttccccctctacataaagcacgaagacctctcagaaatcgcacacggtggtcaatgtctcagcatatcagtgttacagttgtggattctataa

SEQ ID NO: 53458 - DNA, 264 bp, Glycine max
  Peptide Sequence Number=SeqID_145143
atgcaggaacaacaacaacaacaacaaagacaacaagcaactgaggccccttctctaccttccttagaggagtctagcaagcaaattgaagtgcctcaaccagtagcagcacttgcacctgaacctgtcaagcttcattctacacctgaaaaagaggatgagatacagccccctatccctcttccatttccacctagagcaattccaaacaaaaagatcgaagaagtggataaggagatcttggagaccttcaggaaagtagag

SEQ ID NO: 53459 - DNA, 111 bp, Glycine max
  Peptide Sequence Number=SeqID_145144
atgccggtgacggccgaaacacaattcggaaatgttcgatcggcgtcatccggcgatgcttcttcttttaaacctcgaccgctgatactttcctggccgacgtcggcttga

SEQ ID NO: 53460 - DNA, 474 bp, Glycine max
  Peptide Sequence Number=SeqID_145145
atgattatgaggggccaagacatttatagtagccaagatgaggctactacttcaccttcctctagtgaaagtgaagaagcaaaggggggagaatctagtgaagaaatctatccccaagaagaaggacaacctttaatggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgaaggtttggttcacaagagattaaatccttgtgctttgttggtgcccaaaataggggttcccatgaaccctaagagaataaaggtcattcctgagtggcccgctccaccaagtgtgttgagggaaaaagcctag

SEQ ID NO: 53461 - DNA, 87 bp, Glycine max
  Peptide Sequence Number=SeqID_145146
tgatcctaggtcgtttcccaacgaccagtgacaagccaaatgttcataatactacttgcagtaacactaatagtaacgatggcgcgg

SEQ ID NO: 53462 - DNA, 528 bp, Glycine max
  Peptide Sequence Number=SeqID_145147
atgtcggctttgaaagagcaaatggcttccatgatggaggccatgttaggaatgagacaattcatggagaaaaacgtggccaccgctgccgctgttagttcggttgccgaagcagacccaactctcctagctaccgcgcaccatcctcccccaaacacgttaggacgagaaaggaacacactggggcacagcaacaacccccatttgggatacaaccgggtggtttacccttatggattaccgcctaattacacgccgccagtcatgcatgatgacgcgggtcatgtctcttcccccatccttgagggggagcctcctcgacagcctgacgaggtccatgaagatcatcaagagtatgcccaagaggatgtcgattcctaccccctaatccctgtcgaggggccagcacccaacacattgcctcagcacaacctcactgcacaaccaatattcttgtccacagaaggaccacccccgacggcggaagaaagaaggaaactcgatctcatcaaggagagattgagagct

SEQ ID NO: 53463 - DNA, 219 bp, Glycine max
  Peptide Sequence Number=SeqID_145148
atgcacaagtccttgcacctaggccggccatcgtatctaaccaaaacattgaagcctttgctggggaatggcatcattaggtctaatggactgcagtgggcattcccaaggaatctacttgctcctgagttttttcatagcaaaattaaggctagtgcagtaatttttcaagtgagactttgctggaactccaacatgtcatttgcgtctgctcgttag

SEQ ID NO: 53464 - DNA, 495 bp, Glycine max
  Peptide Sequence Number=SeqID_145149
atgaaagaagcatatgatgaaattcagactccattggttccccaaatgccaactacattttcaaaggtgtccataattcaagagctggatgcaacggcatacgaggaagcacctgctatcgctttcaacatgtcctttgaatgtcacaaagcaaaaactttggtccctgaatctagtagtcagccgacacaaactggagaagcagtggttggtatcaaggagcatcaatcaacgctcacgggcatagaggagaagaggctcaagtttgattcaagagtgacaaccacaaacacattctcaaactacttcatcctaggagatcttgatgaggttggggttggaggccaagctggcatccatgaaggagagggaggaggaggttttgtggtggcggtcaaagcaggtttagatctgggaggggcgggtttgggtcttggtggagttacaatggtgcactggcagagaggaggatggcaacgacaagaaggaggatga

SEQ ID NO: 53465 - DNA, 720 bp, Glycine max
  Peptide Sequence Number=SeqID_145150
atgggatgtttgcaaagggagggtcgtttgcttcagggagagcataatcttttaggcgaagcatttcttgttatgtcttcttctgctgggatccaacaacaacaagatgttttaaggtggttactagaacctttaagcgttcagtggacacaattggagtggcaggataagtatttgtcaggtccacacggtttggttcagttgtgctcagatgtgcctgttatgtggtcaatttttcatacagtgacattctttgagagggcacttaagaggagtggattgaagaaagccaattggaattcagaaaacagctcaacaccaaattcaatccctttaaatccaatggcctctcgcatatcatggatggtgactcctctcttgaaactacttcgctgtatacattccctttggtctccatctgtaagtcaagctttacctggtgaggtcagagctgcaatggtcatgggtgatgttgagaggttcagtcttcttggagaagggaactctaaattaccaaaaggtgtcacagatggatctaagattgacatgaataaagaaggatacactgaacccaatgaatcagatattcgaaattggtttaaaggcatcagagacagtggtcttctacaagatggtagagcaatggttccggatgctcatggcattcttagtggatcagacttgaaagtggaagtgatggaggaaacaattccaggataa

SEQ ID NO: 53466 - DNA, 1332 bp, Glycine max
  Peptide Sequence Number=SeqID_145151
atgacaactattagttataaaaccatctttgaaaccggtgtagatgtggagagccccaaccaacacccttcttgtgccttgttttacttgtttcatcaagttagaagcactagggtttggaatcctaacatgtgccctcattgtgttgttcaagatctgacaagactgcatagtagcgatagtgttgttctcgtggcacgccctcaatatggaagctggcaaaatgcaagattgctcgccaatgatggaaggttcttcaaaaatggtaaccgtggttccatcagagcagttgataacaacattgttttggtaaatattcctcagaagcactcttcaaaagcaaaacaactccacagaggaaccaatgatattgttcggtacaaagagaccaaatgggcagcagaatgtgcaaaagctctagtaaaagctgagctttccaatgctaaacagacagtgaaagatcttttctctatgattggggaatccatgtacaatgcaaaagccaaaatgcgagacatggcaccactaaagaagtatgtcaaatcgagaaacgatgataatcagtattcacaagagaaactgcaagcggagaacgaagtcaaagcatcaagatccagcatgtttttcttctcaagagtagcacaaaaactgacgaacgagaggaagccagccattgaagcaatagatgagacaaaagagctcgaaatgatattggccacaacattgtctgatattgatatgttgaagaatgagttcaagtttgttaacaaaacagggaaaaggttacttcaaagaggtgagcctacaaaagaagaaatagaggcagcaaagaaagacttggcttccattacaaaacaaggttttaagtttatggcctctatggatgtcacaagaaatcaactgaagcatctcttgagagaaaaatctaaatcagaagccatgtctgttgcagaggaaaaggccaaatcaatagtgagtaacttgacacaaactcttggtaagctcaagtccaaaacagaagcagcaaaaaaagaaaaagaccttataataaatggagaggttatagaaaccaaagaagatattaaaaaggccttgttggagataaaggtgagtgaggaaagatttcaaggtgccatgcaagagctacaagcagtgaaatcatcagaagctttagccttggagaagctcaagattcttagggagaatgccatgaaagacaaaattagtaaagtaacaaagcctagtttgttaattatcatatataagtttcaatatgactatttgagaaaccatgcagggaaagcaaatgaaattgctgagaaggtaaaatga

SEQ ID NO: 53467 - DNA, 231 bp, Glycine max
  Peptide Sequence Number=SeqID_145152
atgggtgccaagtacctcgaagtggtgaagcaaaggttgcatgccatcaaacaatggtccccagatgaaattagggcaatagtttcgtggggctccggactcgatggtggaggatgcatgaatgacaatcaattcatggggctccgaataagatttgatggtggaggatgcacgaacaacgctaggcaatcaattcgtggggctccggactcgatggtggaggatgcatga

SEQ ID NO: 53468 - DNA, 225 bp, Glycine max
  Peptide Sequence Number=SeqID_145153
atggagcaagaagaatacaccaaagaaaagatgaattggagttacatagagtttgttgataaccaagatgttttggatctaattgacaagggtgccaatgatgtcgaggctgactgtaacatccatatacactggaaatgtgctactgacatagtcctagcttgttgtacaggctatgttgatgtgaatgaccagctggtggggatggatgaggaaaaggtttga

SEQ ID NO: 53469 - DNA, 183 bp, Glycine max
  Peptide Sequence Number=SeqID_145154
atggctgaatcatcaaagaaacgaaagggatcttcctccacctccactgctactgaccaccgccgccctggaacctccggagacccaccagcaccagttcctccctctttttcatctcctcgagtcattctagaccctaagtaccttgaccctgaatttttttatgaagaagcatttgggtag

SEQ ID NO: 53470 - DNA, 160 bp, Glycine max
  Peptide Sequence Number=SeqID_145155
atgactcacacaaagaaaactggtcaaatgacatctgaggctgcaaaggaaattgcagacacgattatgagtagaccaatattgtttctcctgttgactacaagattccttggaggagcaggcctcatagggaagctttatcgcccatggacatcaggat

SEQ ID NO: 53471 - DNA, 294 bp, Glycine max
  Peptide Sequence Number=SeqID_145156
atgttggatcctacatcggattcgttgtaccctgatgacattgatcattccacagctttttctgaagtcattgcagctcacggtggtcaatgtctgagtatctctattatacaattatggattcttgctttgaaaggattcaacgacagccaaggaagtaaatccaaggctgctactagatggattgtagttaaatattttactgatcaaataccattagaaccaaagagaatgaaggcaatttgcattcagtgggcaagatattatttgaaagttaaaaatcaaacactatga

SEQ ID NO: 53472 - DNA, 444 bp, Glycine max
  Peptide Sequence Number=SeqID_145157
atgaatgaggagaagaagtttgtggttaaggaggtctatgctatacttcctggagagggccagttgggcgaaggaatgttttataaacacttgtggaaactacctatcccatccaaagtgaagggcttgatttcgagaggcacacataaccacctccaaactatgggcaatctgaagaagggaaaaatcattgatgatactactagctttgaatgcatttcctgcaactcaagggcaaggtgctatgagtggtatggtgatgagagagttctaccagctgactatttcaatcatttttggcaacatagaggaaacatcaatggcaagaaaaccatcttagcatggggagcagggttgctatggatgctctcaagcatagagcatggacatggtgcaaagctaacattcatggcttcaattcatctctgtatgtatggtccctag

SEQ ID NO: 53473 - DNA, 228 bp, Glycine max
  Peptide Sequence Number=SeqID_145158
atgtggttcgtacaaccactatcaatcaaccaactttcacttgatttcactactcaagaagcatgtggccacaaacagttggtcctcttcttcttgattagcaatctgagctccctcatcatgttgaatgaagcggcagttgcaaagggatgtctggggcgtatccctgggggagaaatggttggaattataaagaaattcattaacttagatgcaggaactgattaa

SEQ ID NO: 53474 - DNA, 993 bp, Glycine max
  Peptide Sequence Number=SeqID_145159
atgtcttcgtttccgagctccgtagaacgaacggttgcatcgtctctgcttcttctcaacaccacacctctctctccctcgctttcaactccaaagtttcactctgattattccggcgatgcgcttctagagagaagaagtggaagcaagaggttcagagagatctcggtttcgtacggttcttataaatcttcgtcttcctcgctcaccgaggacgacgacgacgatgacgacgatggcgattcctcggagaaagacatcaaatcgggcagcgtgtcgtcctctgctgtcacgcgttacgatcagatgaagctcaaggtcgattctacttttctatgtgccttctcatcgattcttattttgtgtttgtttcgcttcgttatgtgtttgtgtttggaagcacaacgaaaacaaacaaatatgcgtgatctgaaaattcacttgactgattcttctaatgagaatcattctgtttttttcattctcatcgattctagtttggagtttgtttcgcttcgttatgtgtttgtgtttattgcgaggaagattcggaccaaggtcgcgtggaccacgtcgtgctccggcgaccggaagccgaacgtcggcgaggcggagaaggtgctgtctccggcttcggtctccggcgaggcctcgtcgtgtttgtcgagcagctcgagcgggatctccagtgagagaagcttgcgctacgctaagagatgcagaggcgcaattgtgagtgtggccggaatcaatcgcgagacggcggcggcggcgaagcgtcgcggcgccggttcgccgcacctgcatcggcgcggcgaagctatactgaagctgctctcttgttgcggtggctcctctgaagtgaagatccgtcaaatgctcggtgacagccctgacactagcaaagctctgcgaatgtataatctctgtctctcactctttctcacacacacgcagattgtggcatgcaacataaacttttacgagatttaa

SEQ ID NO: 53475 - DNA, 336 bp, Glycine max
  Peptide Sequence Number=SeqID_145160
atggggctagttgagggattgggcatcccaactggaaattctgagccactcttcaacagggggtttatgagtcaatgtgaatggaactcctgcttagaaagcataaccatgggagagccaatagctgcattgcctatgcactctgaccagccaagaaacacagttttgaccacacagatgctcaagaatactgtgagaaggttgatggaaacaaatgaaggtgatgagatgcgagagagagcagttaggcttaaaaacgccatccataggtccatggatgaagatggagtttctcgcatggaaatggattctttcattgctcatatcactaaatag

SEQ ID NO: 53476 - DNA, 111 bp, Glycine max
  Peptide Sequence Number=SeqID_145161
atgaatcaaaaggagaagtttagcaaggaagaaggtgttgataacattaatgaaggatattgtgggagcttgattggatgtctaatgtatctcacttcaacaagtttttaa

SEQ ID NO: 53477 - DNA, 603 bp, Glycine max
  Peptide Sequence Number=SeqID_145162
atggcattcatgggagagacaagcagtcagacagttgtgaacttcacattaggttttatttttccaaatggatccattggtcacaatgacagtggtgtttcctttcaagcttccactcaagttcctattcgagtacctaatagttgtgattttcaaacgttaaaaaccagaatacacaatacccttaagctaactgacaagcaaattttggatgaaatttactaccgacagcctttcacatatgcagatggtattttaaacttacttcaagccactatgacccctactcatgatgccctgctatattacaatgggaggtggaacatgtcacgccaaaatgagtttgttggttacttgttcacaggaaaaaatcctaaaaagtttgacatacccaccggatgtaccatggatgaactgaaagattcgatcaagcaagttgcgccttctgggattcccccttatgtgagggagaggtgtgaaatgtcgggtctgaaaacagaggagggaggagcaaaagatgagaaaaacaccgaagatagtggcggtggctttagtcattctccatcgtgtggccatagtgttagtgttgaagtgagtgtgtga

SEQ ID NO: 53478 - DNA, 72 bp, Glycine max
  Peptide Sequence Number=SeqID_145163
atgaggaatgttgagggagctggtgccggagcaagcaaaaagccatgcctcaactacgcggttgcctcatag

SEQ ID NO: 53479 - DNA, 231 bp, Glycine max
  Peptide Sequence Number=SeqID_145164
atgacaactccaagattaatttcagctttggtatcagttcgcaccctagaaaaaagagagtccattaaacagggtttgtggaaacaaccgactgctctttgtattaagtgtaaaacagacggggcaacaagaggattcccaggcacttctggttggaaactgactctaaccctgctcctcctcgctttcagccacccaaaatcagttcactggtctattaacactagctga

SEQ ID NO: 53480 - DNA, 747 bp, Glycine max
  Peptide Sequence Number=SeqID_145165
atggatggagatatctcaattctcttatctattccacatggagtgaggctgctcatagacttgcctctcaaaaactctcacttaagcatagttgtaaaagctgatttggcctggccattcgaaccggtccaaccagaacccggtggcataattgagccggtttctctaatggatcattcatactgggttgtgcacgttaaaggaaactatggttcgaaccttcaacttctcgccatcgatgagcgtgttgaggaagatgcattactccatctcctccatagcacgattctgcctcaacaacgcttggtgcagaacaattggtcgcctcttgatcacgttgggtttgaggtccacctactctcattgcagcggcgacaacggttacatgtggcgccgatggacaacgtcaaagcaatagggaaaaggccattcgtaccaatccaaccgggacctggtggcataattgagtcgtttcgttattggatcgttcatactgggttatgcacattaaatggaaactatggtcagaaccttcaacttctcaccattaacgagcacgttgaggtagatgcatcacttcatctcctccatcgcacggttttgcatcgacaacgcctagagcagaacaaccagctgcctcttgatctcattgggtttgaggtccacctgctctcgttgcagcggcgaaaacgtctacgtgtggcatcgatggacaatgtcgaagcaatagggaaaaggtcattatag

SEQ ID NO: 53481 - DNA, 1887 bp, Glycine max
  Peptide Sequence Number=SeqID_145166
atggggaacaaggatcaaactctagaccacacagttatagaggctccaattacatgtcatgaacttgttttaaacttaacttgctgtagaggaactgaaatatggaggattgagaattttcagccagttccattgcccaaatctgagtatgggaaattctacatgggagattcgtacatcatcttgcaggatgaggctggaactgcggccattaaaactgttgaacttgatgctgctattggagggcgtgcagtgcagcacagggaaatccaagggcatgagtctgacaagtttttgtcatactttaaaccatgtattataccattggagggtggagttgcatctgggtttaaaaaacctgaagaagagaagtttgaaacatgtttgtatgtatgcagagggaaaagagttgttagattgagacaggtcccttttgcaaggtcttcattgaaccatgaagatgtattcatactagacactcagaataagatttatcaattcaatggtgcaaattccaatattcaggaaagagccaaggctttggaagttatacagtttctgaaagaaaaatatcatgaagggaaatgtgatgttgcaattgttgatgatggaaaattagacactgagtcagactcaggtgagttttgggtcctctttggtggttttgctcccattgggaagaaggtaattagtgaggatgatattattccagagacaattcctgctcagctttatagtattgttgatggtgaggtcaagcctgtggaaggtgaactttctaaatcactgttggaaaacaacaaatgctatttactggactgtggtgccgagatgtttgtctgggttggtcgcgtgacacaagttgaagaacgaaaagcagcctgccaagccgttgaggagtttgttgctagtcaaaataggccaaagtctacaaggataacccggattattcaaggttatgagacgcattcatttaagtccaactttgattcttggccatcaggatctgctagtaccaatgctgaggaaggaagaggaaaagttgcagcattgcttaagcaacaaggcatgggtgtcaaaggaatgacaaaaagtacccctgtaaatgaggaaattccacctttgcttgaaggagatgggaagatagaggtatggcgaatcaatggaaatgccaagactgcattgccgaaggaggagattggtaaattttatagtggagattgctacattgtattgtacacctaccattctggtgagcggaaagaagactacttcgtgtgctgttggtttggcaaagacagtgttgaggaggaccaaacaacagctactaggttagccaatacaatgtctacctcattaaagggtagacctgtacagggtcgcatatttgaaggcaaagagccgccacagtttgttgctattttccaaccaatggtggttctcaagggagggttgagctctggatacaagaaattaatggcagacaaaggtgcatcagatgagacatacacagcagagagtattgcacttattcgaatttctggaacttctattcataacaataaatcagtacaagttgatgcagtgccatcatcattgaattctactgagtgttttgtcctgcaatctggctctacaattttcacttggcatggaaatcagtgttcctttgagcagcaacagctagcagcaaaggttgctgattttttacggacgagtaacgagtgcatccgaggcttcttcatgcttgctgtggaggctgttggtgatgctgatccaattaccattgttgaacaccttggaactggaaggcttgccatccccatgctcattgttttaatagagtggtggggagacacacaatgttcccctagagatgaattatga

SEQ ID NO: 53482 - DNA, 420 bp, Glycine max
  Peptide Sequence Number=SeqID_145167
atggatggttggcggaacttggattccataagtttgtctcgaaaatatatgatgaaaaagaaactttgggaagagttgtggcttgtatgtcgaggaggtttgaatgtctcctacaagaaaaatcaagaatcaaatgactcaaggagagatgataacaccaagttttttcattctatcaataattggaaaagaagatctaatgggttgaagggtgttatgaaatatggtagattggtggaggatcccaacattgtcaaggaggaagtcaagtgcttttttgagaagaaattcaaggaaagcgatgatcttaatttgaatcttgatggggttgctttcaattccattgggagggaagataatgagattcgtgttgctcgattttctaaatttgagatcaaacaagctattcatagtgtctag

SEQ ID NO: 53483 - DNA, 378 bp, Glycine max
  Peptide Sequence Number=SeqID_145168
atggtgttgagtgctaatgcacaccaacttggatggatattagaagggatggtcaatgaagttgaaagttggccctatatttttccagcttctgaggactttctctcatctaaccaacgaggtaaagttgaagtgaaatactttttgagatggtttcgtgaacgtaggcaagagcggactaagatccaaaggagggttgtgagcatgattctgttagcccttgctctcgagataaaacacaacgtgttgaagaagacaacaccaaaggccttgtggaagaagctcgagaatatctgtgtcaaagtcgttaaccaatcgtctttgtttgaagatggagttgtatcaactcaatatggagatgggaggagatctccatga

SEQ ID NO: 53484 - DNA, 132 bp, Glycine max
  Peptide Sequence Number=SeqID_145169
atgatgatcctaatcagcggtgcttatgtgggactagcagccataggagaggttggatcttggcaaagagaatgtaagggttatcaattttggaccattactgatgacaaaggctatttccaggatacttga

SEQ ID NO: 53485 - DNA, 164 bp, Glycine max
  Peptide Sequence Number=SeqID_145170
atgatgacaacaaaagatgatgaacaaaaagctcaagagaatcaagaacaagtcaagagttcaagaattaagaagaattcaagattcaagaagaaagcctacaaacaagaatcaagattcaagactcaagattcaagaatgaagaaaagactcaatcaagataa

SEQ ID NO: 53486 - DNA, 603 bp, Glycine max
  Peptide Sequence Number=SeqID_145171
atggcgggtccgaaaacctattggtgccacgagtgcgacatgagcatgtccctcacgctcccaccctcccctctcctctacccgccctgtcacacccacttcctcaagctcatggactccctaaccctctcccaaaatgacattgaatcctccctctttgacgtcgttttccaagacgctcttttacttctcaacccccttcctcaaaaccccgccccctcccctccctccacgtcaccccctccctcctctcctccctcgaccccagcggtgtcgtcgttcacagcgtcatctgcaaagaccaaattacccccattgccaaagccaaacaattaccctgcaaacacttataccactccgatggctcgaactccatgcctcgtgacggaagaggatttctacgggctgaggatcacgctcaaccacattacctcgcgccacgcgctcatcgaagaaaatgagaatcgcagcccccaaattgggaaaactccaggtgagagtcgcgttcagagagagaggttcgcctccatgaaagcgagcatggattttagaatttcctctcttttggacaagatttacaattccaaaattttagttaattaa

SEQ ID NO: 53487 - DNA, 1368 bp, Glycine max
  Peptide Sequence Number=SeqID_145172
atgggatcattcccaaaagcaaaacccaacaacactcacaccgacaccaacaccaacacccataacagggttatgggttttctcctagttttctttccggaagagaataacaatacaacaccaaccattgctaccaaaagtaccaaacccaaccttgtatcttcttctccctctccacattccttgaagagaattagttccagttccaacaatgcccttctctccaaagcccagtccactatctcaatatgcttcctcctcctcttcactaccctccttctcttcacactctccacattcgaacccacacaccacaaacctcgctccataccccccaaatccaaactccgcaaaaacacctcctcaagcgacgtcgctttcccctccactgcgctccagcgtatgggcacgctctaccgcagaggcacccgagccatgaacgacatcgtcgtttgccacgtacccgaagacactactcacgacgaattccgaatcttcctcagactcctccaccgctccggcctcacttccaaatccgacgtcgtcttcatcttcgtctctgcctcctcttcaaccactttcgctcacattgtccacgaagagaacacctcattcctctcgctcattaacctccacgctcagttgaactcgactcagtgggccaaaccgtccgagtcgaacttcgacgcgactcgtttcttgaaagctcccaagaaaggagaaccgctctggggaaagaaaattcggacgaattatagtggctcggaaggtgagttgagtcgggcgagttatgggtcggtgcttagttttgatgccaacgaactcgatccagagaactcgttggctggttttttggaccgagttccactcagtttgagaaggtgggcctgttaccccatgttactcgggcgcgtgaggaggaactttaaacacgtgacccttgtggatgtaaaaaatgtggtcatttttaatgacccactcggacgagtcaggaaccagagtcccgagtcggttttcgtgtaccctaatgcaaaacacggtaggaactccgagaggactcagtcgcatcacccggttaactcagtgattctgatgggcggcgcccgcgggatccggcgcgtgtcgcacgccatgctcgttgcgattgttcgggccgcaatgcagccgcacaagaggaagaactcggtgtccgactcggcgattctgagtcaactcgtaaggaacaagtttgcattgaggaacgttcacttaattgtctcgggggagtcgattccggaagcgagttcactcgctgggtcaacatcgttttcggattgtgcaataattcagcgggcatctggtaaaagtagaacaataatgagaaaatag

SEQ ID NO: 53488 - DNA, 234 bp, Glycine max
  Peptide Sequence Number=SeqID_145173
atgtcagttttagaattatacatagaaaaggatgttgctagtggttctgcgtttcattctgcaaattctgttagatcatgtggaaataatttatctaataatgagtcggaaccgtcaagaaatatgatgaagtcgccgacatggttcaaccagttacaattgttcaaccaagagaagcgttgtacatctctctatataaataaccaagtacagcagatccccatgaatatgtga

SEQ ID NO: 53489 - DNA, 820 bp, Glycine max
  Peptide Sequence Number=SeqID_145174
atgaaagaaccagaagaagatgcaagagaaaacatgcagcaaggaagaagaagtgagaaagtggagcctggacactacaaagttgtgattgtggatcacatccttcgtcatttctcgcttggtagacctcttgacattgatgaggtgttcaaggagacaaacattaggaaaaaggacaacacctgggtggataagagatatgagcaaacctataagaaattgcaagaaggctctagtggtgggacacagaccattaacactgaatcaagagttaaattgtgggttgatgttgttggaggcaagtctcagggacttctttatagggctggagacatgtcctcccattataggcttggtgcatacttgattgtggtggaattcatgtcactgcttacatgtcgtatagttggagatcaatgtgaaatgttgaaagaagaaactattgagttttgttcagagtacattgaaaaggtaaaacttgtggggcttcccaagtctcaacatgaggaaagagtgggagaacaagccaaacaggtgtttgtgttcaagatccttgtgatgaaaggtggtaagtggttctacacagaaaaatcattggtgttaatcttgaagatgatgattcaacccttgatacttgttgtcgcaacctacccttcggcgggagggcgacgcggggctcgtgggtgcatcttccaagggaggaaaatgcgcggagttgccaccaacgtttattcgaggaaaacgtcggaaaaaccagaaaggtgtggtctacgaactttaagtgtgaaaggttcgggagttgtatttacgcacggggaag

SEQ ID NO: 53490 - DNA, 297 bp, Glycine max
  Peptide Sequence Number=SeqID_145175
atggatcctcccactggaaaagttgatggttcccacaaaaagaaattaaggattaggatctatttgcgggtcatcacccaagacaaggaggatgacgataacaacgtctatgagaagtacgatatcaacaaagagaagttgaaccaattttttcaaatccgtagatacacttcatgggaggatgttagaaagaaggtgcagtccatccagaaacaaaacactgccctttacatgttgtcttataggggttatgattttcttgaacaaaagtcaatggaggaaaaacaacaaaactga

SEQ ID NO: 53491 - DNA, 138 bp, Glycine max
  Peptide Sequence Number=SeqID_145176
gcttttgaccatgacttggtagaacctcttgacgtgtttgatttgtttccacgtttcttaagtgagacaaaagctggtgcaacatcaaaactccgatatctcatgggtgggatggatgaatctctgatggaatcataa

SEQ ID NO: 53492 - DNA, 186 bp, Glycine max
  Peptide Sequence Number=SeqID_145177
atggatttggtgcatgcaagattcgtcagcattagtggtggttttttcgtgggtctagtcacgtgcggtggtgagggtggtggctcagatctaggtcgtgcgagattgatgagtggtcatttcactgtcgatttggtcgtgtgtggtggtgatgggtggtggctcaacttggaccttggagggtag

SEQ ID NO: 53493 - DNA, 533 bp, Glycine max
  Peptide Sequence Number=SeqID_145178
cgtgatgccctccctggagttattgtcactgacagagaccaagcattgatgaatgcagagaaggatgtattccccgaatgcacaaatttattgtgcagctttcacataaacaagaatgtgaaggccaaatctatgagcaggaacctaaggtcaacaaagcgcaatccatcttactgggagtatgtagatgcctttgaatctatgcaaaatagcaatttgccggtgaggcgtactgcatcatcctctaagcaaccgaatcgaagaacgatgatgcccatgttggaccaatttcagccatttatgcacgacttcattgataagatcgttgatgtcaaagctgatgactcttggtcggtggtccgcaaccatttgcttaaagaacttgccaaattctcagaagactatatcaaactctttggtggcacggagagatttgaggaattaaggatgtcactacttgttgatgggttaaccaaggtgactatggataagtggatggatataacggatatgggacatgtcattgcatcaag

SEQ ID NO: 53494 - DNA, 408 bp, Glycine max
  Peptide Sequence Number=SeqID_145179
atgtctttatatgtgtgcggtgaaggtgaaggtgaaggtgcattgctgtggccggcggcggcaaacgaggtacgtagaaggtggttgcattgtcgcgaaagtacggatcacttacggatcaagttgatccaagcatgtggtgcgaatgaaccacatgttgattgttcggatgcgttcaatacttctcaggtgtttaagtgtcgagaggatgttttgcggtgggctcgatccgtggctcatgaaaacagatttgtggcggtgattttaaggtcggacacaaacacaggagtgacgagtataggtgtaggaaaaaagaatttatcagaagagacactgggactaggaaatgtgggtgtcccttcaatcttcgttgcaagccagtggttggaggagaaggctggatggtga

SEQ ID NO: 53495 - DNA, 219 bp, Glycine max
  Peptide Sequence Number=SeqID_145180
atggtacttgaacccgatgatgatcctggacatttgagggcaaatgctttccaagaaggagggaatggtaatccttgtggcgtctaccctgacttatcttccttcatcggaagtggcgtctaccttgacttatcttccttcattggaagtggcgtcatccaaatcttcgtagcctatatcaagcgatccgctcctagtcaggttcacatcagctcgtga

SEQ ID NO: 53496 - DNA, 480 bp, Glycine max
  Peptide Sequence Number=SeqID_145181
atggctcatcttcctccaccaccactgcaggccaccgctgccacggtgctttcagtgactcttcggcaccaccaaacccatctctttcctcaccacactctctcaatctgttttccaccaatgaccaacgtcagagaattagttcaggtcttttataacaacttggaaattcgtgatggagtcatattttctgaacacttcaacgtccctcttgctaatgaaccttttgtcaaggttaaatgtttattttccattggagccacaacagttgcctcttttgggtataggaaagatattgatggccaatgggttcgtaaacaggatctttcggctaatgctcccgatgaacgcactccatctccactaccaagggatccctcctctacattactgaatgatgtcctcactgagctttgggatcttcgtgcttttgtcgaagaaagatttgattccatggattctcacatcactcgtctttaa

SEQ ID NO: 53497 - DNA, 627 bp, Glycine max
  Peptide Sequence Number=SeqID_145182
atggcatccaactataaagacgttaaagaagcgctcatggaaggcaacctaatgactccaaagaaactcacctctaagagagctaggaagaccactgcaggagaaggatctagcatagctccacctgtagaaattgaatttgatggacaccgctttcgtggtgaggaacaccagtgcagctttgaagtgatcaaagattggtctttccttaaggaaagaattgtccaattacctgaaggtgaacatattgaattccaagcagagattgctaggaggcactggacacagcttgcagagcccatgcgtaaatatgaccctgaaattgtcatggaattttatgcaaatgcttggcctactgaggaaggtgttatggataagtgctctatagtgcggggccaatggattccttatgacacatatgccatcaaccaatttttaaggaatctattgatcctagaggaggggcaacaatgtgaatatattgcaaggagaagtcagactataggttttgatgaaaaggctataggtcagttgctttgcttcccaggacgtgattttgtacgaatcatggtagggaggcagttgcgaatcatgtgcaccaatatgacgactttgactcaaatctag

SEQ ID NO: 53498 - DNA, 228 bp, Glycine max
  Peptide Sequence Number=SeqID_145183
atgaatatagtgaacgaggcgaggctcacgggtgcatcttccaaaggaggaaaatgcgtggagtctccaccaacgcttatttgtggaaaacgtcggaaaaaccgaaggaaaccggtcataaagaatattccaagttcgggagttgtatttacgtttgaggaaggtcgacaaaagcggggctcttgctcctgcgtaccctccatcgaagaggaaatcagacctaagtag

SEQ ID NO: 53499 - DNA, 285 bp, Glycine max
  Peptide Sequence Number=SeqID_145184
atggctgttgtttggtctatatggaagatgagaaacagaattcttttctccaatgattcctttaatggcagcaaacttgttgacgatgcagtttttttagtgtggtcttggctctcaaatttggataaggattttaagttatataaaccccaaacatttaaagcttcgagcttgcgagagagcaatcagcagaaaaccagacaagcttcatccatctctaagcccaaagaaaaggaaaaaggggactgggaaccatgctcaaagcaatacaaggggcaaaggtag

SEQ ID NO: 53500 - DNA, 768 bp, Glycine max
  Peptide Sequence Number=SeqID_145185
atggcttccgcttctcagagttttgtctcgcaatcctttccaaatttcatcgctgagaagctcgatgatgcgaactatctccgttgggtttggaaaaagattcatgagtacttcagcctccataagaagtctcgtgcatgccagctgcgaactgcgatgcgtgcagtttcgcttgaaggttatgtcaatgagctcactggtgttggagttccggttcaccatgagtatgttgacatgatacttgaaggcctttcgttcgattacacgctgatgatctcagttattgagagcaagaagcatactctgtccattgccgagattgagaccttgctttacggtcatgaaactcatattgtttgctacaataaagaaactcaagcactaagttctccgttcttgaattacactcaaggctattcacaccccaattcatacaagtctggtgattctggtggctctaggggagcgtatggccgcggcagtggtggtcgtggtggttttcttgatcgcggtgccggacgtagtggtggtgccttcgcagaggtcgagccttatgaatcgcttactttctttgatccaaccacacttccacctattccctactcctctaattctgccaaaacctctaatacttgggttagtcccaattccaagcctgctgttccagcatcaaatcaaccaatgctatgcttaccaattcctcctctcatggaaatggtcatcctagttccacctggataccagactcttgtgctagcttccatgtga

SEQ ID NO: 53501 - DNA, 1343 bp, Glycine max
  Peptide Sequence Number=SeqID_145186
cactcaacccttcactagagccattttcaatcactctctcaaatcttgacctgctctcaggtcgttttcctgttacatacttgtatttctaccgcaaactagaatcagataacttcaaagcctttgttgatgctcttaagaacactctagcacaagttcttgatcactactatccctttgctggccaaattgttcaaaatcccaaaactagtgagcctgaaatcatttgtgacaacaatggtgctctagtcattgaagctcacacaaatatcccattaaagagtttagatttttacaatctcaatgaaactcttcaagaaaaggtagtctcagttgaaccagacttccccttgcaaattcaggcgactgagtacacttgtggaggcatttccatagcatttacttttgatcatgcattaggtgatgccacttcctttggcaagttcattgcttcatggtgcgaaatagctcaaaagaaaccactctcgagcataccagaccatactagacaccttcgtgcgcgttcttctcccaaatatcaaccatccttggatcaaacttttatgaagtgcaccatgaaagagatacagaacatgccaatgaatcatgtcttgcttaaacgcctttatcacatcgaagcatcaagcatcgacatgctgcagaaacttgcttctttgaatggggtcaagagaacaaagattgaggccttttcagcatatgtatggaagataatgattggtacaattgatgaaaggcataaaacgtgcaagatgggttggttggtggatggaagagaaagaatgggaagaggcaagaatttgatgtcaaactacattggtaatgtgttgtctttggcttttggggaggcaagcattcaagaactgaaggaagcctccatatcagaaattgctaagacagtgcatgaggcaatttcaaaggtcaataatgaggatcacttcttggacttgattgattggattgagtgtcataggcctggtttgatgctagcaaaggcagtgttgggtcaagaggggccaaccctagtggtgtcctcaggacaaaggtttcctgtcaaagaagttgactttggatttgggagtcccttgctagggacagtttacacttccattcaaaaggtgggagttagttacatgaaccaaaggctaagtgccaagggtgatggttcatggactgtgtctgccatcttgtggccagaactggaagctgcattgcaggatgacccaattttccaccccatccctactcgaggcatcaagctcaaagaatgtgccaagttcctcattatagtggttgctcagcaggaaagacaatcctgcttgtaa

SEQ ID NO: 53502 - DNA, 598 bp, Glycine max
  Peptide Sequence Number=SeqID_145187
atggggaaatcaagggacaagcctatgtcgattgtcgctctttatgctgctaggaaaggcatcgccactgagacccattctaaaacatctcatgacatgcctcattctcctttgaaaaggaaaaaggtcgtcaatattgattataacatggatttaatcggttctagtttggtgcctattaggaagttcaatggtcctccttcgtggatgtctttgggcgaagagattgatcatgttattttgtcggaatattgggatatgattcagaagagtaaccatgccgagttggattcaactatctcgatgttgataaggagggccgaggatcaagctgatgtactgatagaagagctcaataattataagaaagagaatttcaaaaaggctgttgaggattctttcaacaatgcccttaagcaggttcatccaactcatcttggagcttcggggatcgtgaatgaatattttgtgggacacgaaactcctgatgaagagatggcttatgggtttattgataccctagatgctaactttgatgataaaatttctaggacttctaatgctaatgccgacctgagggatcttaaagggcccatat

SEQ ID NO: 53503 - DNA, 279 bp, Glycine max
  Peptide Sequence Number=SeqID_145188
atggccattaaggggtatatggtgtttatggagatcagaggactggaaggtggagggaatatgctgacttggaggaatgacagaatgggagtgagactagatagatgccttattaatcttgactggagattgaagtttcaggagggtgtggtggtccatctaggatggttaaaatctgatcagaggcctattctcccaagattagaaaaccaaactagacgaaagcaacataaaagacctgttttgaagctatttggaccttatatgatgacttcctga

SEQ ID NO: 53504 - DNA, 438 bp, Glycine max
  Peptide Sequence Number=SeqID_145189
atggctccgaagaagctctctacgaagaggtctagaagagacgccgcagcagaagggtccaatgctgcccccgagtttgacagtcatcgtttccggagcgccgagcaccagcagcacttcgaggccatcaaaggatggtcgctccacagagagaggcctcgcagacgttggatgtcgctggtgactcccatggctaagtttgaccttgagatagtcctagagttctatgctaatgcttggcccacggaggagggagtgcgagacatgcgttcgtgggtgaggggccagcagtgtgagttcagccagaggaggaacagggtcgacgggtttgacgaggaggccattgcccagctggaggcgggtgcagatcatgcacaccagcatgaccactttgacctagacgtggatgacattgctgctcagcaatgtcttgcctag

SEQ ID NO: 53505 - DNA, 186 bp, Glycine max
  Peptide Sequence Number=SeqID_145190
atggagtgcatggaacggttggaacccggtcaggccaactcggcccaacctgcaattaagcaacaaggttggaaaaaccctaattgcctaaccccaaaatggcacgagaaaggaggccgctaccatgaagggtggtatgcctccgtggtgccactcgtgcagggaccgatggcgcgaggtcggtga

SEQ ID NO: 53506 - DNA, 228 bp, Glycine max
  Peptide Sequence Number=SeqID_145191
atggggaagaaaaagttggaaatgagtcttgaaaaccaacaaatcagccttgatctatttaatgaaggaagagaattgctggaccaggatgtatgcttacaagtaaaggagttggataagaagaaaaagaacttagaaaatttttcagttgttcactcactaagcgcaacactcacgctaagcgccaagtcttcacgtgctaagcgtgccctcgcgctaagcgcttag

SEQ ID NO: 53507 - DNA, 171 bp, Glycine max
  Peptide Sequence Number=SeqID_145192
atgaccaagacgatgaccagtcccacaaggtggtggacgccgattacgtcgcggatttcttctttccagtatgactggttcttccacgtcatgatcatgttgttgttctatctgaagaactttgaccttgttctccaaacgaatgtggtgcatcaaactattgtaaagtag

SEQ ID NO: 53508 - DNA, 57 bp, Glycine max
  Peptide Sequence Number=SeqID_145193
atggtggagatgaaagttatgatgagctacaaagcgtgtgagaagaagattaaatga

SEQ ID NO: 53509 - DNA, 399 bp, Glycine max
  Peptide Sequence Number=SeqID_145194
atgtctttccttttcacggtcatcattcttatcacctacactcttctaatgtcgcggtgctctcacctatgctcactctcactgtcggtgtcaccactacccatcaccctcttgagcattcgtcaccgttgttgtttttatatgggagtggtcttaccagcaagcgcaccgggtcgccaagataaaaataccaaacaccgattcctccatgtcgcaacctacccttcggcaggagggcgacgcgtgactcgcgggatgcgtgttccacgaaaggaatacgcgcggagtcgccaccaacgtttatttgaggaaaacgtcggaaaaaccgaaaaagaagcgatctacgaacttttaagtgaaaggttcgggagttgtatttacgcacgaggaaggtattag

SEQ ID NO: 53510 - DNA, 477 bp, Glycine max
  Peptide Sequence Number=SeqID_145195
atggcccagctattatgcacaccggggcaggatttcgcccagaccgctacagggaggcgggtgcggatcatgcgcaccagcatgaccaccttgacccggacgtggaggacattgctggtcagcaatgtcttgcctagtgatcataactccgatctccctctgccgaagtgtatgccacccaccaaacaccctctagacctggataagtctaacagggccctggggtttccgacattgatcacgggcctctgccagtcattcggggttctcgtcactcctagcaagagacaacgtttcgctccttttgcgtgccctactccagatcagtttagggctgaggtcgcatggcccggagattggcccgtggcccaagcaggggaggcgcctgcaggagctcctggcgatgcagaggaggcccgtatggaggaggagatgacggacttgctcggtttcttgggaggaaccggagccacgtga

SEQ ID NO: 53511 - DNA, 168 bp, Glycine max
  Peptide Sequence Number=SeqID_145196
atggaaaaagatctcaagaagactctcaaattcttagatgctacaaatgcaaccaacttggcctacattgcatgggatgacaatgactcatccgatggttcagaaaaggagatcaaccttctaaccaaggattatgaaagcgatgagaacatctctcaagaagactaa

SEQ ID NO: 53512 - DNA, 780 bp, Glycine max
  Peptide Sequence Number=SeqID_145197
atgagacctgctggtggcgtaatgtgcactgaatcattcaacgagggtgtcgaagctgtctatggatctaggaagacatctagatgctggtctggatcttttgttcaatcataccgcttgaggttgagtggtttccaccccaaaggtatgtctgcctccataacacgatcaacaaaaggatgccgacggacggtccacctcgctggacgatgcatgtgggagagacttaagtcatctgtagtgttgcctatgtgtcaggggtgtgattccccttgggtgcgttcagtcaagcctctagctagtcatggtcagcctttagcctggtcaactcatcctcatggcgtcactccatctccgcaatgcgattttggagttgatgtaaagccgcatggtatgttttactgcggtcccatggtgggcgccaaatcttcttaccaaaatctcgaacctagacatgtcagggttgatgctgcggatgtgggcttgcaaaacaaaggactcaaacgctcaagtaagaatatgagtgaggagaaggtcaagcgtccgcactcctgtaacaagactaacatggaaggtgaacatgtgtctctcaatgtcatggtcgggacggatgtaataatcccatattcgtacccgatttttggttatcggggaaaacctgaacctaaactcatatctgatcaactcgagtattacctctcaaagtcaggatggatttggacgagtacccacgagtacgggtttcttgccatgtctaaccgttttgatattgaatattag

SEQ ID NO: 53513 - DNA, 723 bp, Glycine max
  Peptide Sequence Number=SeqID_145198
atggcagtgcatttgtcggggttgacttcaatccctcagtgtgtgatcatgaagctgaggaacttgcttccgcctagctcgaaagtacatttttcaggggtaggcgcatgtcgtatttgcggagttccttgcatacttcttccaggtctgccacatgttggggcatccaggaagcttagcacctggaacccagacattccatcgactagccagtcaatgctgagcagagggtattcgtctacctgggttttggtatcttatggtgaagctcttggagagcttgccttgatcgaaggtggtcatcaagtccatgtagcctctggtctctactctctcgcctgcaaagttgaggagtggaccgacgtgaggtggacagtgtcgggtgagaccttaagtctctggaaggaccttggacaccatgaaatttgcaatgatgatggagacggccacagggttgacggggttgatgcctttgaagtccctaccagtaaaggggagccaaaagagaaagagaactattcacgacggagaggcctgaagagtgtgagtttcagagagcgtagagcagagcaaggggccaagttttcatcttttagggagattagtgagtttttgagtgattgtgagattcctagaggtggaggagtcatccctactcctttggactttagcattgggaaatgtactgtttccttagaacttgatagagcagggactgaataa

SEQ ID NO: 53514 - DNA, 304 bp, Glycine max
  Peptide Sequence Number=SeqID_145199
atggctagaggactcctagaagattgggccagggatgtaggagaaggctctagggttctcatgagccttaagggctccatagtgtaccgaagggaacccctcaagtttaagtttctcctaccttcaagctcttatccatggcttcctatggtggtgagcttgttcttgacttatcttctccttgaattgcatctccaatcgtcattcctccttcttcattttgctgccattgatcttcaagaagcaaaggactccattgatgaagaagatccaatgcctacaagctctacatggagccacatta

SEQ ID NO: 53515 - DNA, 159 bp, Glycine max
  Peptide Sequence Number=SeqID_145200
atggaggagatacatggagaagacgatgaagaacaaggaattaaagatcaatggcagcgaaatggagaaggaggaacggtgattggagaagatgagtggagggagagggagagaggggaacgaaattttgagagagggaaaagggagaatggggtctga

SEQ ID NO: 53516 - DNA, 318 bp, Glycine max
  Peptide Sequence Number=SeqID_145201
atgacgagaggcaatccatctgacttacaaccctttgatcctgagatagataggacatttcatagattagttaggcatcattttataccttttgatcatcctgagcattccattactggtgaatctgtgcattctgttattggtgattttaaacatcctgattttgagcattataattttgagcattctgattctgagcattctgattttgaacactctgagaacatggcacaacctccaccccgtgagagaactctaagagaaatggctgcacctgatttcacctacgaaagcttgtgcatccaataccctcaatga

SEQ ID NO: 53517 - DNA, 462 bp, Glycine max
  Peptide Sequence Number=SeqID_145202
atgacaccttcgaccgaagatgtgaagaaagcaatgcaaggattgtttgctgtactccagctctctatgtggggctggtttcacacctttttctccaagaaggtaggcccgtctatccgctacaaggaaggaagaatcaggattctatcttcatgcgaaggatgtcccatgagaggagtgccatcagacgaaagcatcacgcctttcatcgcacgaggtttcagtgaccacaacgcgagggacagagagcttagaggaagcagtaatgggatcatcggcggctatcataagtggctgagagtccggacacaaggattggattggctcccaaatctaaagactgtgagagacaatgaggttaaagcttcggaagaaagtgatgaggtacaagccctaaaggcaaagcttgaaagagcccgggtagtcaaagagaagttcaagtccatagccatcaaagtctga

SEQ ID NO: 53518 - DNA, 417 bp, Glycine max
  Peptide Sequence Number=SeqID_145203
atgtcaaaatcttatggctctcactcttatccaaagaaagaccaaggtcaaggcatctttggggtgacaccttctaagcccaaatataataaggggaagacaatagaaaagcaaccccttaaggctagtatgcaagagaagactagctccatgaactgctttaaatgtcttggaagaggacacattacttctcaatgccccaccaagaaaaccatgattatgaagggccaagacatttatagtagccaagatgaggctactacttcaccttcctctagtgaaagtgaagaagcaaaaggggaagaatctagtgaagagatctacccccaagaagaaggacaacctttaatggttaaggaggagtgtaaggaggtgtggagggaagaagcccggagtttcatgaaccttgggatttaa

SEQ ID NO: 53519 - DNA, 453 bp, Glycine max
  Peptide Sequence Number=SeqID_145204
atgactcttgctcaggtgtggagtgttctctcatattccaacctggctcctacttcacacacctcagacctgacagtagatagagctaggctgatctttggcctagactctcagatggacataaatgtgggagcccttatctctggccagatcacatctatagcccagtctaactcttctagacttgggttccctactctgatcaccgcctgtgtaaggccagaagggaaaaactgttggaatcctaatgatctaacagtttctatcaaaggggccagacgggcaaggatgaggctagctgaacctccttccacatctacaactcctattccagcacgtccctcagcagctccttctgccccagcttctgcagatttcagcatcttaaagccatgtgtcgcaacctacccttcagcgggagggcgacgtgtgactcgcgggagcgtgttctaa

SEQ ID NO: 53520 - DNA, 405 bp, Glycine max
  misc_feature (40)..(40): n is a, c, g, or t
  Peptide Sequence Number=SeqID_145205
atggaggccataaaagagcaaatggccacaatgatgaagnccatgatgagcatgaagaagataatggaagccaatgcggttatagttgccgctattagcgctgtcgctaaggtgaacccgatgctcccatctagcctcaagcaaatgaatcatccaacctcaaatatgttaggcaaagatttgggaagtacggacgaccccatgatgtgcaaattcaaaacaagcacgccttcccatcatatggcttgcctcccgactatacaccacccaatgtggcatacactctcaatgaaaatctcaataactccactccgatactcattgagaaccaataaccccaaactgatcatgcacatgtctcttaaaccgtgggggggacccatgaaattccccatcacaatctag

SEQ ID NO: 53521 - DNA, 150 bp, Glycine max
  Peptide Sequence Number=SeqID_145206
atgggagatcgcttggaggacatgattcgtgaccttggacaagagtctttccagcaagcacatgcccctgtgtatgggtggagtgacaaaagtttcacctcagtgcttgaggtagtgaccctctgcttgcaaaggacaacacgttcctaa

SEQ ID NO: 53522 - DNA, 147 bp, Glycine max
  Peptide Sequence Number=SeqID_145207
atggtagtctttgagtacaaggaagcttcaatctcaagtggactgttgactctcagaattatggactggtggctaaaggataaagggttccagaatttggtgaaacttgaatggggtaattatcaccctcagggatggggggtttag

SEQ ID NO: 53523 - DNA, 900 bp, Glycine max
  Peptide Sequence Number=SeqID_145208
atggcttctaggaaaagaaaggtaccctctacacctacccaagccagatttgacagatccatattcaattcccaagaggctggggaaagatacactgatgttattgtgcctaggaagcttttgccagagaggaatgtggtgatctactatacagagtttgatgagttcaaggaggaactcgagagatgccactgggatgaggagttgactgatttcattgacggaaacatcgatgttgccattgtgaaggagttctatgcaaacctatatgaccccgaggacaaatcacctaaattttcactcctgaggcctgatccccaggagttggctgctaagctttgtatcctagggaggggattcgagcttaacgctgatgggcagcctttgaatatattgaggaagaaaatgaccaccctagctcagacatggagtgttctttccttctctaacctgattcctacctctcatacttcaggtgtcactcttgacagagccaaactcatttatggcatcatcatgaagatggacatgaatgtggggtacctcatttcccaccagatctccctcactgctcagcatgacacatccagacttggattcccgaccttgattacaactttatgtaaggctaggggagttcagtctgattcgagatccttggagagcttgagtccttccattaatttgccatacattaagaagaactgttggaatcttgatgatccaacagtaacttttagaggacctaggaaggcaaggggtaagagatctgaggccccttccacttcagcaccagagacaggaggtccttcttcttctacacttcctccctcttcctccacagagatcccagtgattcctccagcaccttcacagattccacttacaactcctctctga

SEQ ID NO: 53524 - DNA, 720 bp, Glycine max
  Peptide Sequence Number=SeqID_145209
atgtcctcactttcggaggactgcacgtcctcaccttcagagggcttcacgtcctcgccttcagagggctgcacgttctcatcatcagaggacgtcacgtcctcaccttcagagggctacaccccctcatcttcagaggactacacgtcctcgccttcagagggctacacgtcctcgccttcagagggctacacaccctcgccttcagagggctacacgcgctcgccttcagaggactacatgtcctcgccgtcagagggctacacgccctcaccttccgaggactacatgtcctcatcttcagaggactacatgtcctcaccctcagagggttacacgccctcggctccgaggactacatgtcctcatcttcagaggactacatgtcctcaccttcgtaggctacacgtcctcatcatcagaggactacatgtcctcaccttcgtagggctacacgccctcaccttccgaggactacatgaactcaccttcagaggactacacgtcctcgccttcagaggacaacatgttctcgccctcaccttccgaggactacatgtcctcacctttagaggactacacgtcctcgcctttagaggactacacgtcctcaccttcagtgggctacacgccctcgccttcaaagggctgcacgccctcaccattagagggctacgcgttctcactctcagtgggctccatatccacaccttaagataa

SEQ ID NO: 53525 - DNA, 375 bp, Glycine max
  Peptide Sequence Number=SeqID_145210
atggcagaaaatatgcaaattgaagaacctagttcacaccaaccaacttcacaatcttcagaccatcctactccgctatcttcacaccaaccaactccagtagaaagttctaccggtacagttgaaggtcctaataatgaacctatgcaacaaccacctagcatagaggtggatgaccatggtgtatcatcaacaaaaactggaggaggtgaggctcaaaagtattgtgtggaaccattttgctgttggatacaaatgaaggaagggtggcaattacatcagatatgtggactgcaagcaaccaaaagaaagggtatttggctgtcacagctcattacattgatagctcatggactttgcaaagtcgcattttga

SEQ ID NO: 53526 - DNA, 300 bp, Glycine max
  Peptide Sequence Number=SeqID_145211
atgtttcaaatgcaaggagaacaaacaaggtgttcttgcaagaaatgcaaatgtaaagttttaaagtttgtggatgatgtgatgagggatctttatgaggaaaggttcatgccaaattattattggtggacaacccatggtgaagagttaccacaatttcctcccatagtgttgcaaggttcatactacaaaagtggtaggcaaaggaaagaattgaatccttatgagcaaatgatcatggatcatgctggaccatcaattggccaatacatagaacaacagggtgtaattgagacataa

SEQ ID NO: 53527 - DNA, 1071 bp, Glycine max
  Peptide Sequence Number=SeqID_145212
atgataaacctcggcacgctcggcgcgcagcgcggtcaggcggaaacggcgctccagattttccgcaaacagcgcctgctccatatcatctttgccatcgacgcgacgacgcagattaccaatcacccgcaggctgacctctttcagcagctcaggatcgatgttctcttcagcgtcgttttccagccgctgctccattttgtgcaggctttcgatcgccacgccggccatcgcggcacgcgcgctctggatttcgcgacggtgtcccactttgtcgtggctctccatgccgcgcagcagaatcggcagcagaatcacgccgacaaacagcgagaacagaatcacgccggtggcgataaacaccagttcgtagcgcgccggaaaaggttcgccgttgctgaggaacagcgggatcgacagcacaccggccagcgtgatagcaccacgcacgccggcaaaagaggcgatcagcagttcacgcagcgagtagctggagaactccagcggcttcttcttcagcaggcgcaggctggtgcgcttcatgatccacagccagccgaagcgcacgatcatcagcgccgcatagaccagcccgacgtcagcgaacagcatccacagctcgacgttaggatcggcgttcgcctgagcaatcgaggtggagagaatgtccggcagctgcaggcccagcatcaggaacaccatgccgttgaacacaaactccagcatctgccatacgctgttggcgcgcaggcgcattgccagcggtgcctgacggatgatgccggaacgggtgatggtcataccggccgctaccgccgccagaatgccggagacgccgaggtgttcagcaatcaggtaagaggcgaacggcagcagcagcagcagtacggtttgcgttgccgggtcgtcaccgctccagcggctgagcaggcgcagcgaacgaccgtacagccagcaaacggcgacaccggccaccaggccgccaatcgccactttaaggaattcgacgctggcgccgccccaggtgaacaccatagtgcccatcgccaccgcgacggcaaacttgagtga

SEQ ID NO: 53528 - DNA, 306 bp, Glycine max
  Peptide Sequence Number=SeqID_145213
atggcggattccatcagcagactctccttcccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaatttggtcattctgcacccttgtatcatccagaggcggcgggcccgatga

SEQ ID NO: 53529 - DNA, 348 bp, Glycine max
  Peptide Sequence Number=SeqID_145214
atgtcaaatgaagaattgaagctgcaggatccacgatgtcggatacaatgtccaggacatcctgcccgaaaatactggagttgctgcacaatgcacaaggcaagacaaaagctgcaggatccacgatgtcggatacaatgtccaggacatctggcccgaaaatactggacacataaatctgttatatctttaacagattattgtgcaatttttcaggagaatgatagatctcatccagcgcaagttgttgcagcccagatacgcacactgctatataaacatgaaggctgcacgagttctgtaccaagtccgggattgaagagttattttgtgagttttgggacttga

SEQ ID NO: 53530 - DNA, 729 bp, Glycine max
  Peptide Sequence Number=SeqID_145215
atgagagacaatagactctacgaggtagctgtctattctaaaaaaaggctattatttacattccgagactccttacatctactccccggcaaactagatgaccttgctaagaatctatgccctgagttgggttctaaaggatctatttcctatgaggatgtaagacttgaaagtcttagtattatgaaagagagtttgttagagtatatggagcaggatattcttctgctagggggaattatgcagtccttccaggacatatattataaggcttaccaggcagacatagtaaataagcttacaatagcctcactggctctaagtctatttcgtgaaaaatattacgattacaataagcaccgtatccacatccctaatcagaatgaggatacatttattcggcgtggatattacggtgggcataccgacgcatacttaccatacggtactaatttatactattatgacgttaactctctctatccttttgttatgaaggaattctcaatgcctgggggtacaccagtctggcattctgatttagaatatatgacattagataacatgtttgggttcattgaagcatatgtagaatgcccaaaaagcacctttgttggggtttactatagtgaggagctcaagtatgctagagacataaggctacactataataccaatttgtggatacctcttcgaggagatggaaagtccattcaaggactacattaa

SEQ ID NO: 53531 - DNA, 390 bp, Glycine max
  Peptide Sequence Number=SeqID_145216
atgcagtcccagtttcaatcacagatgcaatcacagggactcgcactgcctcctcagcctgaggttggtccttcagctgctcgtgtcagcacaaaggagacttgtgttgatccctcagggaacgatctagacacgggtgactcagacagatgcaggttgtatatcgaagaaaatcctccccacttagttgccctaggaagactttatgagggatccataaccgttcacaacattcctttgctgcatgatcaagtcaaggttggtgttgaggaggttagagatgcaaatgcttccattcctgtacccattgaagaggttaagttagtgaggcaaacacttaacaccttccttgcttggccgacacatcttgtcaagcgtttatcagaacag

SEQ ID NO: 53532 - DNA, 252 bp, Glycine max
  Peptide Sequence Number=SeqID_145217
atggcattagcgcgtgattttcgtagggaaacaacccatggggcaatttggtttagaataggtagcaaaatacctttggcaatttacactttggacgtgggagcaaaatacttggatgtagaagaatatcttgtgcgagtgaatgttcgtaaggaagaaatggccccgaggaagcttgtcctcaagcggtccaggaaggataaggcggccgaaggaactagttcactcctgagtatgacagtcacgctttag

SEQ ID NO: 53533 - DNA, 231 bp, Glycine max
  Peptide Sequence Number=SeqID_145218
atgttgttcccccttgattcacaagtcctcagccccaaagcttacaaatctattttaagtccaagcccattgatgcaagctccattggagcttgtaggcctaggatcttcttcatcaatggattcctttgcttcttggaagatgaatggcagcggaatggagaaagggagagagagagaggagacgccacttcaaggagaagatgagtctagaagaagctcaccaccatag

SEQ ID NO: 53534 - DNA, 225 bp, Glycine max
  Peptide Sequence Number=SeqID_145219
atgacatgcctttccaaagacaacccgataaggagacattcctatgggtgctttgtaggcagtccgatgtgcccagagagcatcatcaagcctgatgcaattggctttgatgttttgatgatgatcatgaatgatgtgttgcaattgatgcaaatgggcttttcaagattaaaattcaagacaatacttcaagattacaagtcacaacatcaagatgatcactag

SEQ ID NO: 53535 - DNA, 663 bp, Glycine max
  Peptide Sequence Number=SeqID_145220
atggcttctagaaagagaaggatcattggtataaggcccacatctcagtatgacacaaggagattctcttcattagatgcttggaccagatacacagacaatgttctggggagaaacattttacctgagaggaaggtagagctctatcacactgagctagatgactttaaggctgaattggaaagaggtcatttggtgaagattgatgctgatagtctcaacgcattcctagagacacctgtgatattagctgaggcagaaactttacccgtatactccagatactgtaggttgcctacagactttagagagatagaggctgccttatgcatacctggtcgagggttcatcttgaactttaagggccatcctggaaatattctcaggaaggatttgactacactggctccggtgtggagtgtcctctcatactccaacttggcccccacatcacatacctctgatctgacagtggatagagctaggctaatctttggcttagtctctcacttggataagaacataggagtgctgatttctgtccaaatgacttctatagcccaatataacacctctagactttggttccctgctttaatcaccgtattatgcagagtcagaggggttgtatctgacagccttaccttcaagcgcctgagtccg

SEQ ID NO: 53536 - DNA, 288 bp, Glycine max
  Peptide Sequence Number=SeqID_145221
atgacgggagatgcgtcaaagtttactcatatttctcccaagaatggtggacatgtgacttatggtgacaacaacaaatgtacagatacatttcttccaaaagagtggagaacttcaagatatcatcctcttgataatatcattggtgacatatcaaaaggggtaacaactaaacactttctcaaagatgcatgcaataatatggcttttttttctttaattgaacctaaaaacttaaatgaagccataattgatgaacatggattattgctatgcaagaagagttga

SEQ ID NO: 53537 - DNA, 47 bp, Glycine max
  Peptide Sequence Number=SeqID_145222
atgcaggtgccttatactaggtatcctatttgtccacagttcaaaag

SEQ ID NO: 53538 - DNA, 162 bp, Glycine max
  Peptide Sequence Number=SeqID_145223
atgtcagtgaaaaacctcgtcgggcgcctaggagtacatgacaagacaaaccacacactagcaagtcaggtcactctcactaggcttaaaagagcactcaaatcgggtgtatttaaccccaaggcctacactccaaagagttcgtcaggctctccctcgtga

SEQ ID NO: 53539 - DNA, 183 bp, Glycine max
  Peptide Sequence Number=SeqID_145224
atggtctgggtgtatccaaactaccgcatgaccctctctggtcggcacgcggtgaatcctcgtcatagtccggatcagcagtggactccgcaactgagggaaagtgctcgtatatccagcactacaaagcagtgtgatgtaaccgccaagctgttggttgctgctgatagaagcatcgtttag

SEQ ID NO: 53540 - DNA, 156 bp, Glycine max
  Peptide Sequence Number=SeqID_145225
atggctctctacgggtcggagtttgcttacttgaacccccttaggatactaggctgcctcctagcggcgctttccgtttgtccagagctgggcaagggacgacgatctatcggtcatgaccctagtctctacttgcgtctgtccctaagtacctga

SEQ ID NO: 53541 - DNA, 90 bp, Glycine max
  Peptide Sequence Number=SeqID_145226
atggaggatgacgtgatcctgactaggagtggatcgcttgatacaggctacggagatttgaatgacgccacttccagtgaaggaagataa

SEQ ID NO: 53542 - DNA, 403 bp, Glycine max
  Peptide Sequence Number=SeqID_145227
atcgcgatggcagcgcagctgatccgtgattgcgtcgtgatggagtgcctagagggtgtttgggagaccctcgagggcaacgagaggtgccaatttcgcggcacagttcgactcactgcaacattgcttgtacatccggagcaacccgcacgcacacttcagcagcctgtggagtggatactacctacgcctaccccatatcgactagttgagcccgttcaattgatagaggtgtcatcctccgaagaggatcctgaaggggacccagaggagtcatctcctgaacctgctatggatgccgctgacttaccagaggatgatgaggacccacttcctgatgttgattctccagatacggttctggagcggagattctttgaaccgaatgacgaccgtaacggat

SEQ ID NO: 53543 - DNA, 489 bp, Glycine max
  Peptide Sequence Number=SeqID_145228
atgacgaacaccacctttagcacaaacctaaacaccaaccaagaaatgaattttgcagcaaaaaagcctgtagaattcaccccaattccggtgtcctatgctgacttgctcccatatctacttgataattcaatggtagccataaccccagccaaggttcataaacctgcatttctccgaaaatacgactcgaacgcaacgtgtgcttgtcatggagaagccccggggcgttcctttaagcattgtggggccctgaagcataaggtgcaaggtctaattgatgcgggctggctgaaatttgaggagaatcgcatgattttcaactttcaccggaagtgggtgcaagccattggtctgtttgctcaagcgacctgtgctcctgagtttggacttccaagaccgttcaatcagagattactcgtcttgcgtgttggtggggttgccgtaaaacaacaaataaagttcaaaacaaataagtttccgaaataa

SEQ ID NO: 53544 - DNA, 255 bp, Glycine max
  Peptide Sequence Number=SeqID_145229
atggtgagaagtatgggctataagttttatgacccaactttaagatcaatatttgaaacgggaaatgcaagatttcttgaggaagttgagtttgggaaggaagagaacataaggaaagttctctttgaggaaaaacctattattgacagttctcaagtccttatacctattgtcgttcaagaaacaactccagtaatagaaaatagtgttcaaactatcgttgatgacattgttcaagaacaagacaacgatgag

SEQ ID NO: 53545 - DNA, 771 bp, Glycine max
  Peptide Sequence Number=SeqID_145230
atgagtcaatctcttccaagggctacacgtcctcaccatcagagggctacacgtcctcaccttcagaggactatacgtcctcaccttcgaggactacacgtcctcacctacagaggactatacgtcctcaccttcagaggactacacgtcctcaccttcagaggactatacatcctcaccatcagagggctgcacgtcctcaccttcagaggactacacgtcctcaccttcagaggactatacgtcctcaccttcagaggactacacatcctcacctttagaggactacaagtcctcgccttcagagggctgcacaccctagactttagaggactacatgtcctcaccatcagaggactacacgtcctcgcctttagaggacttcacgtcctcaccttcagagggttgcacgccctcaccatcagagggctacacgccctcaccttcaaaggactacacgtcctcgccatcagaggactacacgtcctcgccttcagaggacttcacgtcctcagcttcagagggctgcacgccctcaccttcaaagggctacacgccctcgcctttgtagggctacacgccctcaccttcagaggactacacgtcctcaccgtcggagggctacacgccctcacctttagtgggctacaagccctcgcctttagaggactacacgtcctcgccatcagaggactacacgtcctcgccttcagaggactacacgtcctcgccttcagagggctacacaccttcggcttcataggactacat

SEQ ID NO: 53546 - DNA, 180 bp, Glycine max
  Peptide Sequence Number=SeqID_145231
atggtcattttcagggcatacatccacaaagatacgggcctaggatcttcttcatcaatggattcctttgcttcttggaatatgaatgacagcggaatggagaaggaagagagagaggagatgccacttcaaggagacccccccccccagaagaagctcaccaccataggaggcaaatag

SEQ ID NO: 53547 - DNA, 687 bp, Glycine max
  Peptide Sequence Number=SeqID_145232
atgcaaaaatgcttcagagttcaaaaagcggggaatgcggtggaaagaaaagataaggagcttagaggaagcaaaaacggtgttatcggcggctatcataaatggttgaaggctcggaagcaagggataacttggctctcgaagctaaagatttcaagtggggaagaagttgaagtccctgaggagagcgaagaagtgcaagccttgaaacttgaaagaacgcgagtggtcaagggaatgttcaagatgacagccaccagggtcaggaaagagtgtgacgagctgagggataaacaacgaagtcaagctttgaagggccgaaaggggcgagtcaagggtggaaagtatgatattagaggacaagttgaaggcttgtcaaagtatagagagaagctaaacctagctgctagccatgagcaaaggctagaggatgagcatgcgaaggtattagctccgcacatggaaagaaaagcaagagagagagtgatagaattattgcacagagaagctatgaaatggatggataggttcactctcactctgaatgggagtcaagagcttccaaggctgttagccagagccaagtcaatggcgaacgtatactcagctcccgaggaagttcatgggcttttcgattattgtcatcatatgattgagttgatgtcccacaaaattaggaaccactga

SEQ ID NO: 53548 - DNA, 171 bp, Glycine max
  Peptide Sequence Number=SeqID_145233
atggagtctcacaacttccctgaaaaagttttgagatgtgggaagcatcacccaccttgtggcaggatagagtctacacctctttgggttctaggaagcccaaggacaaagtccatactaatgtctacccaaggtgcagatgggatgggtaagggtgtgtatagcccatga

SEQ ID NO: 53549 - DNA, 159 bp, Glycine max
  Peptide Sequence Number=SeqID_145234
ctaagctctagcttctcaaggaggcttctcaaggaagtgagcttagtttttagatggattctcaaggaagttttctcaaagaagcttctcaaggaagttttctcaagaaagcttctcaaggaagttttctcaagaaagcttctcaaggaagctacctag

SEQ ID NO: 53550 - DNA, 356 bp, Glycine max
  Peptide Sequence Number=SeqID_145235
atggtagtgcaattaatccatgaccgagtggagatggagtgcctagagggagtttgggagaccctcgaaggaaacgcgaggtgccaattctgtggcacgattcgactcacggctacttcattagtacatccagaggaacccgcatgcacgcttcagcacactgtggagtggatattacctacacctactccatatcgactagtggagcccttccaagtgatagaggtgtcgtcatctgaagaagaccctgaagaggacccaaaggagttacctcctgagcctactgtggatgccattgactttccagagggtgatgaggacccacttcctgatgtggattctccagaggacgtcat

SEQ ID NO: 53551 - DNA, 292 bp, Glycine max
  Peptide Sequence Number=SeqID_145236
gctcggatttccaacctttatcagtgccctttgcagagctagaagagttacctctgacagtctgacttatgagagcttgagcccggccattaacttggcctacattaagaaaaactgttggaatgtggatgatctgacagttaacttcagaagggcaaggaaggcaagggctcgacctgctaatgttccttcttcttctactccaccagctccttccacttctgctactcctacaccatctcctccaggcccatctgcccaggactctcagcgctttgagtccatgctttag

SEQ ID NO: 53552 - DNA, 213 bp, Glycine max
  Peptide Sequence Number=SeqID_145237
atggcacgcaacgtgtttgctccgtgcccctatttaatggacctatatgggagggagctaaaagggcttttagtgataattcccgaggtggtcgtatctctcttgatggtctctagaggtatcatccccttcgaagaacatattgtagcagtagggactactagcaacaatgtgtcatcaaagagaaaaactctagacgagggttcactgtaa

SEQ ID NO: 53553 - DNA, 264 bp, Glycine max
  Peptide Sequence Number=SeqID_145238
atgaatgttatgtctagcgctgttcatgtgtcctccaccttcgagtttggagctatgtttcatgatttcctaagtgcggaccctcaaggcaatcctccattctccccctttttcgagccccatgaatgttattgcctagtgctgcttcatgtgccctccaccttcgagtttggagctatgtttcatgattgtctaagtgcggaccctcaaggcaatcctccatactccaccttttttcggagccccatgaatgtcattggctag

SEQ ID NO: 53554 - DNA, 258 bp, Glycine max
  Peptide Sequence Number=SeqID_145239
atgcaattaccgcaagagcccttgaacaagagaccaagagggctcgcaaggaagagtatggccggaacaaatttcgcggagctctatggggctagaggaagggtgatcgactctttacaccaagaggcaaccatgtggatggatcggtttgctcttaccttgaacgggagtcaagaacttccccgattgttagccaaggccaaggcgatggcagacacctactccgcccccaaagagattcatgggcttctcggctaa

SEQ ID NO: 53555 - DNA, 336 bp, Glycine max
  Peptide Sequence Number=SeqID_145240
atgtggctgaaaggggtgaagacccttgtggttctatctggaaatcatgatgaatgcgctaagtgcgcctgtgcgcttagcctattcatcgcagttgtcaaatttttggatttccagatgaacgcgctaagcggaccatcgctaagcttgacctgtacggctaaacgcctctttgcttctatggcatccaagaagagaaaagctccctctacacctacccaagccagatttgatagatccaggttcacatcccaagaggcttgtgagagatacactgacattgtggtgcctcaaaagctactaccagagaggaatatggtagtctattacacatag

SEQ ID NO: 53556 - DNA, 297 bp, Glycine max
  Peptide Sequence Number=SeqID_145241
atggatcaaataggacttcccttgggaatgggttcttttgtgcggggcgagaaaaaagggtcgctagcgcacgggattttgggtaaggattatggtgagtcaggattttggctcaaggtttgtagaatggctagacatgatacatgtcggggtttggtttggctcaaggataaaagggatgcctcacattatttccatgacacaaaatgcaaaaatgatgatttggaaactttatgcaaaactggtcatgcatgcacctatgcggacactcaagtgtcaaattttatggtcatgtga

SEQ ID NO: 53557 - DNA, 248 bp, Glycine max
  Peptide Sequence Number=SeqID_145242
caccactcattgagttggggagaaaccatgttccttcatgggaagatgcccaggaaatgggtgttgagggaaggagcccagagtatgaagaacatcgggatttgaggtcaaatcctttccaaggtggagggaacttgatggaagcttgcttgtggggcttctatggaggctggatctttgagcttcaatggggtcctttaatggtgattttccaccatggagatgcagcggaagacaaaggaaaggag

SEQ ID NO: 53558 - DNA, 60 bp, Glycine max
  Peptide Sequence Number=SeqID_145243
atgtgcccccctcccataggtgatcagcctgggagcccaaaggtgttccctaccaggtga

SEQ ID NO: 53559 - DNA, 157 bp, Glycine max
  Peptide Sequence Number=SeqID_145244
tggagttgccaactgtcgcaacctaccattcggcaggagggtgacgcgtgactcgcaggtgcgtgttccaagaaaggaatacgcgcggcatcgccaccaacgtttatttgaggaaaacgtcggaaaaaccggaaaagatgtgacctacgaattttaa

SEQ ID NO: 53560 - DNA, 78 bp, Glycine max
  Peptide Sequence Number=SeqID_145245
atggttaaagataatctaggaaaattcgatgcaaaatctgatgaaggtcgactctttgagaggcccactaatgcataa

SEQ ID NO: 53561 - DNA, 432 bp, Glycine max
  Peptide Sequence Number=SeqID_145246
atgccaaagaacaagtctaagaagacaatctgcataatcctcttgacatgcttcatagggttaatgctcttgaaagcgccagaacttacttcgccgacatggcgatcaacctcaatgatagtgcctaccctcatgcatgcaaatgcagaagaaagccttgctaaggttgccacacctgcagacgaaggagatgccaaggctcaagtttataagtcttctcctgacttatatgcagtcatcttactcgttcgagatgcctccccctcgagcgaaagccattttcatacacgagtatttccatggtggccattagagttcacatgctctggatacttgcatcgtcgctccacctatgggacctatttcttggcttgcatgcatggactcacccgccaagaagactttcggtacaagggatcttcatgtccatga

SEQ ID NO: 53562 - DNA, 536 bp, Glycine max
  Peptide Sequence Number=SeqID_145247
cggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccgattaaaatgtggcatgctgagggttagggctacgctttggggtttgcggaggggcttcgaaccccgcgagggatggtggctccacggagtggatgctggagaggtaaatgatggcaaggactaccaggtggggacgtgggggtcagaggagaagaaggtgttgtcgagccactag

SEQ ID NO: 53563 - DNA, 315 bp, Glycine max
  Peptide Sequence Number=SeqID_145248
atgccgtgccatgaagttatcagactagccatctgtataatttgtgaagtgcaatgggatgatatggcaagtgatgtaagctccattagagcttgtaggcctagtatcttcttcatcaatggattcctttgcttcttggaagatgaatggcagcataatgaagaaaggaagagagagaggagacgccacttcaaggagaagatgagtctagaagaagctcaccaccataggaggccatggataagagcttggaggaagaaggagatgaatgaagggagaggaagagaagagcacgaaattttgtgctctaaatga

SEQ ID NO: 53564 - DNA, 111 bp, Glycine max
  Peptide Sequence Number=SeqID_145249
atgaccaaacttggtctctgcgtgccaacggacacgactgtgtctgaatggcaaaggggtgcggataaccataaggtatctccgcgtatcatgggtgcggataaccgtaag

SEQ ID NO: 53565 - DNA, 168 bp, Glycine max
  Peptide Sequence Number=SeqID_145250
atggcaataactgaagctacagggctccaaatgagggagttatggccacgaggtaattcctgggcagaggtggattttctggaattgtggtttgaaagaacaagggtgatgatgataggaaggaaagaatcactctttccagcgagggcaacacacaataggttgtga

SEQ ID NO: 53566 - DNA, 357 bp, Glycine max
  Peptide Sequence Number=SeqID_145251
atgtggggcatcccttttatccttgaaccaaaccaagccctaacatgtatcatgtctagccattctacgagctttgagccaaaatcccgactcaccataaaccttgacccaggagaaaagaagaagaagaagaagaagaagaagaagagaaaagaaggaaaattccccaatcaaagagtgggagaaagcaaaagaaaagaaaggaaattcccaatcaaagaatgggagaaagtaaaaaaggaagaagaagaaggaaagaaagcccctgatcggggatcgaaggaaaaacagaagaaatgtgcagagaggtctttggaccggacaatatctgaacaatacagaattgtcaccaaataa

SEQ ID NO: 53567 - DNA, 187 bp, Glycine max
  Peptide Sequence Number=SeqID_145252
ggttgtcatcatcaaaaagggggagattgtggaatcaatgccttcaaaggtgattttgatgatgccaaagaattcaagaatcaagagaaagattcaagagaagtttcaaatttccaagaatcaagaatcaagaataatcaaatacaagattaaagactcaagattcaagaatcaagagaagacttaa

SEQ ID NO: 53568 - DNA, 573 bp, Glycine max
  Peptide Sequence Number=SeqID_145253
atgagactacgttttcgagaagctggaataaaaagattacaaacagatgcttctgagaagatctcagctgagacacacttgctaaaagaaaaagaggagcacttgaaggaaattgaggtcttgcgggcccaggtggatcggaataatgaagcaactacatttgctatggaaaatttgcagctaaaagaagaaattagaaggcatgttttattgatacagctaaaatacttttttgttgcttttttttttattcatgtgcatgcaaaagtaactcactttgatttcatgattaaagtaaaggttgggaagtggcatagttactctatgaccaaaaatcaatcttccagtacgaacaatatatacattgcctattatatccacaaatatgaaaaaatgttaaagtcattttgtatggaaggtgaacgagaacggatgagtgaacaaatcatggtattggaaaacaagttgttggaagcactagattggaaatttatgcatgaaacagatctgaaaaaaaattctgatttgatgatcgaagatgtacataatgatggtaatctcatctccaaacag

SEQ ID NO: 53569 - DNA, 268 bp, Glycine max
  Peptide Sequence Number=SeqID_145254
aacttgtaaaaggaatttacaagatagtggaactctcaagcgggttgcttggggactggacgtaggcacaaggttgagcttagctcatcagtggactaagcgcgcatccaccgttaagtgcagcttaagcacgcatagtgcaacagaagaatctggtagagcatcaatatcaaggtcgcacgctaagcgtgagatcagtgaactaagcgcaagagttgtcttcagccaggctcagcacacgactagcgctaagcttaaatccacttaa

SEQ ID NO: 53570 - DNA, 288 bp, Glycine max
  Peptide Sequence Number=SeqID_145255
atggataaagttgatatctttgtccctcatcctctcacaaacgcatgtttgcttattcaactttcatcggaatgtgggtgcaagccattggtctgtttgctcaagcgacctatgctcctgagtgttgacttccaagactgttcaatcagagatactcgtcttgcacgttggtgggggtgccgtaaacaacgagaatcctctacaacaagagacccacggtctcttaatcccttttcagaaataagaagaagagaagaagaggtctctcgtaaaagaggtagattgtaa

SEQ ID NO: 53571 - DNA, 410 bp, Glycine max
  Peptide Sequence Number=SeqID_145256
acaaaggcattactgtcgcaaccaaaccttcggcgggagggcgatgcggggctcacgggtgcgtcttccaagggaggaaggcgtgcagagtcgccaccaacgtttattcgaggaaaacgttggaaaaaccggaatgtagccctctgaaggcgaggacgtgtagccctctgaacgcgagggcgtgtggccctctgaaggcgatggcgtgtagccctctgaagacgaggacgtgtagtcctctaaaggttagggcatgtagccctctgaaggtgaggacgtgtagccctctgaaggggaggacgtgtagtcctctgaaggcgagggcgtgtttgagccctctaacaggtcttgaaactcatggattctattcctcaacacctgtaaaaagaatgaaaacatatgtattctaa

SEQ ID NO: 53572 - DNA, 375 bp, Glycine max
  Peptide Sequence Number=SeqID_145257
atggcgcctaccaggcaccctttggatccagataagtccaacagggccctgggatttcccgaactgatcacaggactctgccagtcgttcggagtccccgttgcacctaccaaggcgcgccagcgggcacctcatcaggctggccaggctggggcatttgacatggagcagtatttacggcatttggttcgccagcaggcggccaaccaccgagcacataccagtttcagggcagaggttgcatggcccggagattggcccgaggcccaagcgggagaggcgcccccagaagttcccggcgatggagaagaggcccacgaggacgaggagatgggcgatttgcttgacttcttgggagggagtggagatacatga

SEQ ID NO: 53573 - DNA, 261 bp, Glycine max
  Peptide Sequence Number=SeqID_145258
atggtgcaaaagagggacaagaaacttagaggcagtagcaacgggcccatcggcggctaccataggtggttgaaagcctacgcacagggtctggattggctcccgaatttgagaaccactaaggggttggagtttgaaactccggaagaagatgacgaggtacaggccctcaagacagaactcgagaaagcccaaatagtcaaagaaaagttcaagtcaaaagctgttaggatccgaaaggagaacgccaaactgagagac

SEQ ID NO: 53574 - DNA, 379 bp, Glycine max
  Peptide Sequence Number=SeqID_145259
ccaagcattcggggttcccgtcacacctagtaaggtgattcgaccgccgatcacccaggccttcattgagaagtattgcacgcctagacaggggcagggtgatgcaccgcaggccgcaaacgcaccgccgccacctcatcaggctggtccagctgggtcatttggcatggagcgcctcagtcagcagagccagggtttcgctccttttgcgtgccctactccaaatcagttcagggctgaggttgcatggcccggagattggcctgaggcccaggcaggggaggcgcccacagaggctcccggcgatacaaaggaggcccgcatggatgaggagatgacatatttactcggtttcttgggagggagtggagccacatga

SEQ ID NO: 53575 - DNA, 327 bp, Glycine max
  Peptide Sequence Number=SeqID_145260
atggatgtccaactaatgactgaccaattcatgattatgcactccacaaatcaacttcaccatccagccttctcctccaaccgctggcttgcaacgaagcttgaagggacacccacatttcttagtcccaattatgacaaaggtgatgacaaaaagctcaaaggtcaatcaaagaatgagttcaagatattcaagatagaatcaagaacacttcaagattcaagaggaaagttgatttcaagaatcaagaatcaagattcaagagatcaagatttcaagaatcaagattcaagagatcaagattcaagactcaagattcaagaataa

SEQ ID NO: 53576 - DNA, 309 bp, Glycine max
  Peptide Sequence Number=SeqID_145261
atgacagaaaccgtttgtacggaaagccgcttgggtatctctgtacgtcacctgacttcacgggtcaggatgacagaaagtgctgaagacgatgagatgctgacatcttcgaaaagggtgcagatgaccacattggcctctgcttgtcaatcggacttggggtctccgaatgacgaggtgcggataaccgaaaggtgtctccgcatgctaccagactcttgggtcatgagagcaaaaggtggggtggtcgacaaaagagagccttttgctcctacgtatcctccatttgtgatgaagaactcagactaa

SEQ ID NO: 53577 - DNA, 291 bp, Glycine max
  Peptide Sequence Number=SeqID_145262
atggctccgaaaaagctttctgtgaagaggtctaggagagacgtcgcggctaaagggtccagtgccgcccccgagtttgatagccaccgtttctggagcgccgagcaccagcagcgcttcaacgccatcaaaggatggtcgttccacagagagaggcgcgtccagctcagggaggatgagtatacagattttcaagaggaggaagctcatagacattggacgttgctggtgactcccatggctaagtttgaccctgagaggagggagtgcgagacatgcgttcatgggtga

SEQ ID NO: 53578 - DNA, 429 bp, Glycine max
  Peptide Sequence Number=SeqID_145263
atggaagggttagtggacctagcagcgattgacgctttcctcgcctttcatcatggcaaggaaagcccggtcgtcgccattttggccatgtatgacacgttcgaccggggatgtgaaaagagcagcgcaaagaattgtttgttgtgcactggctctctatgtgtggctggtttcacaccttttttctccaagaaggaaggaagaatcaggattctatcttcatgcgaaggatgtccaaatgttcccttgatggaacaaggggagtgccatcagacgaaagcatcacgcctttcatcgcacggggtttcagtgaccacaacacgagggtactccaaggagttcgcaaggcatgggatgcagcgtgaagaaaggacagagagcttaggggaagcagtaatgggagcatcggcagctatcataagtggctga

SEQ ID NO: 53579 - DNA, 498 bp, Glycine max
  Peptide Sequence Number=SeqID_145264
atgactagaggcaatccatctgacttacaaccctttgatcctgagatagatatgacatttcatagagtagttaggcatcattttgtaccttttgagcatcctgagcattttattattggtgagactgagcattttgtggttggtaattttgagcatcctgattttgagcattatagttttgaacattctgattttgagcattctgagaacatggcccaacctccaccccgtgagaggactctaagggaaatggctgcacctgatttcacctacgaaagcttgtgcatccaataccctgatgaggatgtcccatatgttcctaaaactggactgattcatttgcttccaaagtttcatggccttgcaggtgaagacccgcacaaacatctgaaagaattccatattttctactccacaatgaaacccctagatgtccaggaggatcacatatttttgaaggcttttcctcattctctagagggagtggcaaaggactga

SEQ ID NO: 53580 - DNA, 216 bp, Glycine max
  Peptide Sequence Number=SeqID_145265
gggcaggatcatcttgagctactttctggggtagggacaaaacttgaacagcagaaaccaatcaaggaacggatgcaagtggggatgaagtcacgatcaactgatcgttgccccttctctgcgctaaacaagcagagaacgtcgctgcaagacagccccgtatcctttgtattcgcagttttcttttactatttgtttgtcttaaaaagaaaataa

SEQ ID NO: 53581 - DNA, 567 bp, Glycine max
  Peptide Sequence Number=SeqID_145266
atggtttgcaatgaccaggttgacatgatcgacagattacttgttgggtcatttactttcgattgtcacatcaagcactatatcattgttcgtattttgcttccttggtcttcaaatcttgcccaagcctctgaggaggatttgattctgttgtgggcccttcaaactggtcgtcagatcgactgggcccatctagttcggtactggatgcataaggcattacagacccatgcacttctcctgtatccccaccttgttactttttttcttcatcatttcaatgttcctttggatgatgaaccgatgttgatggtcaatgggttcgcaaacaagacttgtcattgcttattcctgatgaacgtacccctatctcctccaccacaaagggatgcttcttcttctctgctgactgaagtcctcacagagctctgtgatattcgagcatttgtgggtgctcgttttgatgcgatggatactcactttgatgggatggatactcgtatcactaggcttgaagatgatatgagcttcatcaagcgttgcttcgatcccccggccgactcttag

SEQ ID NO: 53582 - DNA, 1027 bp, Glycine max
  Peptide Sequence Number=SeqID_145267
agggctacaagcccgcacctttaaaggacaacacgtcctcgcctttagagggctacatgccctcgctttcagaggactacacgtcctcaccttcaaagggctgcatgccctcgccttcagaggactacacgtcctcaccttcagagggctatacgctctcaccttcagaggactacatgtcctcgccttcagaaggttgcacgccctcacctttagaggaatgcacgtcctcaccttcagagggctatgcaccctcaccttcagaggactacacgtccacgccttcacagggctacacgccctcgccttcagaggactacaggtcctcgccttcagaggactacacgtcctcgccttcagaggactacacgtcctcgccttcagaggactacacgtcctcaccttcagaggactacacgtcctcaccttcagaaggctacacgctttcaccttcagaggagtacacgtcctcgccttcaaagggttgcacaccctcaccttcagaggactacacgtcctctccttcagcgggctacacaccctcaccttcagaggactacacgtcctcgccttcacagggctacacgccctcgccttcagaggactacacgtcctccccttcagaggactacacgtcctcgccttcagagggttgcacgccttcacacgggccagtagtttccctttatcagtcccttggtcaccccctgatctcggaggagggccaactgtggatcacgcccataagacaccaaatggacctggaggagcccaacagggccctggggtttccagctctggttacgggcctctatcagtcctacagggtgcccgtcccccccagcaagggatcgtgcccgcaagacacctagtggacccgaagaagtccaacagggtcttggggtttccagccctgattacgggcctctatcagttctacggagtgcctgttgcccccaccaaggtcatcaggccccctaataaccgagctttcatcaagaagtactatgcccctaggcaagcgtag

SEQ ID NO: 53583 - DNA, 535 bp, Glycine max
  Peptide Sequence Number=SeqID_145268
atgacggaagggtgtggtgaagggttttgccttgcaaaccttcccggtgatgcttttagtctatgggggaacttctttgaggcaaagaaacaaatgatggctgatgccaagtttgcggggctgcttggtcttggcaagccgttggtgaaattttgcccccccggtcaacttcgtggtttttgcccgttgttggctttggctagggtcggcggtgctgggattttgccaactttggcttgcgccccgttggctaagtctgtgcctcggtggtggatcatcatgcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 53584 - DNA, 216 bp, Glycine max
  Peptide Sequence Number=SeqID_145269
atgatccccactccaaacgagaatatcccagttgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaaaggttcgggagttgtatttacgcacggggaag

SEQ ID NO: 53585 - DNA, 318 bp, Glycine max
  Peptide Sequence Number=SeqID_145270
atgccttatgaatcctcttgtgcttatgccgccagtacccgggaggcctcttatcctgtacatgacagtgttggatgggttgatgggatgcatgttggggcagcacaacgatttcggaaaaagagaacgggttgtctattacttgagcaaaaagttcacagcctacgagatgaactactctatgctggaaataacgtgttgcgctttaatatgggcatcccatcatctaaggcagtatatgttgagccatactacttggttggtatccaagatggacccagtcaagtaaagcccgctcttacggggcagatcgcttag

SEQ ID NO: 53586 - DNA, 60 bp, Glycine max
  Peptide Sequence Number=SeqID_145271
atggttaaagatcaaagaatgcgaggggaagagttgcggcggcacttatttaagttttag

SEQ ID NO: 53587 - DNA, 282 bp, Glycine max
  Peptide Sequence Number=SeqID_145272
atgcctgcaggtcgactcctagaggatcccacaggatacgtaggagcaagagcctcgcttttgtcgatcgcaccgctttttgttaccatgacccaagagctggtagcccgcggagacaccttacggttatccgcacctcgtcattcagtgaccccaagtgtgattgatgagcaaaggccaatgtggtcatctgcaccctttccggagatgtcagcatcttccggtggagaaattatggtcattctgcacccttttgtcatccagaggcgacgggcccgatga

SEQ ID NO: 53588 - DNA, 231 bp, Glycine max
  Peptide Sequence Number=SeqID_145273
atgcttcattccatgctccagagcttacacagggggtgtacacatggctcagaaggaggagacttctacagaccagatcccaaagccatcccagcacccatacctgatgatgccataccatctgcaccagcatctaagttaggacagcctatctctcaggattcaccaattgctcaggtgttggaccttaatgagcatgcacaagaacaaccacaagagcaggacatataa

SEQ ID NO: 53589 - DNA, 353 bp, Glycine max
  Peptide Sequence Number=SeqID_145274
gccatattgcttctcccgtccttgaaagagagcctcgtcaacagcccgaagaaggccacaaagaccctcaagactacgctcgaagggatgtcgagttctatcccccgattcccgaagggccggcacccaaaggaccgtccccggcaactgaagaaaggaggaagctcgatctccttgaggaaagattgagggccatggaaggatttggggactatccgttcacagacatgacggagtctttgcttagtacccgatgttgttatccccccgaagttcatcgacaagtatatagggacgacttgtcccaaaaaccatctcaagatgtactgccgcaagatgggcgcacactctaa

SEQ ID NO: 53590 - DNA, 340 bp, Glycine max
  Peptide Sequence Number=SeqID_145275
gtcgactcctagaggatcccacccagacattgtctcgacatcagggaaagctgctgcttcaggtgctgtgtccaaggatgctttgattgctgaactcaaggacacatgcaaggtgctggaagcaaccatcaaagccaacacagagaagaaaatggagctggaacggctgatcaaaaggctctcagaaagtggcattgatgatggagaagcagctgaagaagaagatgaagcagctgaggaagaagtagaagcagccgaggaagaagaagaagctgctgaggaagaggaagatgcagcagaggatactgaatcagatgatgattctgaagccaccccatga

SEQ ID NO: 53591 - DNA, 258 bp, Glycine max
  Peptide Sequence Number=SeqID_145276
atgagagcaccaaattgttatgactacgctgggtttacgaggaccagcacctccagacaactagagaggaaaggagaagaaataggggaaggaaaattcataagctttttcattgattctttctctttatttacagggctgacaacatcaagcaagaattttttgcaaggaagattttcgaagattctgggaatgactcagcattctctttttgtcactatcctcaaacgaagtcgtttaggtatgcacgtttcttaa

SEQ ID NO: 53592 - DNA, 396 bp, Glycine max
  Peptide Sequence Number=SeqID_145277
atgggtcaacctacacactcttctgttttgcaggttacaggttctaccatctatggtgaggctcatgaaacaggccaatgtattcccattgaacagtggaggacacacaggagtccatataatcagcaaggacaatggaggacacaccttagcaatcagttcaacaaagaccaaagtgggccttcaaataggccaatccaacaaggacctaacatactccagagaactactaagctggaggagaccttgactcagtttatgcagatagttgacaagtcatccaatagttttgtggcaaatacagaacagaatcccaaggaggaatgcaaagctgtgatgacaaggagtaaaaagtctgtggaggctgaggatgaggatagtgttgtgcataagtag

SEQ ID NO: 53593 - DNA, 128 bp, Glycine max
  Peptide Sequence Number=SeqID_145278
atgggaaagctggatcatctagaggaaaggctcagggccattgaaggaggttgtcgcaacctacccttcggcgggagggcgacgcgtgactcgcgggatgcgtgttccacgaaaggaatacgcgcgga

SEQ ID NO: 53594 - DNA, 179 bp, Glycine max
  Peptide Sequence Number=SeqID_145279
gatcaagagaaaacaaccttcacttacccatttggagtctttgcctgacagagaatgtgatgcaatcctatcccccaagggaattggatagaagactccaagaagattgggccaaagatgcaagagaaggcccaaggattctcatgagccttagggtagatttcgggcccatgggctaa

SEQ ID NO: 53595 - DNA, 312 bp, Glycine max
  Peptide Sequence Number=SeqID_145280
acgtccggaaagagtgtgtcgggttacgagaagaaaattcagcaaccgcaagagcccttgaacaagaaaccaatagggctcgcaaggaagaggatggccgagacaaattccgtggagctttgtggggcagcaacacgtttatgtgagacagagaccagcatgttagccatcgtcagcaagtaccaagaagaactaaatctagccatagcccacgagcataaagtggcggacgagtatgcccaagtgtacgcggaaaaggaggctagaggaagggtgtcgcaacctacccttcggcgggagggcgacgcgtga

SEQ ID NO: 53596 - DNA, 66 bp, Glycine max
  Peptide Sequence Number=SeqID_145281
atgcgtcctccaccatcaagtgcggagcctccgagaaagaagaaggagagatgggagtcgtcatag

SEQ ID NO: 53597 - DNA, 198 bp, Glycine max
  Peptide Sequence Number=SeqID_145282
atggcagaaatgggaaagttggatcatctaaggaaaggctcagggccattgaaggagaacatttgcaaaaagggggacggatctttcaaagaacacgcccaaaaggtggagggatctggcggcccaagtggtacccccaatgatggaaagggagacgataatcgtgatggtagacacattatcgatactctactatga

SEQ ID NO: 53598 - DNA, 396 bp, Glycine max
  Peptide Sequence Number=SeqID_145283
atggcatcgaccaggcaccctttggacccggataagtccaatagggccctgggatttcccgcattgatcacaggactttgtcagtcgttcggagtccccgtcgcgcctagcaagggtgatgcaccacaggccgcagacgcgccaccacctcatcaggctggtctagctgggtcatttgattcggagcagtatttacggcatgtggttcgccagcaggcggccaaccaccgggcgcacgtcgcatggcccggagattggcctgaggcccaggcaggggaggcacccgcagaggctcccggcgaggcagatgaggcccgcgaggacgaggagatgatcaatttgcttgatttcttgggggggggagcggagccacatgatttggagatccctagatcc

SEQ ID NO: 53599 - DNA, 354 bp, Glycine max
  Peptide Sequence Number=SeqID_145284
atgagggagaagcttgccacccagctcgcccaggcgagcaaggttgcttcctccagaagcaacacccttctggaggaaggatctagaaggcccaagtgggccagattgctatttgcacccccctttttactaagtgcaccccccttctatttttttgctttcgaagaagttacggaaactcacggattgcgcaaaaacacctcttttcgacttccgccacattacggaatttcacggatcgcgcaagcctgcttccttttgatttctgagacgtctcgggacttcattcattgcgcaacaaaggacgccaagtatctcaaagcggctaaccaaaggttgcatgtcatcaagtaa

SEQ ID NO: 53600 - DNA, 126 bp, Glycine max
  Peptide Sequence Number=SeqID_145285
atggttctacacgaaaaagccattggtgttaatgttgaagatgatgattcagccgttgacacttgtgttagtcctttctccacacaaatgccgcctaacatcaatggtggtgaagaagttaacaat

SEQ ID NO: 53601 - DNA, 630 bp, Glycine max
  Peptide Sequence Number=SeqID_145286
gggacttgggccggtccgccactgaggacgcttctccagactacaattcggacgccgagggcgaccgatttcatggtgggctttcccggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggcatcgacaatgatccttccgcaggttcacctacggaaaccttgttacgacttctccttcctctaaatgataaggttcagttggacttctcacaacgtcgcgggcagcgaaccgctcacgtcgccgcaatccgaacacttcaccggaccattcaatcggtaggagcgacgggcggtgtgtaccacgggcagggac

SEQ ID NO: 53602 - DNA, 623 bp, Glycine max
  Peptide Sequence Number=SeqID_145287
gggacagagctaggctgatctttggcttagtctctcgcatggatattaacataggagctctcatttctagccagatgacttctatagcccagtctaactcttctagacttgggtttcctgctctgatcattgccctatgtcgagccagaggggttgtctctgacagcctcacttttgagcgcctgagcctgatcattaacttgacctacattaggaagaactgttggaatcctgatgatctgagagttgctatccgaggggctaggagggcgagggcgagggcgaggccagctgatcttccttccacatctatagctcctactccacctggggcccaaccttctcttcatagggaagatgaaggtcccaaaacccaggtaccacagcatgtagaggatgcgtcatctgaggccaccgttctagagccattcattatagaggaggaggcaggtgagacaaagcatgcagcagacccctccactcttatactcgagataccagaggacccgaccacaccagtcctaaccctgaacacttctcctccagctactccagtacttcatttgacagatgaagagggtgttcaaacacgggacactcaggacgagtcacaggaattctaa

SEQ ID NO: 53603 - DNA, 312 bp, Glycine max
  Peptide Sequence Number=SeqID_145288
atggcgtgcccgttagcatgcgtaccgaaagagccctcatggacctcccccagcatgctctcagcttctttagcgttcacgcatcagagcaaaaccatgtcatggtttctcttgtatagtatgcttccgctcaagaagaaaccggctgccaatctccttaacgtcctcttgtcgttgttggaggcctccggtctctttgcggtgtcagctagaacatggacgctaaagtggcaagcacatccaccatttgattttcctctcgaggaatgtgatggaaggagatctcatcaaagaactcagccaattccttga

SEQ ID NO: 53604 - DNA, 240 bp, Glycine max
  Peptide Sequence Number=SeqID_145289
atgtcagccagtgatcatgccattctacgagacagaacccatcaacccatgaagaaaagcttgatagagctatcatcacatgatgctttattggcacagaacaagttgcttgctaagcaacttgagattttaacagaaacactcgataagctaccaactaagttgtccacactcttctgttttgcagtgacaaaggtatactcaaggaggattttcaggctttcagtagggtccctataa

SEQ ID NO: 53605 - DNA, 831 bp, Glycine max
  Peptide Sequence Number=SeqID_145290
atggacatgaacataggagctctcatttctagccaaatgacttctatagcccagtctaactcttctagacttgggtttcctgctctgatcaccgccctatgtcgagccagaggggttgtctctaacagcctcacttttgaacgtctgagcccggtcattaacttggcctacatcaggaagaactgttggaatcctgatgatctgatagttgctatccgaggggctaggagggcgagggcgaggccagctgatcttccttccacatctgcagctcctactctagcatccacttcagcaactcctttagtcccatctcagatggattctcaacgctttgaagccatgcttcagagcattcatcagggacagatcattttacttcagagtttacaggtggtggtgcctccagggtccattccttccattgagaagtttctaaaaagggtagcctggattggggcccaaccttctcttcatagggaagatgaaggtcccacaacccaggtaccacagcatgtagaggatgcgtcatctgtggccatcgttccagagccattcattgtagaggaggaggcaggtgagacacaggttatacaggaagctgttgctactcctgagaggtcacgaaagggcacatcagatccacccacaccagtagtggacctatcctcacctcagcatacagcagacccctccactcctatactcgagatatcagaggacccgaccacaccagtcctgactttgaacacttctcctccaactactccagtactttatctaatagataaggaggatgttcagacacaggacacccaggaccagtcatag

SEQ ID NO: 53606 - DNA, 105 bp, Glycine max
  Peptide Sequence Number=SeqID_145291
atgcgaggggttaggtggcctgcgggaaaaagagagggttttgggagaagagggaaaatcgaaattgtgaggcagaggaagctaaggagtcagtctaaaaactga

SEQ ID NO: 53607 - DNA, 215 bp, Glycine max
  Peptide Sequence Number=SeqID_145292
ggatcgtgcccgcaagacacccaatggacccgaagaagtccaacaaggtcttggaggggccaagctctaattacgggcctttgtcagttctacggagtgtctgtcgcccccagcaaggtcatcagccccctactaatcgagctttcatcaagaagtactatgtccccaggcgggcgcagggcgaaacaccacagcagcctggggatggccggtag

SEQ ID NO: 53608 - DNA, 358 bp, Glycine max
  Peptide Sequence Number=SeqID_145293
atgaggggtggaaataggcggctacgtcaatctagcgcaacgagagcatccaagtcacaacaactcacaaaaattgcttccgatgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 53609 - DNA, 75 bp, Glycine max
  Peptide Sequence Number=SeqID_145294
atggaagagaagcttgcttgtggagcttctatggagtatggatctttgagcttcaatgtggtccttcaatggtga

SEQ ID NO: 53610 - DNA, 342 bp, Glycine max
  Peptide Sequence Number=SeqID_145295
atggcagccctagatttcccttatacttggtggagtgggccaatcaggaatgacctttattctcttaggattcgtgggaaccccttgatcactgtcacaacctacccttcagcaggagggcgacgcggggctcataggtgcgtcttccaagggaggaaggcatgcggagtcgccaccaacatttattcaaggaaaacgtcaaaaaactggaaaggtgtggtgatgcaatcctaccccgcaagagcattggataaaagactccaagtaaattgggccagagatccaagggaaggccctagggttctcatgagccttaaggtagatttcgagcccatgggctaa

SEQ ID NO: 53611 - DNA, 870 bp, Glycine max
  Peptide Sequence Number=SeqID_145296
atggggacaaggggttgcattaattacaatcccatcctcgccataagacaactgggctaccctatgagaggggcaccattagaggaagacctcacacctattatttcacgaggtttcaatacaaccaacgtggaggcacttcagaaggtccgcaaggcattggagatggtgcaaaagaaggacaaggaactcagaggcagtagcaacgggcctatcggtggctaccataggtggttgaaagcctacacacaaggtctggattggctcccgaatttgagaaccactaagggggtggaagaaaatgccgaactgagagacgtaaatatagctaccaccaaggccttggaacaagagaccaaaagggctcatagggaagatcatggccagaacaaattccgaggggctctgtggggcagtaacagcgagcttaagctctggagagaggaaagggaccaatcacgagtagacagtttgatcttgaaggatgagttgaaggtttgcctaaggtccaagagaagcttgtctcagcggttatgcgagacagagaccaacatgttagccatcattagcaagtaccaagaagaattaaatctagtcacggcccacgagcacaaagcggcagacgagaatgcccgagtatacgcggaaaaggaggctagaggaagggtagttgactcgttacatcaagagataacaatgtggatggaccgatttgctcttactttgaacgggagtcaagaacttccccgattgctggccaaggccaaagcaatggcggacacctactccgcccccgaggagatccacagacttctcaactattgccagcatatgatagacttaatgacctatataattaggaaccgctag

SEQ ID NO: 53612 - DNA, 306 bp, Glycine max
  Peptide Sequence Number=SeqID_145297
atgcaactaccgcaagagcccttgaacaagaggccaagagggctcgcaaggaagaatatggccgtaacaaatttcacggagctctgtagggtagcaatagtgaactcaagctgcaaagggaagagagggacaagttgcgagtacatagcatggtccaaaaggagcttgtctcagcgtttatgcgagacggagaccaacatgctagctatcatcgccaagtaccaagaagagttaggtctagccacggcccacgagcttagggtcgcgggacgagtatgcccaagtatacgcggaaaaagaggctag

SEQ ID NO: 53613 - DNA, 558 bp, Glycine max
  Peptide Sequence Number=SeqID_145298
atgggtcaacttcaacggcaagccttccgcaaagcctatggtaagatttgggacctagctagggtagaagtctccatggaaccgattgcatccctttcccagtattatgaccagcccctaaggaagccatatcttttctctgggttctatccctccacgacaagagttgccaaggtagtgaaaatctcagcacaagagttggaacgtctaaagcaaaacagaaatggagtagtcggagtaccaaggaagtttgtcctctttccgaatatggaagggttagtggacctagcagcgattgacgctttcctcgcctttcatcatggcaaggaaagcccggtcgtcgccattttggccatgtatgacacgttcgaccggggatgcccgtctatccgctacaaggtcaccgctcgtgcgtcgaaaagggaaagggagtcaagaacttccccgattgctagccaaggccaaagcagtggcggacacctactccgcccccgaggagatccacggacttctcagctattgtcagcatatgatagacttaatggaccatatgattag

SEQ ID NO: 53614 - DNA, 90 bp, Glycine max
  Peptide Sequence Number=SeqID_145299
atggataaagttgatatctttgtccctcatcctctcacgaacgcatgtttgcttattcaactttcaccggaatgcaacctgcgctcctga

SEQ ID NO: 53615 - DNA, 593 bp, Glycine max
  Peptide Sequence Number=SeqID_145300
gcttttcgtcttacagatatcaaaaaagaatatttgtacggataaccactcgggtatttccgcccatcagcgtgactcaaatgtcagtatgacagatcttgtgagcgtggaagatgactacacagaagacgacgttagtctctgcgtgctatcaggcttttcgtcttacagacatcaaaaaagaatagtttatacggataaccactcgggtatttccgcccgtcagcgtgactcaaatgtcagtatgacagatcttgtgagcgcggaagatgacacagcaaaaaagaatgtttatacggataaccactcgggtatttccgcccgtcagcgtgactcaaatgtcagtatgacagaacttgtgagcgcggaagatgacggcgcagaagacgacgttagtctctgcgtgctatcaggactttcgtcttacagacagcaaaaaagaatgtttatacggataaccactcagggtatttccgcccgtcagcgtgactcaaatgtcagtatgacagatcttgtgagcgcggaagatgatgtaaatctccgcgtgtcaacgggctttgcgactgtgattgacgaagggcacagaagacaac

SEQ ID NO: 53616 - DNA, 690 bp, Glycine max
  Peptide Sequence Number=SeqID_145301
atggccccgaggaaacttgcctcaaagagatccaggaaggataaagcggccgaaggaactagttccactctcgagtatgatagtcaccgctttaggagcgctgaacaccagcagcgcttcgaggccatcaagggatggtcatttctccgggagcgacgcgtccagctcaaggacgacgagtataccgatttccatgaggagatagttcgccggcggtgggcatcactggtcacccccatggccaagttcgatccagacatagtcctcgaattttatgtcaatgcttggcctacagaggagagcgtgcgagatatgaggtcctgggtgaggggtcattggatcccgtttgatgcagatgctatcggccagttcctgggatatcctttagtgctggaagagggtcagcagtgcgagtatggccagaggaggaaccggtccgatgggtttgatgaggaggccatcgcccatttgctatgtataccggggcaggatttttcccggactgctgccgggagacgggtgcggatcatgcgcaccaacatgatcaccctgactcagatctggatgactttgctgctcagcaacatccagcccagcgaccataattccgacctccccctgccgaaatgtcagctggtgtacgccatcctgacgcggatgagcatttcacgtggctcagttaatcgctga

SEQ ID NO: 53617 - DNA, 249 bp, Glycine max
  Peptide Sequence Number=SeqID_145302
atgtgggtgtcgagggagcggcttctggcatatttcaggcgggaggagaaagaggacaacgatttcaggcaggaggatgacaaagagaagagggaggacaagaaaaatcaaacaaggttgcttcaaaggataagcaatgcttcaagattaatacaagattgcttcaacaaacaaagccttgtttcaagattcactgaagatcaagccttgcctcaaaacaaagtgtttccaagacatgcaaggctctag

SEQ ID NO: 53618 - DNA, 446 bp, Glycine max
  Peptide Sequence Number=SeqID_145303
tacaatctaaatccattaacgaggatccattggagggcaagtctggtgccagcagccgcgctcgtagttggaccttgggttgggtcgatcggtccgcgtccggtgtgcaccggtcggctcgtcccttctgccggggatgcggtcctgtccttaactggccgggtggtgcctccggtggtgattctgatcatattgtgttggccttcgggattggagtaatgattaacagggacagtcgggggcattcgtatttcatagtcagagataccgtcctagtctcaaccataaacgatgccgaccagggatcagcggatgttgcttttaggactccgctggcacattctgagaaatcaaagtctttgggttccggggggagtatggtcgcaaggatgaaacttaaaggaattgacggaagggcaccaccaggagtggagcatgcggcttaa

SEQ ID NO: 53619 - DNA, 423 bp, Glycine max
  Peptide Sequence Number=SeqID_145304
atgacagtcaccgctttaggagcgctgtacaccagcagcgcttcgaggccatcaagggatggtcgtttctccgggagcgacgagtatactgatttccaggaggaaatagggcgccagcggtggacatcactggttactcccatggccaagttcgatccagaaatcatccttgagttttatgccaatgcttggccaacagaggagggcgtgcgtgacatgagatcctgggtaaggggtcagtggatcccgtttgatgccgacgctatcggccagctcctgggatatccgttggtgttggaagagggccaggaatgtgagtatggccagaggaggaaccggtctgatgggttcgatgaggaggccatcgcccagctgctatgtataccggggcaggattttgcccggactgctgcagggaggcga

SEQ ID NO: 53620 - DNA, 780 bp, Glycine max
  Peptide Sequence Number=SeqID_145305
atggctgagaagacaaagaaaagactggaggaagctgcccagtctagaagcactgagggcgtcattgaccctccatctcccatcggatgccacgtgaagtggaagatggcccgcacaaagcaaattgggcagatgacgtctgaggtaccagctggaggagttgatcacagaaaaagtgacttggtaggtaatggcatccttcagccagatgcagtcccagttttagtcttagatgcaatcacagggacttgcactgcctccggagccagagttggtcccttaggtgctcgcgtcaacacaaaggagagctgtgttgatcccttagggaacgatccagagacgggtgactcagacaaatgcaggctgtacattgaagaaaatcattcctgcctggttgcccaaggaagactttatgagggatccacagcggttcacaatatccctttgttgcatggccaagtgaaggttggtgttgaggaggttaaagatgtagagactcccgttcctgtacccactaacgaggttaccttagtggggcagacacttaacaccttccttgcttggccgacacatctcacagctgtgtctccagcaaaacctccaaaaagcccagatcatgaggtcgaagatcccctatatctgatgacattgaccatcccacaactgtttttgaagcctctccaggttatgtgggatgcttccctgttcggcctgtttaattcagacttccccttgtacataaagcatgaagatctatctgaaatagcacacgatggttaa

SEQ ID NO: 53621 - DNA, 950 bp, Glycine max
  Peptide Sequence Number=SeqID_145306
tggcaaggactggctgtattaccttgctccaaggtccatcacgagctgggatgaccttaagagagtattcttagaaaaaaatttccctgcttccaggaccacagccatcaggaaggatatctcaggagtgcatgaggtagctacaaacccatctgcatcatctgaaactaagaagcttgaaggcaaactggatgcgttggtcaactttggtaacccagttagccttgaatcagaaattttgtacctgtcgcaggggtttgtggtttgtgcttcctctgctgaccaccatacagacctttgcccttccatgcagcaacctggagcaattgagcagcctgaagcttatgcagcaaatattacaatagacctcctcaccttcagcagcaaaatcaaccacagcagagcaatttatgacctttccagcaacagatacaaccctggatggaggaatcaccctaacctcagatggtccaaccctcagcaacaacaacagcagcctgctccttccttccaaaatgctgctggcccaagcagaccatacattcctccaccaatccaacaacagcaacaaccccagaaacagccaacagttgaggcccctccacaaccttccctcgaagaacttgtgaggcaaatgactatgcagaacatgcagtttcagcaagagaccagagcctccattcagagcttaaccaatgagatgggacaattggctacccaattgaatcaacaacagtcccataattctgacaagctgccttctcaagctgtccaaaatcccaaaaatgtcagtgccatttcattgaggtcgggaaagcaatgtcaaggacctcaacccgtagcaccgtcctcatctgcaaatgagcctgccaaacttcactctattccagaaaaaggtgatgacaaaaatttacctaacaatttctgtgcaggtgaatcttcttccacag

SEQ ID NO: 53622 - DNA, 234 bp, Glycine max
  Peptide Sequence Number=SeqID_145307
atggcgcctcctctcacctcttttcctttgtctaccgctacatctccatggtggaaaatcccattaaaggaccccattgaagctcaaagatccaataatttaattttcgtggaacctaatgatgatgcacaatctaaggaagaccttgatgatgatgatggagatggagatggtgatgaaagtgatgatattcatggagatgatccaattagaggattggacatgcttctttga

SEQ ID NO: 53623 - DNA, 736 bp, Glycine max
  Peptide Sequence Number=SeqID_145308
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggagaatatctaacgaagaaatgagaaatcctcgcctttcggctgctttacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53624 - DNA, 255 bp, Glycine max
  Peptide Sequence Number=SeqID_145309
atgctccaatcatgtgggatcggcacaggtttaaaggagcactcaaactgggtgacccccaaggcctacactccgaagagtccgtcagggcctctccctcctaactcaggtcttagcattaactcgtcgtccttaaagggtcttagcattaactcgtcgctcttaaagggtattagcattaactcgtcgcctttaaaggatctaagcattaactcgtcgctcttaaaggatattagcattaactcgtcgccctaa

SEQ ID NO: 53625 - DNA, 409 bp, Glycine max
  Peptide Sequence Number=SeqID_145310
gtattcctattggagtcaaccccaaaagaaaggtggtgtgggatcctataattaggaaatttgaggctaggctgaacagggcccctaaagcagtgatcaataggttatcttccattcaaagacaatttctttggggtggtaaccgagaagggaagaagattgcctgggtatcttggagacaatgttgtgtttctagagatgtgggagatgcttgggctgatgatgggattcccctcaaagaccaatttccagaattataccgaatttcctcccaaagaaacctcattgtggctaatatgggatccttctccgaaagcgggtgggaatggaatctcctttggagaagaaacctgtttgataatgagatgggaatagcttcaaaattcattgaccaaatctcagcaatcag

SEQ ID NO: 53626 - DNA, 410 bp, Glycine max
  Peptide Sequence Number=SeqID_145311
atgtccaaccttggctccaaagaggactccttcccaagtagaaaatacaccattggggcacagtttgtgtgggagccttacccatcaaccgttatgtcattgttgcctcccgtttgtttagtcggaagtctcgcgtggtacgcggtggtgccactaatttgtttccaagttattgagtggcaccaaccggacagagccttgagacaatttgggatgcagcaaccagttccagagtctccttcacaacccctaaacattcatggcataacattaaaggggaaacatgacgaaaattgggggcaattgttcgccccaatgattcagcagtggaataatcgccatgcatttagggtcgacgcttatccccgacaagaaggcctattgagttttaactcggactacatggtctg

SEQ ID NO: 53627 - DNA, 495 bp, Glycine max
  Peptide Sequence Number=SeqID_145312
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatcttcccagccagcgttgcgagtgcagtactcattcgttttatacctctgaatcaatatcaacctggtggtgagcaatggtttcaaccatgtaccggatgtgttctgccatgcgctcctgaaactcaacaatcaagcttatcgataccgtcgacctcgagggggggcccggtaccagcttttgttccctttagtgagggttaa

SEQ ID NO: 53628 - DNA, 261 bp, Glycine max
  Peptide Sequence Number=SeqID_145313
atgtgggtgcaagccattggtctgtttgctcaagcgacctgtgctcctaagtttggacttccaagaccgttcaataagagattactcgtcttgcacgttggtgggggtgccgtaaaacaaagagtaaaaatcaaccgcttctttcattctcccttgctacaaggttgtgaaaacaaaacaacgatggataccttagaggcctacactggggcaatgaaatgcaccatgcataaacctcaagtgaacctaggggcagattag

SEQ ID NO: 53629 - DNA, 560 bp, Glycine max
  Peptide Sequence Number=SeqID_145314
acaaacgcggccataacagcggaatgacaccggtaaaccgaaaggcaggaacaggagagcgcacgagggagccgccagggggaaacgctggtatctttatagtcctgaaattccgccccgttggggataagccactagttctagcgtcgccgcatgacgaccgagcgcttttttttcacgaacgcttcgactgggacaccctggctcagtgtacccaacatagtaatcgccagtatgagcacatccgccctttagcgccagctggcgtaatagcgaaaggcccgcactcgatcgcccgcgcgttggccgtcatacagttgcgcagcctgacatggtttcccgaatggaaagcgcgccctgtagcggcagcaattaacgcggcgggtgtggaggaacagctgatgaaaccagaagccactggagcacctcgaaaaacaccatcatacactagaatcataagcttggcagcatcacccgaggcgcacggtattgcgccaataagacctgtgatcccggaagcatccttcgaaaaaaaatccggtgtcctgttgaaaaagtag

SEQ ID NO: 53630 - DNA, 358 bp, Glycine max
  Peptide Sequence Number=SeqID_145315
atggaccctcggaggactacacgtcttcaccttcatagggctacatgccctcaccttcagaggacttcacgtcctcgccttcatagggctacatgccctcaccttcagaggactgcatgtcctcaccttcagaggactacacgtcctcaccttcggaggactacacgtcttcgccttgagagggctacacgtcctcgccatcagagggctgcacgccctaaccttcagagggttgcacacactcgccttcagagggttacatcccctcaccttcagagtacttcacgtcctcgccttcatagggctacatgccctcaccttcagaggactgcatgtcctcaccttcagaggactacac

SEQ ID NO: 53631 - DNA, 303 bp, Glycine max
  Peptide Sequence Number=SeqID_145316
atggtgaaagttggaacctcttacgtgccgatcaacgtctcattttcgccaaaagttggcccagggaaaacaaattcccgtatgcaacaagggctccggatttttcattctgcgaaaatgatcttccgtcacaggtatagcttattcgggcaataccgtgcgcctcggctgttccctcctgttcagctactgacggggatggtgccgtcaatcggcaaaagcataccgaccggacatcagcgtggcaagtgtaagccggtgcaatacgctgagctaaccacctacatgcccgttcgcgcttaa

SEQ ID NO: 53632 - DNA, 214 bp, Glycine max
  Peptide Sequence Number=SeqID_145317
gcatggagcggtatctacagcacttggttcgctaacaggcggccaaccaccgggggcagatcagtttagggttgaggtcgcatggcccgaagattggcccgaggcccaggcaggggaggcgcctacaaaggctcccggcgatgcagatgaggcccgcatggaagaggagatgacggatttgctcggtttcttgggagggagcggagccacatga

SEQ ID NO: 53633 - DNA, 1698 bp, Glycine max
  Peptide Sequence Number=SeqID_145318
atggatcgtcaatggccagcgcttaaagccggggtacggaaaacaaaagcccaacaggtgaagtcagcagaaggaggggtgctaatagcagaagtccagtgggctgcacgaagctacgtgcttagcgcgagacctcgcgctaagcgcccagggtacatcacgctaagccttgctagaggcttagcgagtgcggacacgaggcttgcgcagctcgctgagctgctgccagacagaggagcaagacggaacacgcgcttagccagcacagacgcgctaagcgccctcatggacttcagcgaacgcgctaagcgcgctcttgtggcgctaagcgcgtgccagaagcagcgcgcagggtggcgccaagcgcgaggctgggccttagggccaccagtcctcgcgctttgctttctgcaccccccttctttactcacttcacccctgcttatgtcttctcgcaagcgccgagctgtgcctacaccaggggaagcgtccaactgggactcttcccgcttcacatccgagatcgcttggcacaggtaccaagacaacattcagcttcggaacatccttccggaaaggaatgttgaacttgggcctggtatatttgacgagttccttcaggaactcaggcggtgcagatgggaccaggtgctgactcacctaccggagaagcggatcgacgtggctctggtgaaagagttctattcgaacctttatgatccagaggaccacaatcccagattttgcagggtgcgaggacaggtcgttcggtttgacgctgacacgattaacgacttcctcgacaccccggtcatcttggaggacggggaggagtacccagtatacaccagatacctcagcactcaccccgatcctgacaccatcgccgccacattgtgtactccaggggggcgttttgtccttaatgctgatggactcccctggaagctactgaggaaggacatgacgacactcgctcagacatggagtgtcctttcttactatgatctcgcgcccacttctcacacatctgatgttaatcttgacagggcccgcttgatctacggtttggtgagccgcatggatatggatgtgggcagctttatatcacagcaaatcagccagattgcccagtccagcacctcgaggctcgggttcccagcattgattacagcgctgtgtgacattcagggggtggtttctgataccctgatctttgagtcactcagccctgcgatcaacttggcctatgtgaagaagaactgctggaaccccgccgacccatcgatcacctttcctgggactcgccgcacacgcaccagggcttcagcgtcggcttctgaggcccctcttcctacccagcctccgtctcagccttctcagagaccgcgacctccacatgcttccacctcagcatccatggacatgcattttcagatgctgaggtctattcacgtcggacaacagctcatcatggagaacatgcataggctgtccttacacttgcagatggacccgccgctcatcactccagaggcttatcgtcagcaggttgcctggtcaggagaccagccctccactgacaggggggaagagccttctggagccgctgaggatcctgcggtcgatgaagacctcattgctgacttagccactgctgactggggcccatgggcagacctgggcggaggcagctaa

SEQ ID NO: 53634 - DNA, 69 bp, Glycine max
  Peptide Sequence Number=SeqID_145319
atgactaaagcacgcacaaggggggaaaagaaggagaagcttgccacccagctcgcccaggcgagctag

SEQ ID NO: 53635 - DNA, 219 bp, Glycine max
  Peptide Sequence Number=SeqID_145320
gatgaggaatcatttgatgttactttctcggttggtggagaaaggtttcatgctcataagcttgttttggcagctcgatcaaccatgtttgaaactcaattttttaatgcgatgaagaaggatgatcaggagatagttgttattgacatggaacctaaggttttcaaggtgtcacattctgttccgtacaaaatcgccggtcttaccgcagtccgataa

SEQ ID NO: 53636 - DNA, 336 bp, Glycine max
  Peptide Sequence Number=SeqID_145321
atggtgaaagttggaacctcttacgtgccgatcaacgtctcattttcgccaaaagttggcccagggcttcccggtatcaacagggacaccaggatttattttgtcagatgcgaagttgatacttccgacacagtggcgtatcatggtttctatcagctgttccctcctgttcagctactgacggggtggtgcgtaacggcaaaagcaaccgaccggacatcagcgctggcaagtgtagcgggtgccgacgctgcgcgtaaccaccacacgccgcttaattgcgccgctacagggctgcccgtctttccattcgaccattcggtgccaactgtatga

SEQ ID NO: 53637 - DNA, 519 bp, Glycine max
  misc_feature (338)..(338): n is a, c, g, or t
  Peptide Sequence Number=SeqID_145322
atgaagctttgcttctacacaaagcaccctggacgtgtccgtgctgttggagccaatgtcaccatcaagaaatacttcggatcagctccacagaagtcccgcagctcttcctcactgcctcctgaagaattgcagcagctgacccagcaaatcagagaccagctagaggattcgatcatagaaaaagtgactcggcagctcatggcatcattcagtcagatgcagtcccagtttcagtcccagatgcaatctcagggacttacactgcctcccgagcctctggttggtccctcaggtccctcgagaaacgatcctgagacgggtgactcagagaggtncggcttgtacatcgaagcaaatcctactcacctggttgccctaggaaaagtttatgagggatccactgttgttcataacactcctttgttgcatgtccaagtaaaggtgggtatggaggaggttaaagatccaaatgctcccgttcctgtacccactgatgaggtttccttaatggggtag

SEQ ID NO: 53638 - DNA, 441 bp, Glycine max
  Peptide Sequence Number=SeqID_145323
atggaagaaaagaaaccgaaagtgaacgaaataaagacgaaagccaaaaaaataagaaatgaattgaaagtctcggattggaaaacttacccgttgaagaacgaagaacgaataaagaacggtgaagaacgacggaaaaccttcacggatttgctcacagaaacgtctcggaagcattacggaagcacctcggcttggattttcttcacggaaaccacttttttcacccaaaaaacctcccttcgcctatttataagaaaaagggggagaaggttgctgcccagctcacccagaactttacagattgcgcaacaatgcttctttttggcttctggaatgtcgcggaactttgcagattacctaacgatgaatgttaagtacctcgaggcggtcaagcgaaggttgcatgccaccaaacaatggtcctcggacgaaattagg

SEQ ID NO: 53639 - DNA, 517 bp, Glycine max
  Peptide Sequence Number=SeqID_145324
gtacattgagcaactgactgaaatgcctcaaaatgttctttacgatgccattgggatatatcaacggtggtatattccattggaacctcttacgtgccgatcaacgtctcattttcgccaaaaagttggcccagggcttcccggtatcaacaggggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagccccacaaattcgcggggctccaaactcgttggtggaggatgcatga

SEQ ID NO: 53640 - DNA, 538 bp, Glycine max
  Peptide Sequence Number=SeqID_145325
atggcctctggtaatcgattaccaaaggtgggtaatctattacaaggcttaaaagtgaagacaggaagctacggtgacctctggcttagaaatgggattggaatgttgaaggggcctctggtaatcgattaccaatgttgtgtaatcgattacacagaggaacaagccactgagggagcttgggagaccctcgaaggcaatgcgaggtgccgatttcggggcatgattcgattcacggctacttcattggtgcatccagatgaacccgcgcgcacgcttcagcgcactgtggagtggatactacccacgcctacaccataccgtctagtggagccagtccaagtgatcgaggtgacgtcatccgaggaagaccctgaggaggattctaaggagctacctcctgagcctgttatggatgctcttgactttctagtggatgatgaggacccactccctgaggtggattctcccgaggacgtcatgtcggcatctgaggcagactctatggaggatagtggccctggagagatggcgatca

SEQ ID NO: 53641 - DNA, 402 bp, Glycine max
  Peptide Sequence Number=SeqID_145326
atggtttctatcagctgttcctcctgttcagtactgacggggaattggttatccgcgtcacaattcggcacacaagcataccgaccggaacatcagcgggcaagtgtaaagcctggggtgccagacgctgcagctaactcaccattcaattcccgccttgcgctcaactgcgccgctttccagtcggaaacgctgtcgccattcgctgcattcaggatgatcgccaactgttgcgcgaagggcgatcgagtgcgggcctttgcgtattacgccagcggcgctaaagggcggaatacgactcactataggcgcgaattcgctctgagctcctaccgctcggtcgtcatgcggcagcgctcagaacagtggcttacaacggggcaggaattcgatagtggttaa

SEQ ID NO: 53642 - DNA, 216 bp, Glycine max
  Peptide Sequence Number=SeqID_145327
gggcaggatcaccttgggctaccttctggagtggagacaaaacatgaacggcagaaaccaatcaaggtacttaaggatgaacgcaagcggggatggggtcacgaccgaccgatcgttgcccttctctgtgcgaaacaagcagggaatgtcgctgcaaggcagccccgtatcctttgtattttgcagctttcttctattactagttggttgtattaa

SEQ ID NO: 53643 - DNA, 165 bp, Glycine max
  Peptide Sequence Number=SeqID_145328
atggtttttcacttaaggcttgtaatgagcttcaaaacaaagaaaggagaacataggctcaaaggggctatcaaacgaattaattcaagcaagaagtatcaacaagagtcaagccaaggctattgtccaagcaatcaatggggcaaaacacatcgaataaaatag

SEQ ID NO: 53644 - DNA, 267 bp, Glycine max
  Peptide Sequence Number=SeqID_145329
atggccacacctctgaggtctcctccacagtctgatggtcaatcagaggccactttgaagaggagtagaacaatgacacagcttagaaccttgacattaagaatcgtggatcagcccagaccggcagtttatgttgatcccgctatcgggagagcatcgagaccgatgcgtgaaaagttccatagctatctaggggtagtcgcacgagaaaaggttcccattatccataaaaattggaaagatgtacctgaaacgcttaaggagata

SEQ ID NO: 53645 - DNA, 399 bp, Glycine max
  Peptide Sequence Number=SeqID_145330
atgaaaaatgatggaacatacgaatttggggatcccacagttatgtggctccgcatgccatcggactcttgggtcacgcattttgtttctaatgaccatttagaggaagcactggggttcaacaaatatagaagaaaatcactcaaagtgtatcaatcagcacagtgtgaggtgaacaagtcaccgacgcataagattttggttggcaatcaaagggagagggccactttaggtcgtgggcaaggattgacattctcacccagggtcaaggtttatgataagttgggattttggctcaaggcttgtagaacggctggtcatgatatatgtcagtgtttggacagcggttcagggataaaggggatgccccacattatttccatgacacacatgcaatga

SEQ ID NO: 53646 - DNA, 396 bp, Glycine max
  Peptide Sequence Number=SeqID_145331
atgttgctaagtagcaatgtcatctatatccgtgtaagagtggtcatgttggtgcgcatgatccgcactcgtctctttgtagcggcacgggtgaaatcttgccccggtatgcatagtagctgtgtgatagcctccctctctgattgtgctcgcacagttggccctcctccaatatcagggggtggcccaggaaccgttcaaaggaaactactggtgtggatgtggagcacactgaaaatgaggacacgtagccctctaaaggtgagggcgtgcagccctctaaaggcgaggatgtgtagtcctctggaggtgagggcgtgcagccctctattggcgaggacgtgtagtcctcttcaaggtgagggcatgcagccctctgttggtgaggacgtgtag

SEQ ID NO: 53647 - DNA, 494 bp, Glycine max
  Peptide Sequence Number=SeqID_145332
atggtgaaagttggaacctcttacgtgccgatcaactgtctcatatttccaaaagttggcccagggcttcccggtatcaacagggaacaccaggtatttacctttattcccctgacgaagcttgatcgataccgtcacctcagtggcgtatcatggtttctatcagctgttcctcctgttcagctactgacggggtggtccgcgtcacaattccacacaacataccgagccggaacatcagcgctggcaagtgtagccgggggcgcgctttccagttcgggaaacctgtcggctgcgcaactgcttaatgaatcggccaacgcgcgggcgatcgagtgcgggctttgcgtattcccagcggcgctaaagggcggatgtgtcatactggcgattactagttggcactgccgcgaattcctcgctcatgagctcgctacgctcggtcgtcatgcggcgagcgctgaaatggccttacaacggggcggaattcggaa

SEQ ID NO: 53648 - DNA, 432 bp, Glycine max
  Peptide Sequence Number=SeqID_145333
atgcaagatgatgcgggtcatgtctgttcccctatccttgaaggggagcctcctcgacagcccgacgaggtccacgaagatcatcaagagtatgcccaaggggatgccgagttctaccccccgatccccgtcgaggggccgacacccaacactttgccccaacccaacctcacagcacaaccaatattcttgtccacagaaggaccacccccggcgactgaggaaagaaggaaactcgatctcctcgaggagagattgagagctgttgaaggcttcggtgactatccgttcgcggacatgatgaatctttgcttggtaccagatgtcgtcatccccccaaaattcaagtgcccgatttcgaccagtataaagggacgacttgtcctaaaaccatctcaagatgtattgtcgcaagatgggggcgcactctag

SEQ ID NO: 53649 - DNA, 213 bp, Glycine max
  Peptide Sequence Number=SeqID_145334
atggggtataaaaagcgaatgaaaacgagaataaaaatacatgaaacaaaatgtggaccaccacgggggaggagcttgccacccagctcgcccaggcgagctcagctagcccaggcgagcaaggttgcttcctccagaagcaacagccttctggaggaaggatctggaaggcccaagtgggccagattgctatttgtaccccttttttactaa

SEQ ID NO: 53650 - DNA, 807 bp, Glycine max
  Peptide Sequence Number=SeqID_145335
atgggtgaccaagaggaagtacaggaacagatgaaagccgacatgtcggctttgaaagagaaaatggcttccatgatggatgccaagctaggaatgagacaactaatggagaataacgcggccaccgccgccgctgttagttcggctgccaaagtagacccaactctcccagctaccgtgcaccaccttatcccaaacgtggtaggacgagaaagaagcacactggggaacatcaacaacccccattcgggatacaaccgagtggcttacccctatggattaccacctaattacacaccaccagtcatacgtgatgacgcgggtcatgtccctccccccgtccttgaaggggagcctcctcgacagtcaggcgaggtccatgaggatcgtctagagcatgcccaaggagacattgattcctactccccgttccccattgacgggccgacacctaacgcactacctcagtccaacctcacgggagaacctcgaaaccccccaacacaaccaatatttttatctacaagagggccacccccggcagcagaagaaaagaggaaactcgatctcatcgaagagagattgagggctgttgaaagctttggcaactatccgttcgcagacatgactgatctttgcttagtaccagacgtcgtcatccccccgaaattcaatgatgtaagctccattggagcttgtaggcctaggatcttcttcatcaatggattcctttgctccttggaagataaatggcagcggaatggagaaggaagagagagaggagatgccacttcatggagaagatga

SEQ ID NO: 53651 - DNA, 597 bp, Glycine max
  Peptide Sequence Number=SeqID_145336
atggggacaaatcaaaacggaaaaagattctatcaagtcaagattaagggcctaaatgtcaccagccttaaggagttgggatggttgatgggacccctccaaaggcaagccttccgcaaagtgtacggaaagattttagatttgaccacagcggaggtatttacggaagccattgtatccctcgcccaatactatgaccagtcgttgagatgcttcacgtttggggacttccaaatagtactgactgttgaagaatttgaggagagtttaggatgccctcttgggagaagaaaaccgtatcttttctccgggtttcttccctccttgagcaagattgcagctgtggtcggagattcggcgagagagttggattgtatgaagcaaactcgaaacggcatagtgggcctaccgcagaaatacctggaaggcaaggcaagggatatggcgaatcaagaggagtgggtcccgtttgtggatatactagctttgctaatctttggggttgtcctctttccaaacatggatggtttggtggacctagccgcaattgatgctttccttgcatatatcaccatagcaaggagagcccagtggtag

SEQ ID NO: 53652 - DNA, 282 bp, Glycine max
  Peptide Sequence Number=SeqID_145337
atgtcaggatttacacacgattctcctcaaatttcagccagcccgcatcaattagaccttgcaccttacgcttcaggcccttacaacgctcaatggaatgccccagggcttctccatgacaagcacacgttgcgttcgagtcgtattctcggagaaatggagacagactttgtggttgatttagggatggcctttgtggataactgggtggcgggtaaggaaaaggaatggcagtcacaacatgggcttctccctcattttcaccctcttcatttgccctag

SEQ ID NO: 53653 - DNA, 132 bp, Glycine max
  Peptide Sequence Number=SeqID_145338
atggcttgcacccacattccagtgaaagttgaatatgcaaagatgcgtttccagcccgcatcaattagaccttgcaccttacgcttcagagccctacaatgctcaatggaatgccccggggcttctccgtga

SEQ ID NO: 53654 - DNA, 432 bp, Glycine max
  Peptide Sequence Number=SeqID_145339
gaagaacacggtcgaaacaatttccgaggagttttatggggcagcaacaacgagcttaaaatccgaagagatgaaagggatcagtcgggagttgaaggcatgatcttgaaggatgagttgaaggcttgtcttaggtccaagagaaatttgtcccagcagttaagcgagacagaaggaaacatgttggccatcattggtaagtacagagaagagctaaacctagcggtagctcaggagaataggctagtggatgattacgccaaggtattggcagaaaaggaagcaaggggaaaggtgatcgattcattgcacggagaggcaatgatgtggatggataggttcgacttcacgagcctatgctcaaagcaatggcagaagtctacacagcccctgatgaaattcacgagctcctcaactattgtcaacacatga

SEQ ID NO: 53655 - DNA, 309 bp, Glycine max
  Peptide Sequence Number=SeqID_145340
atggaagagagagaacggaagatcttcagaccagataaattttcggcaggattgccattcaaggtcgttctcgactggcgatatcccaccccacctgaacaaagaggaaaagaccgaaacacccaacttcctctccaaaaaacactaccctcgagaaaatcctattggtccgtgatcgtaaaaaaacccggtggaccgttcggtcctgccaacaaaccactttttccggagccccatgaatgtcattgcctagcgctgttcatgtgtcctccaccttcgagtttggagctatgcttcatgattgcctaa

SEQ ID NO: 53656 - DNA, 636 bp, Glycine max
  Peptide Sequence Number=SeqID_145341
atgaaaagagaaaaacatgcctcctatagtagtcataactcttgcaagagcctaagtgaagaacttcatgactattatgaaggaaggcataggtcacatcttagacctcactatcataggagagaaaatgaaagaaagcctcaagaggctaacattaacctcccatacttccatgggaaggacaatgtagaggcttacttagattgggaaataagtgtagagcaaaaacttgaaagaaagtctactttaaaatcttatggctctcattcttatacaaaaggacacattacttctcaatgccccaccaagaaatccatgattatgaggagtcaagacatttatagtagccaagatgaggctactacttcaccttcctctaatgaaaatgaagaagcaaaaggggaagaatctagtgaagaaatctacccccaagaagaaggacaacctttaatggttaaggaggagtgtaaggaggtaagtgtctcttccaagaggttagctaagaaggaaagacatttcgaaataaagacaaatattacagaaatttcccctcttagacaacatccacattttctcctttgtaaaaagacacttgttagcattgccaaacctcttgggcttgaatttattccttaa

SEQ ID NO: 53657 - DNA, 1119 bp, Glycine max
  Peptide Sequence Number=SeqID_145342
atgccccagctcatttttctgctgctgatcatcgccgccgcctggtacggctaccgctcgttcaagcgcgaagcctcgcgcgtatcccagcgtgtgcgtcaggcggaaaaggaagcgcagaaccgggctcatggcacgttgcgatgcgatcgccgtgttttctcgtgtcacggtccaccagcagaaatgaccctttttccgaaaaccgaaacacatgcccatgccggttccgcgcctgcggtgacgcgtctggctcccgccaagatcaacctcgcgctgcatgtgacggggcgtcgtgctgacggttatcatttgctcgacatgctggtggtctttgcccgctttggcgacatcatccgtatcgaacctgcggaagtggacagttttacggtctgcggtccttttgcaacgggcataccgctcgacggcggcaatctggttctcaaggcgcgcgaggcgctgcgccagcagacacagcgggctttaccgcccgtagccatccatctggaaaaaaacctgccgattgcttccggcatcggcggcggatcgagtgacgcagccgccaccctgctcgcacttgatgagctatggggcctcgatctcggtttcgagaaactggccgcgatcggcctcgatcttggcgcggacctgcccatgtgcctgcatggcgcatcgaaggggacgccacttgccgcgcgcggcatcggcgaagacctgactccggttgccggtttcccggccttgcccatgctgctcgtcaatgacggaacagccgttgcgaccccggatgtctttcgcgcgctcgaaaagcgcgaccatccgacgctggcacttgcctcccacccggatatcggacctctttgcgcttatctgcagacgacccgcaacgatctcctttcccctgcattgaaactcgcaccacggatcggtgacaagctcgaacttcttcgccagagcggatcgctttacgcacagatgtccggttccggtgcgacgtgctacgccatctacgaagacattgccgccaccgaacgggtagccgaacacctctcaaccgaaagaccggactggttcgtcgtcgcgacccaaagcgtcccctctcccaagaataatttctga

SEQ ID NO: 53658 - DNA, 536 bp, Glycine max
  Peptide Sequence Number=SeqID_145343
ttggaagccctggcttgtgccgatcaacgtccattttcgccaaaagttgtcgcccagggctcgatcccgtcattcaacaacaccaggatcttttatagagtaatatcgaagcttgatcgatccgtcacctcgaggttttgggaaggcccggtgagccagctttatgattccctgtgtagtgatggtgttaatttcgagctcagtggcgtatcatggtttctatcagctgtccttcctgttcaacgtgagctaactcaccatcacccttgccttgcgctacatgcgccgctccatcgggaaacgctgtctgccattgctgcattcaggatgaatcgccaacggcgcgaagggcatcgagtgcgggctttgcgtattccagctggcgctaaagggcggagtgtgcatactggcgattactatgttggcactgatgccagggtcgaaggcttagaactagtgggcggagatttcccccggaagctgcaggaacgatactacagtggaagtgagaggcccggatttttccagttagcgcg

SEQ ID NO: 53659 - DNA, 480 bp, Glycine max
  misc_feature (468)..(468): n is a, c, g, or t
  Peptide Sequence Number=SeqID_145344
atggtggaagaattcgaagaaatcctaggatgtcctctagggggaaggaaaccatacctcttctcagggttctacccctcattggccaggatttctaaaaaaggtccaaatctcggcgcaggaattagaccgccaaaggcaagtcgaaaatggggtggtcggaataccgagaaaatatttggagcgatcgacgtttttctcacctatcataaccacaaggaaagtccggttgtcgctatgctagccgacctatatgacaccttcgaccgaagatgtgaagaaagcaatgcaaggattgtttgctgtactccaagaaggggttgtattaattataatctcgttctcgccataagacagcttggctaccccatgagaggagcgccattagacgaaagcatcacgcctttcatcacacggggttttagtgaccacaacgcgagggtactccaaggagttcgcaaggcgtgngatgcggcgtga

SEQ ID NO: 53660 - DNA, 825 bp, Glycine max
  Peptide Sequence Number=SeqID_145345
ccggaagaagatgaagaaggccaagctctcaaaaacgagttaggaaaggtgaaacttgccaaggagaagttcaagttagccgctacacacatccggaaggagtgtgccgaattacgggaagagaatgcaactaccgcaagagcccttgaacaagagaccaagagggctcgcaaggaagagtatggccgtaacaaatttcacggagctctgtggggtagcaacaatgaactcaagctgcgaagggaagagagggaccagtcgcgagcacaaagcatggtcttgaaagaggagttagttgcctgttcaaggttcaaaaggagcttgtctcagcgtttatgcgagacagagaccaacatgctagctatcatcgccaagtaccaagaagagttaagtctagccacggcccacgagcatagggtcgcgaacgagtatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcaatggcggacacctactccgcccccgaagaaattcatgggcttctcggctattggaaaaacaccataagtaaacgcgccacaaggcatccctatcgcaccagatccaaatctagaacgatgggtgatcaagaggagacacaggaacagatgaaagccgacatgtcggctttgaaagaacagatggcttccatgatggaggccatgttaggaatgaggcagctcatggagaaaaacgtggccaccgctaccgct

SEQ ID NO: 53661 - DNA, 558 bp, Glycine max
  Peptide Sequence Number=SeqID_145346
atggtgaaagttggaacctcttacgtgccgatcaacgtctcattttcgccaaaagttggcccagggcttcccggtatcaacagggacaccaggatttatttattctggaagtgtcttccgtcacaggtatcagcttattcggcgcaaactgtccctcctgttcagctactgacggggtggtgcgtaacggcaaaagcaccgccggacatcagcgctggcaagtgtagcggtcacgctgcgcggcgcgtcccattcgccattcaaggctgcgcaactgttgggaagggcgatcggtgcgggcctttcgctattgacgccagctggcgaaaggggatgtgctgcaaggcgattaagttgggtaacgccagggttttcccagtcacgacgttggcgaattggagctccaccgcggtggcggccgctctagaactagtggatacaggatatattcccccgggctgcaggaattcgtcttgcggtcgttcgactgcggcgttagcggataatggcttacgaacggggcggagatttcctggaagatgccaggaagatacttaa

SEQ ID NO: 53662 - DNA, 272 bp, Glycine max
  Peptide Sequence Number=SeqID_145347
atggaacatttactcagacactgtgaaaaggttgccgttggcccctatagccgcgatgcccgtgcgctggcgcatgaagtgatcgataccatttcggcgggcgttccgccggagcagctgattctcccctggatgtcggttaaagaggggctgcccgacgccaatagcgggcgctacgtgtgcgcttatacacccgcgaaatctcaggaccgccgctatcagctggtctccgctgccatgttccgcaccgtttgtcgggacgccacccactg

SEQ ID NO: 53663 - DNA, 225 bp, Glycine max
  Peptide Sequence Number=SeqID_145348
gtcttccggaagttacgaaggccaattccggaagaagtgcttccggaaactatttccggagaccttcttccggaattgggcttcttaacttccggaagacgtcttccggaagtgacaatggaattcttccggaagaagcttcttccggaaacattccggatgacgttcttccggaaattgtctgtgagtatttccggaagacacaaattattcttccggaagaag

SEQ ID NO: 53664 - DNA, 339 bp, Glycine max
  Peptide Sequence Number=SeqID_145349
atgcaaagaagatctactataggtgatttgatccccatcaatgtggagattaacgttacttgcaggaggcgcaacgcagagagaattacaaattttttgcaggacttagaagcagcaacaactccagaagaagaacctcgatcttccgtggcgccttctagctttcctattccacgacaatgtcatacatatttgattgaaaaagttatcatggttgaagagccaagaagagtaaccctggaagattactcaagttcctctgtgccgcaattcttttccagtatagcacgaccagaggttcaggcacaaacaatcacatatcctccttctttgatatag

SEQ ID NO: 53665 - DNA, 834 bp, Glycine max
  Peptide Sequence Number=SeqID_145350
atggagagaagtatgatagatgctgccagtggtggagcccttggagacatgattcctgctgaagctagaaatttaattgagaagatggcttataactcccagcagttgagcgccagaaatgatgctatagtcattagaggagtgcatgaggtgtctacaaactcatctgcatcatctgaaactaagaagcttgaaggaaaactagatgcattggtcaacttggtaacccaactgaccttgaatcagaaatctgtacctgtcgcaagagtctgtggtttatgctcctctgctgaccaccatacagacctttgcccttccatgaagcaacctggagcaattgagcagcctgaagcttatgctgcaaacatttacaatagacattctcaacctcaatacaaccctggatggaggaatcaccctaatctcagatggtctagccctcaacaacaacaacaacagcctgctccttccttccaaaatgatgttggcccatgcagaccatacattcctccaccaatccaacaacatcaacagccccagaaacatcaaacagttgaggctcctccgcaaccttccctcgaagaacttcagtgtcaaggacctcaacccgtagcaccttccgcatctgcaaataaacctgcccaacttcactctactccagaaaaaggtgatgacaaaaatttacctaacaatttatgtgcaggtgaatcttccactggtaattctgatttgcagaagcagcacatccctcttccattccctccaagagcagtttccaacaaaaaaatggaagaggcagagaaagagatcttggaaacatttagaaaagtacag

SEQ ID NO: 53666 - DNA, 570 bp, Glycine max
  Peptide Sequence Number=SeqID_145351
atggtgaaagttggaacctcttacgtgccgatcaacgtctcatttcgccaaaagttggcccagggcttccctgtgttgatcaacagggacaccaattattatccttgtcgaagcatgttttgtaacacagtggcgtatcatggtttctatcagctgtcttcctgttcagctactgacggggatggtgtatccgctcacaattcggcacacaagcataccgaccggacatcagcgctggcaagtgtagccgggggcgcgctttcccattcggacctgtcaggctgcgcaactgcttatgaatcggccaacgcgcgggcgatcgagtgcgggctttcgctattcgccagggcgctaaagggcggatgtgctcatactggcgattactatgttgggtacactgatgccaggactactataggtccgcgaattcctcgctccgagctcgctacgctcggtcgtcatgcggcgagcggaaatggcttagaacaggggcggaattcccccggaagactgcaggaattcgatcgatcaaccatgggaatgaagggccgcggcaaactttttccatag

SEQ ID NO: 53667 - DNA, 336 bp, Glycine max
  Peptide Sequence Number=SeqID_145352
atggtccatgacatctccgtcaaggtgaaactggaagtaatagggacattgacagccctaaatgtgtttggcagtagacgaagcaatgatgtaacacgatccatcttttgccccaatttttgcaagatggttacttccatgcttcaacttgactcgatgaaccttttcgtaaaagcacgagcttggttgaaccccataacccagggaatggcaattttgatcgccaatacttcatcaacaattcatatggatgaaagactcgggaatatggatgctatgcatggaaaatgtaattacgagatcgagatgcccgaagaaacatcctttcttaattaa

SEQ ID NO: 53668 - DNA, 155 bp, Glycine max
  Peptide Sequence Number=SeqID_145353
atgacagaaattgtctgcgcggaagattatgtaaatctccgcgtgtcaacaggcttgttggccgcgattgacaaaggtatgacagaaattgtctgcgcggaagatgacgtaaatctccgcgtgtcaacgggcttgttggccgcgattgacaaagg

SEQ ID NO: 53669 - DNA, 117 bp, Glycine max
  Peptide Sequence Number=SeqID_145354
atggcttcggagcggacatggatgccttatgtcttgctggaacaggtgcgaaaccaaccatacataaagagcgggcaagaaacagatgatccgtgcgctactcttctcgcaccttcg

SEQ ID NO: 53670 - DNA, 153 bp, Glycine max
  Peptide Sequence Number=SeqID_145355
atgcaaagggggatgttccaacagaaggcggtgccttctggtggaagcaacccagcttgcctgggcgagcttggcggaatccacctccctcttttcccctataaatacgggaaggagggcagaacaaattcgttcaaccctcctgatatctaa

SEQ ID NO: 53671 - DNA, 540 bp, Glycine max
  Peptide Sequence Number=SeqID_145356
atgaaaaaaactctcttcatctgcgtggtgttcgtcatgattattgcttcagctgcgagtttaccgtttgttctgaatgccggttttggccagccaccgcagggtgcgcagctcacggaagtggaagcgtctccgcactactacgaggggaaattccacaatacgctcccgacgcctggctttaccggccaacaaaatatgctggtggcgtggtggcaatttctgacccgtaaaaccgaaaacgcccgcccggctcagccgctaccgctggtgaaaaccgatctggcgagcctgccgctggagcaggacacgctggtgtggctcggccactcctcctggtatctgcagctggcgggaaaacgcatcctgatcgacccggtccttggtaactatgccgcgccgttttcgtttctcaataaagcctttgcgggggagtatccgtggcgcgcggcgagcatgccggagatcgatctgctgattatctctcacgatcactacgaccacctggattacgccaccatcagggcgttattgccgaag

SEQ ID NO: 53672 - DNA, 144 bp, Glycine max
  Peptide Sequence Number=SeqID_145357
atggctcttaggtttgatgctttggagttacaagtggacatgcaattcgatgagatggattcaaggatcaccaaggttgaacgagatgtgtcttacatccacacatgctttgatctaccactaccactaccaccatcaacttag

SEQ ID NO: 53673 - DNA, 390 bp, Glycine max
  Peptide Sequence Number=SeqID_145358
atgaaccgccaacaacgattgatgaccttcgccaacccggcggatctgccgggctatcaggacgtctccaaagccaacctgcaggcgcgcaaaccgcgcgatctcaagctgtgcgactccttgcaggaagcggtgcgccgcagcgggctgcaggacggcatgaccatctccttccccatgcgtttcgcggcgggatctggcgctcaatcaggtgatggagacgctggcggcgatggggttccgcaacctgacgctggcgtccagctcgctgaccgactgccatggccgctggttgagcatatccgccacggcgtggtgagccgcatttacacctccgggctgcgcggcccgctggcggacgcggtttcgcgcggcctgctggcggagccg

SEQ ID NO: 53674 - DNA, 849 bp, Glycine max
  Peptide Sequence Number=SeqID_145359
atgaattccattggacccaaaaatgatacattggaagaatcatctgagtcttccaatatcaataggttgattgttccgctcctgtatcttccaaaaggaaaaaagatctctgagagctatttcctggatccgaaagagagtactcgggttctcccaataactaaaaagtatatcatgcctgaatctaactggggttcgcggtggtggaggaactggataggaaaaaagagcgattctagttgtaagatatctaatgaaaccattgctggaattgagatctcattcaaagagaaagatatcaaatatctggagttcctttttgtatattatatggatgatccgatccgtaaggaccatgattgggaattttttgatcgtctttctccgagaaagaggcgaaacataatcaacttgaattcgggacagctattcgaaatcttagtgaaagactggatttattatctcatgtttgcttttcgtgaaaaaataccaaaggaagtggagggttttttcaaacaacaagggactgggatcggttttttagcaaggtacggaatgtatcatcaaaatattcaatatgattccacgagatctagtttcattcaagtaacgggttctagccaattgaaaggatcttctgatcaatccaaggattatttcgattccattaggaatgaggattcgaaatatcacacattgatcaatcaaagagagattcaacaactaaaagaaagatcgattctttgttgggatccttcctttcttcaaacggaacgaacagagatagaatcagagcgattccctaaaatcctttctggatattcctcaatgtccagactattcatggac

SEQ ID NO: 53675 - DNA, 372 bp, Glycine max
  Peptide Sequence Number=SeqID_145360
gggggcggagcctatggaaaaacggctttgccgcggccctctcacttccctgttaagtatcttcctggcatcttccaggaaatctccgccccgttcccttttgttctgagcgcctgccacacgcggtggaagctccaacttcatgacaccctcatcagtgccaagtcgtatagtaagccagtattcactgccgtcgttttagcgcccaacgtacgtgctgggaaaccgccctccccggcgttggaccgattcaacttaatgcagccttgcagcacgatcccccaggtttcgccagactggcgtaatagcgaaggcagtgagcccgcaccgatcgcccattcccaatgtgcagttagcgtcagcctgcattag

SEQ ID NO: 53676 - DNA, 435 bp, Glycine max
  Peptide Sequence Number=SeqID_145361
atgtgggcatgggaacgctgcacgactttggctccaaagagaactcctcctataatggaaaacaaaccactcggacacaggtggctgcgacgtggaaaccaacatattggcaatgatgatctaatagttttccgtcgtaaattagatatgatgaaacgacatgagtttgtgtgggagccttacccaacaactgttatgtcgatgttgcctcccatttgtttggttggcagtgtggcgtggtgcgcagtggtgccactcatttgtttccatgttgtagagtggcaccaaccggatagggtgttgcgacaatttggaatgcaacaacctattccagagtctccttcgcaatcacagaatatccatgggctaacgctgaaaggcaaacaagatgaaaattggttccagctgttggcccctttatcagtcagtggataa

SEQ ID NO: 53677 - DNA, 717 bp, Glycine max
  Peptide Sequence Number=SeqID_145362
atggcacctctggttcatgcgctggccagcgatcctgatattgaagcgaaagtgtgtgtcactgcccaacaccgtgagatgctcgatcaggttttaacgctcttttctatcgtcccggattacgatcttaatattatgaaaccgggtcaagggctgacagagataacctgccgcatcctgcaagagctcaagccgatccaggagtcattcaagcccgacgtggtgatggttcacggtgacatcaccaccaccgtggcgacaagcctggcggcgttttaccagcgtattcccgtaggacatgttgaggcggggatgcgcaccggcaatctctacttgccgtggccggaagaagttaatcgcacgctcaccggacatcgggcgatgtaccactttgcacccacggaaaattcccgtcagaacctgctgcgtgaaaatatcgctgataacaaaatcttcgtgaccggtaatacggtcattgatgcgttaatttgggtacgtgatcgcgtgctggcgaaccgcgaactgcaggaagaccttggtgcccgttatcccttcctgcacaacggcaaaaaaaccatcctggttaccggccaccgccgcgaaagctttggcaggggctttgagcagatctgtcatgcgctggctgaaattgctgcgcagaacgaagatgtgcagatcgtttatccggtccatctcaaccctaacgtcagcgagccg

SEQ ID NO: 53678 - DNA, 495 bp, Glycine max
  Peptide Sequence Number=SeqID_145363
atggagacgcccgaaattgaaccacggaagatctcgagaaattcaaatggtcataacttttcacaaggaggcgcatcatatatcgagacgctcgaaattgaagtacggaagctctcgagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 53679 - DNA, 354 bp, Glycine max
  Peptide Sequence Number=SeqID_145364
atgtcacgaaaatttacggattacgcaagcatcccctctttgacttccagaatgttacgaaactttacggattgtgcaataatatttcctttcgactcccgacatgtcacaaaacttcacggattgactaacaatgggtgtcaagttcctcgaagcggtcatgcgaaggtcgcatcccaccaaccagatggtccccggacgaaattagggtatgacaaggtgcaatgtggggaagaagaccgagggacttcaaccattggactcccaagacaaggtctgcacaactcaagggaagaacatggaaatcatggtaaagacattcccctgaacatgcacggcgatgttgccgcatag

SEQ ID NO: 53680 - DNA, 411 bp, Glycine max
  Peptide Sequence Number=SeqID_145365
atgcaagcattatgccaactaaaatcaccggggagttcattagcaagggaagatggacagaatgttgggcatagcccgtacaagtggtctaggattgggagttctacgtgcatccaacattattgctggggcacccagcaaacagtgaagtggcgaaattgcccttcaaaaattcttcttccggaaaaagttttttcggaaaattttcggaaaaaggttttccggaaagtttccgaaaaaaaacttcttccggaagaagaatttatgacttccgaaagtaccagaaagtacttccggaagaacgtcatccggaagtttctggaagaaccttcttccgaaatttccattggtggtcccgtgaagtatttggagattcggtggtcccgtgttccgtatttgaagttttgttag

SEQ ID NO: 53681 - DNA, 855 bp, Glycine max
  Peptide Sequence Number=SeqID_145366
atgattcaaagggttagttcatcccttctcaagccagcgaagcgagaaggtgcattgggaatacgtgagtgcctggaatcacagggtcatcacagtacattgtcaccgatgacaaagaaggacctgattctgggatacatgggtgatgggtgcttgttcacccttagcaagggatgtgatagtctatccatatggaatttattcatttctcaagggatacaacctatccacgagagtttgtcctttgggcatgtcctaatgcacaatgatttcattaggtctttaaagctattatacttatcaaccctaactctgaaccaacaaacttgtctgcagccatggatacgtcgcaatcgttgtgggctctgttctcggcttggcgttgttgctgctgttgctgtgtctgaggtggcggtggagacaactagtgaagtcgccgaagtcggtggtggctgcgcgagttgccacgccggcggaggcggggacgttgtcgtcgaaggaggatataaccgggggtttggtggaggcggagaggaacaagctcatgatttgttgagggcttcgatggaggtgttggggaagggtagcgtggggacttcgtataaggcggtgctggaggaaggaaccaccgtggtggtgaagaggccgaaggatgttgtggtgacgaagaaagagtttgagatgcaaatgaaggttctggggaagattaagcacgagaatgtggttcttctcaaagccttttacttttccaaggacgagaaattgctcgtttatgattacatgtccgctgggagcttgtctgcgctactacacggtacgatgttgttgaaatccctaattcatttatctgtttga

SEQ ID NO: 53682 - DNA, 412 bp, Glycine max
  Peptide Sequence Number=SeqID_145367
accagagagggtgctacgacagttcggatacatccagaccatccctccgccgccggttactggtctgttgtcgtataaggacatagacgactggtggatgcatttcagggatcatgtagcactcacaggtgagatttgtgttgtcctcggccaggaaaacgatgagcccaaacagccagctgccccagatgtggatgcatacgttgagccacatgtctcggaggttccagtcgtagctgatctccccagacattcagtggttgtgaagcgatcgcagaaaggttggagcgtgtgctcaaccttaggatggtcgctgcaggaacagagttacatgagatcatggaagattgcttgcggatcgctaggggtgacgcctatggaagtcttagggcgcgacgtacacaacgcatag

SEQ ID NO: 53683 - DNA, 339 bp, Glycine max
  Peptide Sequence Number=SeqID_145368
atgaccgacaatggcagaactggttggaaggctgggtgcgcggaagaagaaaggacacacggaagagaaaggaagaaatttttgaaatgctgggtgcacgagaagactaaggcttgtggaagcaatgccttccaaggttattttgatgatgccaaagaatcaagagttaagcaaagtttcaagcaaagattcaagaatcaagtttcaagtttcatgattcaagaatcaagaataaccaagatcaagattcaagactcaagactcaagattcaagaatcaagagaagactcaatcaagataagtattaaaatgtttttcaaaatattgagtagcacatga

SEQ ID NO: 53684 - DNA, 759 bp, Glycine max
  Peptide Sequence Number=SeqID_145369
atggcaatgtctgagcttagcgagtatgacggcaatcacgcgcttagcgcgagatttgtgctaagcgcgcctttgggcttcctcgtgggccttctttgcactaagcgtgagttggtcgctaatcgagaagacacattgagcctatctttcagatctttcaatgatgcacctacatcatctccacctccgattgaggttagaccatctccatctcatgttgatgcacatggaccgtccccggtacttacattcacaccatccccatccccggatgtagccagcatgcctattgatgaagacgttccaaatttggccatggaagaccccttcctcacctcaatgatcgtcctatggttacatttatcaatggagcaatttgaggctagactatctcaagctaggtctgatgttgcatcaagtgttggtgaatcacaacttactcctttagaccctgttgaagaacaaagacttaggactcaatgttgggttgcaacggttggaccaaagtcacgaaatcagatgacgccacttccagagatggaagataagttagagcgtaagggatgtctttatggtactggagatcttgctcattcttataaatgtggagatgacaacttcatgcagcgtacacaaggatcttccagtcacgctcaagattcagcggagattaaccgactaagggagaagcttcatcaatcaaaggaggagatgcatgtatttatttcagtcagtcgtccttcagttcctacctcctaa

SEQ ID NO: 53685 - DNA, 1030 bp, Glycine max
  Peptide Sequence Number=SeqID_145370
atggggagagatctggatgagcatggagctgctttcctgaaacatggtgaaacctctcagtcattgtctctttcggatatattcacactgaaggatggatctgtaactcctgttctgaagccggcaaatcctccggtgcgggctaatgtattgtatttgagcactgaattctctgtacctatcgcggaggctgtcaaaaatgtttttaatccttattttgataaagctgaagcatcttctgtggaagctgttgtcgcaacactctgccctttgaaaattgttttggatagggttgttttgacttcaacaggggtgctcctgggttgctggcaggttacctcgggaacagatcccataaccattcgtgctaagttgaagaatgcacttccacatgcaccggagaagcaactttatgatgctgcaattctccacacgtcatttgcaaggcttttgggtccacctaaagcattatcaccttcggaacagcttagaatgtcagatgatgtccaatttttccatgacctagttgatcgacttaacagtcagattcatggattcaaggcggtggtgtcggagctttggtacgtggaggaatatgatgtgctagcccttgcgctaaatggaagaatgaacactcgcaaattcagacttaggtcttgtcccagtaaaaaggaccaaaggaaactccccaggagagttcacaaggctgaaagagataaaatgaagcgtgagcatttgaatgaactttcttggtcttgccgatgcactagcatgtctaacgatcaagacacacctcccaccaaccttaatttggagagcccttattatcttcactcttctgataatcctggacaaactcttgtgagtgacgtccttacagggagttcaagtgctgttgggatcaacaatcaaggcaacgttctggaaaatctttctgttggcattgggactattgctgtgaattttgaaaaaatatctaacatgatggagaaaagagaaaaagatagagatagagatagagagctcgagg

SEQ ID NO: 53686 - DNA, 645 bp, Glycine max
  Peptide Sequence Number=SeqID_145371
atggaaccccaggatgaagaagagatccataactgtttgatcaagctgagaagtaatccggaaaggcgaagggataaggtctacattggttgtggagctgggtttggtggtgacaatcccttggctgctcttaagttgcttcaaagagttcaagaactaaattatctggttcttgaatgctttgccgagcgaactcttgctgatcattatcaaatcatgatgtctggtggtgatggttatgattctcagatggatcctctgggtgctcaacagaaggtcttagaaatagctaacagcctgggtctcaatgtttctgttgctgtggctcacgaggtgtttgtcactaatatagtaggttcaggattttcaccagcaaaatcatatatcatggagggtggtatcaacacctacttgggagctgctcctattgttccttgccttgaaaagtaccaaccaaatgtaataattacatcgagaattgcagatgctgctttattcttagcacctatggtttatgagctaggatggaactgggatgaattagagcatctagctcaaggatctttggctggccatcttctagaatgttgttgccaactcacagggggatatttcatgcatccagcatgttcccttaactcatga

SEQ ID NO: 53687 - DNA, 1134 bp, Glycine max
  Peptide Sequence Number=SeqID_145372
atggagggaggtagtgatgacttccactaccaccaccatctccataaccataaccaccaccgacaaaacttcccattccaactacttgagaagaaagaagatccccaagacccttcttcttgctccacctcctccccatacccttccttagccatctcagctgaaccctctacttccaacaacaacaaccaactcctccccacaccctcctccgaaccctcccccaaaaaaccaccccctaaaagaacctctaccaaagaccggcacacgaaggtcgatggccgcggccgtcgaattcgaatgccggctctctgtgccgccagggtgttccagctcacgcgtgagctgggacacaagtctgacggcgagacgatcgagtggcttctccagcaggcggagccatccgtcatcgccgccaccggaaccggcactatcccggccaacttcacctccctcaacatctccctccgcagctccggctcctccatgtctgtcccttcccagcttcgatccagctacttccacaactcaagcttctccctccaacctagaagaagcttattcctagaaaacaccaacaccaacactcccaacacaacaacaacaacactcctcaatttccaatccaacaacaacaacaaccccatcttccaaatccaacccaagcacgaattgcgcgaatcttcatcactagacctgtcctcagagaacaacaacaacaacgaagaggcactactttcggggacaattccggcgagccaccacgctcaaattccggcgaatatatggatgctagcgaattcaaatagccaccacaaccaaggtggtggtgtgagtgtgagtggtggtgaagctcctcctttgtggacattccctggtggtgtgagtaacagtgctttgtatagaggaaccatgtcaagtgggttgcatttcatgaactttccaaccccaatggcacttttgccaggtcaacaattagggtcttctgggattggtggtaacatgaacgaagggcatttgaacatgctttcggggctaaacccttatcggacgacggtgatcggagtttcggagtctcaggcgagtgagtcacaacagtcccatcatggtggaagcgaggatcaacatgaatga

SEQ ID NO: 53688 - DNA, 252 bp, Glycine max
  Peptide Sequence Number=SeqID_145373
atggaaaaacgcaacaaaaggctattgtcaaagctagcagctggtgtctcactaagcgaggcttgtgcgcttagcgagaatcatgcgctaagcgaggcacttagtccgcttagtgatttgagagaatctagaagagaatctgagaagcatctgtgcactcagcacatcattagctcgctcagtgagacatttgtctcttctggtgctaagcgcgcccagctcgctcagcggatattcactaactcgagctaa

SEQ ID NO: 53689 - DNA, 294 bp, Glycine max
  Peptide Sequence Number=SeqID_145374
atgaaggagaaagattggaatgatgacaaccttaccatgaccatcgtttctcagcactgttttggcgatgattctgaagcgccaagcttctccatctccatcatcgagaacatgaaggacgaatatggcctattcttgtggccctgcagcgtagttctcaccgagtatgtttggcagcacaatcatcgattttcagaagccagcgttgttgaggtgctagaacttccttgcctggcttggttgcagcaaaactcgatgcctgtgtcactcttaccgatgacttcaccagattag

SEQ ID NO: 53690 - DNA, 747 bp, Glycine max
  Peptide Sequence Number=SeqID_145375
atgagccagggtccgggcttatattttgatattggaaagaaggccagagatgttctccacaagggctatgctcaacaaccaccaatccactttaactacagattcttgaattggaatttagatctctcctgtcaagaagaacttgtgcatggactaaggggccttttcacatgtaacatacctgactcggggaagttggaaattcaacactttagtagattcagtgggtttagtgcaagcattggattatcgggagaagcagaaaaaggatataaccctgttgcaaacatctctggtcatataggaaccagaattctcaccctgggagctaatcttgcctgtgacttatcaggaagctcatcagctaggacaaccaacaatctgaatgctgggttgagcctgaacagtccctaccttgttgctgccgcaaccttgcatgacaattttcaaaccttgaaaggttcctgttattttgaagtgaaccccctgaccaagactgcgatcgcagcagaggtgaagtatgaccttgcagatgatgagactactggtgtcaccgttggtgctcagcatgcattattttcttggacattgctaaaggctcgacttaacaacaatggcaaggtaggtggtctaattcaacaaaagtttgggacaaaattttccataaccgtggcgggagagataaatttgaatgagaaagctaaagaaaagtttcccaaggttggagtctccatggctttaaaataa

SEQ ID NO: 53691 - DNA, 711 bp, Glycine max
  Peptide Sequence Number=SeqID_145376
atggccagtgaggcagcaggtattacaagacgggatggaacaagaacaacctcagcagcagcagcagcagcagcggtggttgaagagatcgtacctaattcgggatggacagacgaccattcgagccattttcttcttgtggatcttcctgaatttaggaaggaggaggtgacccttcaagttgatggctccgatggccgtataattgtgaaaggcgaaaggcaaacaaatgaacagaaacgtattcactttgagctggcctttccattgccaccagattcagatgtggataatatatccggaaactttgacagtgaaatccttcacgtgcatgtccccaagcgagcttcacatcaagaacacagagaaagtggtcatgagatagagagagcttcaaataatggcagtgttggaaggccacaagaaattgtaagtgaggaacacgaagttgttaatgaggggagggatcatggtcattatcaacacgaggaagatagagataagaaggaagaaagaagaaatgaaaatgcacagtacatggataatggttattctaaaaaattaacaaggaagttggagcaaaaacgcgacatgtcaagagctctagtggaggttttgatgagaaacaagggagttgttacaactgctgttgtggccttttcgtttgggttgtatgtatctaataagttccattcatggaatgaaccataa

SEQ ID NO: 53692 - DNA, 147 bp, Glycine max
  Peptide Sequence Number=SeqID_145377
atgatcttggaattcatggctagtacaggggaaggtgctggtggggcacttacatgtgcggcttgtggctgccacaggaacttccacagaagggaagtgaatactgaggtagtttgtgagtactctcctcctaattctggtcgctaa

SEQ ID NO: 53693 - DNA, 570 bp, Glycine max
  Peptide Sequence Number=SeqID_145378
atgggggagcacgtggttttatctgttcttgactctcttatagcacctgcaactttgcaaccacaacatgatggtgatggtgatgctttaggttcactcattgagggtgctactcatgttaatgatgttggggaatgtgatacacttgaagaagaagaagaagaagaagaagaccttatcaaaatggtggaatgtcgcatttgccaggaggatgatacccttcaaaatttggacataccctgtgcttgcagtggaactttgaaggagttttgtgttgattttcttgtggctgtgtatggagtagggccattcaaacctggttatactgcaaattcacctgtctgccatcctggagatacttcaattgatatcagtgatgactgggcaaccactaggaatcctttagatttgcacaatgctcgacttttggctattgcagctgtggactaccaagttccagagactgagcacgaagattatgtcaatgctggcactggtggaaccacattgtggcactctgttgtgtctgatgcagtgcttttaggtatgctgttaattcttgggaaataa

SEQ ID NO: 53694 - DNA, 1773 bp, Glycine max
  Peptide Sequence Number=SeqID_145379
atggcaagagacaaagtacaatcttcacttgtttgtgacctcaaactaaaactcataagtgataagcaatcagatggaagattatataacttgccaaatacgattgaagttgttgctttgattgttggtgaggagcatacaggtaataaaagagatattatcattgaaaggcaatcaggaagcctcaaaagaattaatgaactacatcctacatatttgcctttgcaatatcccctactgtacccaaaaggtgaagatgactatagaccaaatattcttcataaggctcgtccgaatagccatgtagcaaagaggaagaaagttaccatgcgtgaatatttttgtttcagaatgcaatctagggacaataaagctcaaacaattatgcattcaaggagattgtttcaacaatggatagttgatgggtacactatgattgagtctcaagcactcaactatgttagacaacatcaacaggaacttagagttgacaagtacatcaatttgaatgtctgtaataatggtcctgaaacacatggcaatgacaaaggaaagagaattatactaccgagctcctttgttggtagtcgtaggtatatggaacaactatattttgatggtatggcaatttgtggccatataggatttccagacatgttcttgacattaacatttgtttacactattgagtggcaaaaaagagggttgcctcatgctcatattttaatatttctacatccttcaaacaagtatccgaatccaaaagacattgataacatcatttttgctgagatcccaaataaggacacacatccagagttatatgaattagtcagcaagcatatgattcatggtctatgtggattgccaaacaagagagcaccatgtatgcttgatggaaagtgtattagatttttccctaagaagatccaacaagcaacaattgttgacaatgatggttttctagtttataggcgaagaaacaatggacatatggttgaaaagaatggtattgaacttgataatcaatttgttgtgtcatacagtccacatctcctacttaaatatagagcacacctaaatgtgaaatggtgcaaccagagtacatcaatcaaatatatgtttaagtacatcaacaaaggatccgatcggattacagccgcaattgtatgtatcaccaccagaggcatgctggaagatatttgcattctcaatgcatgcacgtgcaccagagtagaacgtctgtatttccaacttgaaaatcaacaagttgtttactggaaagatactgaacaaattggttcagtactatctaaaaaaacagtcaaagaatccatgtttacagcttggatggattctaaccaaagatatcctcagggtcgagatcttacttatgcccaatatttgtccatattcgtgtatgttgcacgccgaagatgctggcaaccaagaaaacaaggatatacaattggcaggctcatatggatacccacttcaactggagattttttctacctgagaatgatgttatcttctgctaaagggccccaatcttacaaagacattagaacagtagaaaatatggtgtatggtacattcagagaagcatgctttgcaaaaggttttctaggaaatgatcaagaatttattggtgctctacgagaagctaacacatggggatttgcacactttcttagaaagttatttgtcaagttgttatttatgaataccatggatagaccacaatatgtgtgggaacaaacatggcaatga

SEQ ID NO: 53695 - DNA, 429 bp, Glycine max
  Peptide Sequence Number=SeqID_145380
atgccgcaaaccaagcttcctcctcctccacctctctatgttctctgccgcaccgccaccgtcctcaacttccattgctaccatttaggccgtctccaccatcattgttccgtttccacagccgtcaagattatggttagaactatagatttgggttttgcttcagacagagttataggaagagccctgggtagagaagataatcgtgattcaggtgaagctctccagcgacgaagacccacaacatttgcacataggcaaaaggaagctgttgcggaggatgttcatcacgtagatgacacacagctgaggaggtcttccaatagcctcaagaagcagttgttgatgcccaaggaatgtcttgaattgaagctatcctctcatggaaggaaggctcagaaattcgacaagcctgctgcagagatttaa

SEQ ID NO: 53696 - DNA, 363 bp, Glycine max
  Peptide Sequence Number=SeqID_145381
atggagacttccttgattaaggctcaaattgaggagtctcaagaggccatcatgacaaggtttttgcatggtctcaatagggagatccaagacattgtagagttacaccattatgtgtctttggaggatctcattcatcaagctatcaaggatatcactaatgcatcttcttctagctcttctagtgaaagtggaagtgaatgtgatgtacaatccctggaaggtgatcttttgatgctagttgtagatagacaagttttgatatgcttcttcattggaaaatatgttgataagatactgtttaatgtagttcctatggaggttgatcatctcttacttggaagcccttggcagtatgattga

SEQ ID NO: 53697 - DNA, 1815 bp, Glycine max
  Peptide Sequence Number=SeqID_145382
atggagtttggttcagaaagatctggtcatgaagtcaaggatgagaagagaagtgaatctagtgttggagatgaagaagatcgtcgtgaacaagagattgttacgcaggagccacccctgtctactaccgaaagatccacagtggaggctgggccaaatgcttcttccctaaccaaaaaggaagaggctgttgatgaacttgaagttgccaaagccgaaatgggtgaagtgatggaagaaaaccaacgactaaagacgtgtttgaaccgaatactgaacgattaccgcgcactccaaatgcaattccacaacatagttgaacaagagacaaaagattcttctgatcagaaagtgaacaacaacaatgaccaatatcaaatagatgaatcaaacctagtttccctcagtcttggaagacttccaacaagaaacaataataaagtccctaataataaaccattgaaagaggaagcagaaaaagaagataaagaaggcttgtcccttggattagactgcaaatttgaaacatcaaaatctggaataagcacaactgaatatttgccaattcatcaaagccctaataatagtgttgaagaagtgccaaaggaagaagcagctggtgagagttggcaacctggcaagggaataaagacagctagagatgctacaggagaggatgaagtttctcaacaaaatccagcaaagaaagcaaggatgaacgatggatgtcaatggaggaaatatggacagaagatttcaaagggaaatccttgccctcgagcttactatcgttgcacggttgcaccatcatgcccagtaagaaagcaggtgcaaagatgtgcacaagacatgtccatattattcaccacctacgaaggcaaccacaaccaccctcttccactctcagccacagccatggcctccaccacttcagcagctgcatccatgctattatccggctcatcaacctcacactccggaacaaggccttccacagccatgaccaccgcagatcttcatggaatgaacttcttcctatcagacggttccaaattatcaaagcaatactacctgtcccatcctgcagcactctcatcttcaccttcacaccccaccatcactcttgacctaacttccaataataatccatcctcatcatcttctgctgctcttgttaaattcacttcaaactcaaactacaataacacacaaaggtaccctctttccacaagcttaaacttcagttcctcagaatccaacaatgcaacaacttcttggagcaataatgggttcctcagctacaacaacactctaccatataatagcaataggaatgtgacaaatgtccttagcaacataaaccttggaagacaacaacaacaaccaatggaaaacatctacaactcctacatgcaaaggaacaacaatgttccaatctctccaccacaacattctctgccagataccatagctgcagcgacaaaagtaatcactgcagaccccaattttcaatcagctttggcagcagcacttacaacaattattggttctggaagcactactcaaggaaaccatggtggtgcaggggaaaatctgagtcagaaaatgaaatggggtgaactgtttccttcatcttcttctgcattaccttcatcttcaacaaaagtcaatggttgtgcatcaagcttcttgaacaaatcagccgctaatacacaaccaggaacagctttgatgtttcttcagccacctttgcctctttctagccccaaaagcgcttctgggtctccaggagatcatatagacaagagaaattga

SEQ ID NO: 53698 - DNA, 1077 bp, Glycine max
  Peptide Sequence Number=SeqID_145383
atggttttttatgtgatgttcaaagtgtaccgggtttcatcttttctcttgtggcttctgcttcttgctcaagcacatggaaatgataagataggattttatcaactcaagagaggaaatttacatctgaatttgacaaattatggtgcatcagttatctccgtttttgtccctgataaacatgggaatttaggtgacattacgcttggctacgatgacattgagcaatacaagaatgattcatggtacttcggagccactattggacgtgtggcaaatagaattggacacgctcaattcacattggatggtcatacctataaattgcctgctaatgatcacggcaacaccctccacggtggtttcacagggttcagtgatgttgtatggacagtaaaaagtcacaaggaagatgaccacgtaacatttacctatgacagttatgaccatgaacaaggcttccctggaagacttgaagtaagtgtgacctacatggtcattggcacaaacaaatatagtgtgaaaatgattgccaagccaatagacaaagccacaccagtgaacctagcgcatcatacatactggaatctaaagggccacaacggtggtgacattctatcccacgaagttcaaatctttggctcaaagatcacaccagtggataagaaactcatccccaccggaaaattcgaatccgtgaagggcaccccatatgatttcctagaaccaagggaagtcggtagccgaatcaatgaccttcctggattatatgacatgaactacgtgcttgatgcaagtagccctaatcacttcagaaaagtgcttatagtgagagaaaaagtctctgggaggaagctagagttgtggtcaaaccaaattggtcttcagttctacaccggtggcatgttaaatgctacaaagggtaaggatggagccatttatcataagcatggtggtatggccttggagacacaagggttccctgatgctgtgaatcattcaaatttcccatcacagattgtgcgtcctggggagacatataagcactacatggtctacagattcacggctagctga

SEQ ID NO: 53699 - DNA, 906 bp, Glycine max
  Peptide Sequence Number=SeqID_145384
atgtggcaactgtgccgtggaattgatgaaaatgcaattagagcgtgtgcacagtttgtgtttgcagtaagaaagcttttttatttctctaaactgctgtacaagatggtttgtgaacctgatgaaactgatttgaacatgcacatacctgctgtcatgcttccactagatgcagtgtctgtgcaactacactcgccacttcgaccagctgttgacgtagcagaagtatttctttggatgatggcagttcttaccatattgtgtgcatcatattggtcagcttggacgacccgagaagcagctattgaacaggataagttgctaaaggatgcttcagatgaactcccaaacactaaatatgctagtgttagtggagttgtaaatatgaatgtgaaagctgcagtcctttttgttgtatttgcttcgtgtttcctgtttatgctttacaaactgatgtcgtcgtggttcattgatgttttggttgttctcttctgtattggtggtattgagggcttgcaaacatgcttggttgctcttttgtccagatggagcaatgctgttgatggtgcattttgtttccatatccctgggattttgtacttttcttttatatttctaagacgattttaccatacaaagccaaaggatcaggatgctttaatacctagtactcttgaaaatcatgtcacaaggtggttcaagcatgctggagagtcatacatcaaagtacctttcttaggagctatctcattggagtatatgccattcttgctttcttttttcttctttttaaacggtggcgtttggttgttgtatgttgttcttgttcgtgatgttatcctcggggtgccaaacggtactggatttttactgggagcgatgcaattagtgctatacgcgatctag

SEQ ID NO: 53700 - DNA, 121 bp, Glycine max
  Peptide Sequence Number=SeqID_145385
atggaggattgccttgaggcgctaggcaataacattcatggggctccgaaaagtggagaatggaggattgccttgagggtccgcactaaggcaatcatgatacatagctccaaactcgaag

SEQ ID NO: 53701 - DNA, 225 bp, Glycine max
  Peptide Sequence Number=SeqID_145386
atgaatcctgtgaagcgaatagaaaaccaagctgaggatgaagatgaagatttggggtttcccccggacctagaaaggatggtcgcatgggaagaccgagaaatgaagccacaccaagaagagacagaaatcgagaacttgggcgttggcgatgaaaagaaagatgtaaaggttggcatgggcatgaccacaccggtccaagatgagttggtagttttgctatga

SEQ ID NO: 53702 - DNA, 693 bp, Glycine max
  Peptide Sequence Number=SeqID_145387
atgggtgaagtaaagggggtgaaagagcagataaaggccaacatggaggccatgaaagagcaaatgaccacaatgatagaggccatgaaagagcaaatgaccacaatgatagaggccatgatgagcatgaagaagataatgaaagccaatgcggttgcagttgccgctaccagcgttgttgctaaggtgaacccgactccctcacctggcctcaaccaaatgaatcatccaacctcagatatggtaggcaaagatttgggaagtacgggcaacccccattatgtgcaaattcaaaacaagcatgccttcccgccatatggcttgcctcccaaatatacaccacccaatgtggcgtacactcccagggagatgcatgaaattccccaccacaatctagctgacttcaagccttgcctcggatatgccactgaagggcaagcagttggtggtatacccctgcaaaacactttggagaggcctcaattttgcccccaaccacaacccttatatggaaaaatggttggttacacaccttcaagctttgcagatttggtcttctccggcgaaaggatcaaagtgggtctggaaagaggcaaatctgatcatcctgctttgatgaatgcgaaaaatagggcaaatgaagagggtgagaatgaaggagaaacctatgctgcgacttccattcctacctag

SEQ ID NO: 53703 - DNA, 462 bp, Glycine max
  Peptide Sequence Number=SeqID_145388
atggagctaaaccaccaatgggatgagttcccgtccaaggtagttcccgatcttctaggcagaccggcctctatgatcaaaaactgcagaaggaggctgaaccaggttaccaaaaaggaccattttcccctgccattcattgaccgatgcttgaacgcctggcaggaaataccacattcacctgccccttcggactttatgcttataggaggatcctttcggcctgtgcaatgcctcctgggtattgagaaaccatctccttctaccactgtccagccgaccacaccagaattgaagcctctgccatcaaatttaaaatacgcttacttggatgatagcaagagttttccagtgattatatctgtctctcttgctgatgagcaagaggagaagttgttgtcagttctcaagaagcataagaaggcttataggctggaccttggcggacattcctggtattag

SEQ ID NO: 53704 - DNA, 207 bp, Glycine max
  Peptide Sequence Number=SeqID_145389
atggtagcggaatggagaaggaagagacataggagacgccacttcaaggagaagatgagtctagaagaagctcacaaccataggacaacttatggcaccaaattcttcaagatatggcaccaatcctcctttccaattccctatatggcaactcacaagcaaggaaacaaagagacatgcaataaccaaagaaaaaaaatgaaatga

SEQ ID NO: 53705 - DNA, 162 bp, Glycine max
  Peptide Sequence Number=SeqID_145390
atgggtgaataccaacaactatcattaagaaccattctcatccttagaccaaaaacaggcaaaaggtggaatacgcaaatgagaatagtagaatatttggttgctgtcggaaaagaggaagaagtcgagctacaagaaaatcccacctcctatttaacatag

SEQ ID NO: 53706 - DNA, 275 bp, Glycine max
  Peptide Sequence Number=SeqID_145391
atgggggttcaaatagcaaccaggcccacttgggccctccagaagattcctccagaaaggctgttgcttctggaggaagcaaccctgctcgcctgggcgagctgggcccttctctctctttcgaatttgcttggaaaaattgtttccgtgaagaaaatccaagccgaggcgcttccgaaacgtttctgtaacgtttccgtgaggaatttcgcgaaggttttgaccgttcttcgacgttcttcattcgttcttcaccgttcttcgatcttcaacgg

SEQ ID NO: 53707 - DNA, 255 bp, Glycine max
  Peptide Sequence Number=SeqID_145392
atgataaccgccgatgatgccattacggatgcccctaagttctttatccttcctcaatggacttctccacgccttgtggactctttgtacaacctagagattttgcgtgccgaaatctctcacaaggaaaggcgaaaggctctcttccgttggcgctcccctcatgagatgaatggcagcggaatggagaaggaagagagagaggagacgccacttcaaggagaagatgagtctagaagaagctcaccaccatag

SEQ ID NO: 53708 - DNA, 708 bp, Glycine max
  Peptide Sequence Number=SeqID_145393
gaaaacgcggccactgcaagagcccttgaacaagaaaccaaaagggcccgcaaggaagaacatggccgagagaaattccgaggagcattgtggggtagcaacaacgagctcaagctccgaagggaggaaagagaccggtcacgggtgcatggcatgatcttaaaagaagagttagccgcttgcgcaaggtccaagaagagtttggcccaacacttggaaaccatggagcaaagcatgctagctatcatagggcaatacaaggaagagttgaaccagtctgtgacccatgaacaaaagctagtggaggattttgcacaagtgtatgccgaaaaagaagcaagagggagggtgattgatgcgttgcatcaagaagcgactatgtggatggatagattcgccttgaccttgaatggaagtcaagacctcccgcgtctattagccaaagcaaaatccatggccgaagccgatctatcggctttaaaagatcaaatggcttccatatcggaggtcatgttaaaactccagaaaactatagaggataaagccacgacaaccgcctccagtaaagttagggaagcgaagccggtgctgcagcccgccttaatccgggccgagacagaaacacgacagtgtttggtcgaaggtatagccgaagcttatccttatggcttgcctccggacttcacatgccaccccggaaagatttaa

SEQ ID NO: 53709 - DNA, 456 bp, Glycine max
  Peptide Sequence Number=SeqID_145394
ggtgagaatatcaatccttgccctcagaagaaaacacaaaaagaaggaaaattcccaatcaaagaaacggagaaagcaaaaaagaaaggaaattcccaatcaaaagagcgggagaaaacaaaaagagaaaattcccaatcgaagagtgggagaaagcgaaaaaaaagggaaagaaaattctcgatcaaagatcggaagaaaacggaagaaatatacagaaaggtctttggaccagacaacatctggacaaatacagagttaccaccaagtaagcacaaaaagaaagggaaccacgacctgaagtggtcctctccctttgattgccaaccaaaatcctgtgcgtcggtgacttgttcgcctcgcgctaaacaaaaacagaaaaggaaaaggccaaaaacactcaaagccaaatttcccaccaagaaaaaccccattcccaagaagaagtcctattga

SEQ ID NO: 53710 - DNA, 150 bp, Glycine max
  Peptide Sequence Number=SeqID_145395
atggatgccttagaaatttactactatgaagtgaaaaggcaattagacataaatgtgaaaattattagatatgatagaggtggtccatttgctaagcttcttcagaaacgtggcatttgtgcacaatacacaatgtccgatacaccataa

SEQ ID NO: 53711 - DNA, 393 bp, Glycine max
  Peptide Sequence Number=SeqID_145396
atggaaacatgttcggcagtaagagatctattacaatggatgatagaccaaggccggcttaaggtcggcagtgagaggaaggaggaacaacatgtatacatgcagtcggcagatgaagaaggacctaaaaagcctaaacccttggtaatacacttcactaggaacacggctccccaaagacctcaacacccctcggtagtgtcgggcggtagatctattttgtttccttacgagaacagccgcacagttccgtggaggtatgcccctccgtgcggtaggaaggaagaagctaccgatatcaacttactatcagccaaagtgaccaatatcactgggctgagcggcataacccgcagcggtcgcgtgttcgcaccccctagcctaccgatatag

SEQ ID NO: 53712 - DNA, 452 bp, Glycine max
  Peptide Sequence Number=SeqID_145397
atggtggtgatgggctgggggcagtggctcacgcctgtaatcccagcactttgggaggctgaggctcatggatccaagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcgcgagcggaaatggcttacgaacggggcggagattcctggaagatgccaggaagatacttaacaggaa

SEQ ID NO: 53713 - DNA, 789 bp, Glycine max
  Peptide Sequence Number=SeqID_145398
atgccagtaattactcttcctgatggcagccagcgcgtatttgaccgtccggtcagcgtgatggacattgcgctggatatcggtccgggtctggcgaaagcctgcattgccggtcgcgtcaatggcgaactggtcgatgcggttgatccgatcaccagcgatgcgcaggtcgcaatcatcaccgcgaaagatgaagccggtctggaaattattcgtcactcctgtgcgcacctgttagggcatgcgatcaaacagctgtggccgaataccaaaatggccatcggtccggttatcgataacggcttctattatgatgtcgatctcgaccatacgctgacccaggaagatcttgagctgctggaaaagcgcatgcaccagctggctgagaccaattacgacgtcgtgaagaagaaggtgagctggcaggaagcgcgtgacgtgtttgccgcgcggggcgaaagctacaaaaccactattctcgacgaaaacatcagccatgacgatcgtcctggcctgtatcaccatgaagaatacatcgacatgtgccgcggtccgcacgtgccgaatatgcgtttctgccatcattttaaactgcagaaaatctccggagcctactggcgcggcaacagcgacaacaaaatgctgcagcgtatttacggtacggcctgggcagataagaaacagctggcggcgtatctgcagcgtctggaagaggccgcgaagcgcgatcaccgtaaaatcggtaagcagctcgatctctaccacatgcaggaagaagcaccgggtatg

SEQ ID NO: 53714 - DNA, 432 bp, Glycine max
  Peptide Sequence Number=SeqID_145399
atgaccataaggtatctccgtctaccacctgactcgttgtccctagatgacaaaaggtgcagaagacggtgtcagtttcttcgtgtcaacgggctcgtttgcccctggttgacgaaaggtgcggtgaaaaaaagaggtgcagatgaccataatttgtctttgcgtgtcaacgggcttgcttgcctctggttgacaaaaggtgcgggaccatatggttcccccgcatgtcatcggactcgccgtctctggatgacaaaggtgcagatgacaacgttagtctctgcgtgtcaacgggctcgcttgcctctggttgacaaaaggtgcgggaccttatggttcccccgcatgtcatcggactcgccgtctctggatgacaatgtgcgggaccttatggttcccccgcatgtcatcggactcgccgtctctggatga

SEQ ID NO: 53715 - DNA, 654 bp, Glycine max
  Peptide Sequence Number=SeqID_145400
atggcgctggcacagtttattctctgtcttcagcacgttaactttgatttgcataatagatttgcggaagtggaacgtttctacgacgcgttactgactgaactgcaaagcggaaaatcgctgatggattccggtaatctggcccgttcaaacgcgatgaaatatcttgcgctgtcggtaatgggaaccaacgtggcgaaagattcggcccgggacggttttattctggaagggcatcagcacattgccgcgtatctggatattgccggttcagacgacccggccgacctggaggcgaagttcgacaagattaatcagcagtggcgtacactgtgtgaggattcctgtttgtcagagccttatgtgttacgcaattatctgctgtataaactctacagcagctatttccccggcaaaaacacggcaaccatcatgcgacagttttatcgtatggtgctggactttttctacgtcaaatgtattctcagcgttaaatcgatgcagggtgaaatcgaccagcaggtggtgatgaaaaccatcgccagcctgtcagaaaagaccatgcacaattcgaccattgatgcgcgcatggactttgcaattaataaaatcaacggcggtgatgatttatcctgcctgctgttaattggataa

SEQ ID NO: 53716 - DNA, 227 bp, Glycine max
  Peptide Sequence Number=SeqID_145401
acgatggcggtgcagatatcagaggatctgttgacatacaggatcgtgaaggaagtattgagattatcggtctgagccatggtataaatttgcccgttgacagcgcaaacggtaaaatcaccggcacccgccagcactcatccatggtgattgaaaaagaagttgatagctctacgccctatctttataaggctgcagcaaccgggcagacgatgaaaagcgcataa

SEQ ID NO: 53717 - DNA, 449 bp, Glycine max
  Peptide Sequence Number=SeqID_145402
ggcatcaacccaccaagaagatcttattggagttatcatcacaagacgttgtgttggcacaaaataagttgctctctaagcaacttgaagccttgatagaaaccctcagttgtaccatttgtggtggtgctcatgaattcggccattgcattccttgtgaagaacaaacgcaggaagttagctacatgggaaatcaacaaagacaaggaaacaaccaaggaggattctcaggtttcctgcaaggttcctacaatcagcaaggaaaatggagatcacaccgtggtaaccaattcaataaggaccaggccaaacagttagctgagaagtcatccaacagctttggggcaaatactaagaagaatcccaaagaagaatgtaatgttgtgatgacaagaaacaagaagcatgtggtagttgaggatgaggatactatggccttgaaagaataa

SEQ ID NO: 53718 - DNA, 249 bp, Glycine max
  Peptide Sequence Number=SeqID_145403
gggaggtggtgccgcccagctcgcccaggcgagccaggttgcttcctccagaagcacagccttctggaggaatattctggagggcccaagtgggcctgggggaggaagtgaagaagaaaagggttcagcccctttggcacttctctctctttcgaatttgcttggaaaaattgtttccaatttcgcaaaggtttcaaccgttcttcgacgttcttcattcgttcttcatcgttcttcgatcttcaacgg

SEQ ID NO: 53719 - DNA, 466 bp, Glycine max
  Peptide Sequence Number=SeqID_145404
atgatagaagtgtctgttgaagtcgtcgcatcgctcgctcaatattatgaccagtcgctaaggtgcttcacatatggggactttcagttggtaccaaccatagaagagtttgaaggaatcttgagatgctcgctaggaggaagaaagccgtatctgttttttggattctaccccaccatggcaagagtggcaaaagcggcaaaagctttggcagatcaaagagagtggacttcatttattgatgttttagcactgttggtgtttgggattgtactttttccaaatgtagatgggctagtggatttagcgatgatcgacgcttttcttgcttatcatcatagcaaggaaaacccggtcattgctgttttggccgatgcctatgacacattcgacctaagatgcaaaaagagcagtcatcacatgtgcgctgaaaagggaaaagtgaattgggaagaactcttggcag

SEQ ID NO: 53720 - DNA, 234 bp, Glycine max
  Peptide Sequence Number=SeqID_145405
gtcttggaaaggatcaacaataatgcttttaggctaaagctcccagaggagtatagagttagcaacacctttaacattactgattttgttccttttgcagatgtagttgattcagatgatgcggggcctgcagatttgaggaaaaatcctcttcaagagggaggggatgatgtaaccctcccaaggaggggacccatcaccagagccatggctaggagactccaggaagattga

SEQ ID NO: 53721 - DNA, 414 bp, Glycine max
  Peptide Sequence Number=SeqID_145406
atggtgaaagtaggaacctcttacgtgccgatcaacgtctcatattcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgttattagtgggtacacacctcaggttgggttagcagaacactttaag

SEQ ID NO: 53722 - DNA, 1004 bp, Glycine max
  Peptide Sequence Number=SeqID_145407
atggacggccgtatcgaacgcgacgtgaaattcaagaaagtagaagaagatgtgaagcgcggtctctgcgtggttttgggcgataagctttatgccgtaagctataggctttatgctgtaagctataagcaagaggctgaagcacgttgcctgcggcataaagcccataccgtaagcgataagctttatgctgtaagctataagcaagaggctgaaacacgttgcatgtggcataaagcccataccttaagcgataagctttatgctgtaagctataagcaagaggctgaaacacgttgcatgtggcataaagcccataccttaagcgacaagctttatgcttatgtattgacagatgcttccccggtgatggacgcgctcgtccggaacgaaggggagcgggatatcctgctgctgctgacggggctgatcggagagagacacgcggagctcgaaagtacagagacgccgaacacatggagaatcagtgcggaagaaggctcggagggtattgtacgtcaggtattcagggcctggacgacgaccgaagatctcccggtaccgcttcgtgaagcccgccggaatttctaccgccgcctgaagtactacccgaaagtgacgggtgtgatctttcgctggtatggcgccgaaccggaagaaggagaagagcggaccatcgtgcgcaaggagtttgcccggtggctgacgcctgatccggtcgttagtgacccggaagcggtgatcgacctgattgcccccgtactaaaaggcgggaaatttgcctggaagggtctgtatcagggagaagtcatcgaattcaatctgaaagacaacgccttccgcgaaaccatccggaagcgtgaaatagagtttgtcagcggcatggcgctgaaaggagtgctcacccagcggagcgtactggagaaggtaacggaggtactgatcctcgacgagaccctcaaaaagcggaagaagtacgtcaatcccaaacgggagcagaacca

SEQ ID NO: 53723 - DNA, 345 bp, Glycine max
  Peptide Sequence Number=SeqID_145408
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaaacggcaaaaagcccccgccggacatcagcgctggcaaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 53724 - DNA, 249 bp, Glycine max
  Peptide Sequence Number=SeqID_145409
atgggggagacacatgaaatgccccaccacaatctagccgacttcgagccttgcctcggatatgccactgaagggcaagcagctggtggcttagggccatttgaaggaggtgaagattatgcctttgctaacctagaagagttgttcctagtacccaatatcatcacccctcccaggttcaaggtgtcggactttgacaagcacaaggggactacttgccctaagaaccatctagagatgtgttgttga

SEQ ID NO: 53725 - DNA, 435 bp, Glycine max
  Peptide Sequence Number=SeqID_145410
tgaaagtgaaaaagcaaaaggggaagaatttagtgaagaaatctacccccaagaagaaggacaaccattagtggttaaagagaagtgtaaggaggcacttgctagcattgccacacctcttgggcttgagtttattcctcaagtaaagaagttgttggatgagggtttggtttgcaagagcttaaatccttgtgctttgttggtgcccaaaatagggggtcccatgaaccctaagagaataaaggtcattcctgagtggcccactccaccaacaccactcattgagttggtgagaaaccatgttccttcatgggaagatgcccaggaaatgggtgttgagggaaggagcccagagtatgaagaaccttgggatttgaggtcaaaccctttccaaggtggagggaatgatgcaattctatcccgcaagggcattgg

SEQ ID NO: 53726 - DNA, 429 bp, Glycine max
  Peptide Sequence Number=SeqID_145411
atgcataaggcattacgggccaatgcacctctaccttatccacatttgataactttatttctgcgtcattttcaaattccgcttgatgatgagccatttgttcaagtcaagcattcctttgcaattggtgctggtgttgtgacttcctttggttaccgtaaggatcggaatggtcaatggctgaagaaaaacgcactccctactcaagatgagcgtactccttcacctcctcctcagcatgaagattcagcactcctgaatgaagtccttactgaattacgaggtcttcgttcttatgttggtgaacgtttcgaatcattagatacacgctttgtcggcatggatattcgcctcgcacaagttgaagaagatgtctccttcatccgtacttgctttgatccaccaccactgcctccatcatcctcttag

SEQ ID NO: 53727 - DNA, 129 bp, Glycine max
  Peptide Sequence Number=SeqID_145412
atgaagcagttcactgacaccctcatcagtgccaacataggaacaattcagggtactaggcccccccaatcgggagcgggtagcaatcaggcacagcaagcaattcatagggctccggataagatttga

SEQ ID NO: 53728 - DNA, 807 bp, Glycine max
  Peptide Sequence Number=SeqID_145413
atggaattcttttctgctgaaacttttgattgcattcaagcctttcagaacctaggtcttatacctttcatgtcattacaattgcctgtttatcctaaattggttaaagccttttattgtaatcttgaaattcaagacaacactttaatttctgaggtttttgggataaaaatggtcattgaccaatcccttttccatgacttaacccaattgtccagtgacggtgtaccatttgaaggtatactgaatgacgattggaagtttgatttttctgcacatgatgcccgccagttggtttgcaccaacaatgcggatatgaccggacgccttcttgccggttcattggcttttgaaagccgcatcctacattatctaattgtgcggattttgcttccactatcttccaatcttgcccaagtttctgaggaagatcttgttatcatgtgggcctttcataccggccgtcaacttgactgggcacatcttagatcttttttaattggtgctgctgtgattgcttcttttggttaccgcaaagaccatgatggctcttgggtcaaaaagggcgctcaacccgctgatgaagaaggcaacctaccagttgaagataattctactcttcttcgaaggcttatggacaagtttgatggacttcagacttttgttggtgacaagtttgatgccatggaattgcaagtcgacatacggttcgatgccatggaatcaaggatcaccaaagttgaagaagatgtctccttcatccgtacttgctttgatccaccaccaccgcctccatcatcgtcttag

SEQ ID NO: 53729 - DNA, 228 bp, Glycine max
  Peptide Sequence Number=SeqID_145414
atggcgaggacgcgtagtcctatgaaggtgaggcgatgcagccctctgatggcgaggacgtgtagtcctctaaaggcgaggacatctagtcctctgatggcgaggacgcgtagtcctttgaaggtgagggtgtgcagccctctgatggtgaggacgtgtagctcgatgggatgcgtatcctctagagagatgcgtacctctaggatgcaaggatgtttggtcctctaa

SEQ ID NO: 53730 - DNA, 261 bp, Glycine max
  Peptide Sequence Number=SeqID_145415
atggtgggttacacaccttcaagttttacagatttggtcttcgccagcaaaaagatcgaagtgggtctgaaaagaggcaaatttaatcatcctgcttggacgaatgagaaaactggggcaaatgaagagggcctaagatcttcttcatcaatggattcctttgcttcttggaagataaatggtagcggaatggagaaggaagagagagaggagacgccacttcaaggagaagatgagtctagaagaagctcaccaccatag

SEQ ID NO: 53731 - DNA, 945 bp, Glycine max
  Peptide Sequence Number=SeqID_145416
atggctccgagaaagctttccttgaaaagatctaggagggacaccgcggctaaagggactagtgccgctaccgagtttgatagccaccaagaaggccaggagtgcgagtttagtcagagaaggaacagggccgacgtgtttgacgaagaggccattgcccagctattatgtataccgggtcaggattttgcccggaccgctgcagggaggcaggtgcggatcatgcgcaccagtataaccaccttgactcagatgtggatgacgttgctgctcagcaatgtcctacccagtgatcataacttcaaccttcctctgccgaagtgtcagctggtgtatgccatcctgacacgaatgagcatccatgtggctcagttaattgctgacgccatctatttatttgcaggtatgccacccaccaggcaccctctagacctggataagtctaaaagggccctggggtttccagcgttgatcacgagcctctgccagtcattcggggttcccgtcacacctagtaaggtgatctggccgccgatcacccaagccttcattgagaagtattgcacgcctaggcaggtgcagggtgatgcgccacaggccgcagacgcaccgccgccacctcatcaggctgatcccgctgggtcattaggcatggagcggtatctacagcacttggttcgccaacaggcggccaaccaccgggggcaggtgcagatacatgagtgtctctaccagcttagcctcagtcagcagggccagggtttcgctccttttgcatgccctactccagatcagtttagggttgaggtcgcatggcccggagattggcccgaggaccagacggaggaggcacctacaggagctcctgacgatgcagaggatgcctgcatggatgaggagatgacagacttgctcggcttcttgggaggaagcggggccacgtga

SEQ ID NO: 53732 - DNA, 183 bp, Glycine max
  Peptide Sequence Number=SeqID_145417
atgaccccttcacagcaatattatggcccaattccaacacctaatgccccatcaggaacacaatggaataagaagcggggaggcatcggggcagaagaaatcctgattgccaagcacgaagatgggatcgaccatgtggcacatcctcacgacatcacggacaccaaaatgaatgatttgcat

SEQ ID NO: 53733 - DNA, 135 bp, Glycine max
  Peptide Sequence Number=SeqID_145418
atggcggaaaccagtcaaggtagggatgaacgcaagcggggatggggtcacgaccgaccgatcgttgctcttctctttgcgaaacaagcagggaatgtcgctgcagggcagccccgtatcctttctattttgtag

SEQ ID NO: 53734 - DNA, 207 bp, Glycine max
  Peptide Sequence Number=SeqID_145419
atgtggaccaccacgggggagaagcttgccgcccagctcgcccaggcgagcaaggttgcttcctccagaagcaacagccttctggagggcccaagtgggcctgctttcgaagaagttacggaaacttatggattgcggaaaaacacctcttttcgacttccaccacattacggaatttcacggatcgcgcaagcctgcttcctttag

SEQ ID NO: 53735 - DNA, 869 bp, Glycine max
  Peptide Sequence Number=SeqID_145420
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcgcaaccgagccctgcccatccccaccatatgtacttccaaagccatcacgagcaccacgagggggcaatagtgatcgccaagaaacgccgttactgtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53736 - DNA, 225 bp, Glycine max
  Peptide Sequence Number=SeqID_145421
atgaagaataaactcaagatcctcaagaacctatgcttcatgagccaatacctttgcggagatctacaagagaaaggagaagaacatgaggaaaataatggtatgatggaagatgacccaatcaactttcatcaagccatgcaaggttccaactcagaaaagtggattgaagcaatgaatgaggagtataagtccatgcaagacaacaaggtttggagggattga

SEQ ID NO: 53737 - DNA, 549 bp, Glycine max
  Peptide Sequence Number=SeqID_145422
atgtctcttgcaactcattttggaaagcttcaggaacatgaaatggaacttatgagactccatcaacatgaagagaatgacaaaaaaaataaaggaatttcactcagagccttatcatcttctattcaagaagaaagtgacaaagaggacttgaatgaaatagaagaagatgatgatttcaaattttttgtgaagagattcaataagtttatgagaaacaaaagaaataaaaataaatcaaacatcaatccaaagaagaaaggaaaagattcctctttagccccaaaatgctatgaatgcaatcaacctgggcacatgagattcgattgccttgtctttaaaagaagaatgaaaaaatccgataagaggaatttcaaagaaaagaaagaaaagaaagcatacatcacttggcaagataatgacatggattcttcatgtggttcagaaaatgaaatcatatatctgtgtctcatggtgaaagactatgaaagcggagaagagatgcattcaatgatttgcataaagaatctgtcaaacttgccaaattag

SEQ ID NO: 53738 - DNA, 300 bp, Glycine max
  Peptide Sequence Number=SeqID_145423
atgattaaacgtcaaacggctccattgtcgtcactccaaaatggtcaagtgactaaatcaaacagaatatacactctgagggagttctcggagagatttgcaaaagatagtgtcgcaacctaccctttggcgggagggcgacgcgtgactcgcgggatgcgtgttccacgaaaggaatacgcgcggagtcgccaccaacgtttattcgaggaaaacgtcggaaaaaccggaaaagacgcgatctacgaactttttagtgaaaggttcgggagttgtatttacgcacggggaaggtattag

SEQ ID NO: 53739 - DNA, 309 bp, Glycine max
  Peptide Sequence Number=SeqID_145424
atggagacaacaacaaagggggagaatgtgaatcatgcaagttttgatgatgtcaaagtagaatcaaacaaggttgcttcaacaaacattcaaaggttaatcattgcttcaagattaatacaaggttgcttcaacaaaaattcaaataagcattgcttcaagattaattcaaggtcaagcaaacaagatcaagaaaagataaggcctcaaacaatctcattggtttatcaagcttttacctcaaaacatattgtttccaacacccaaggctctagtaatcgattaccaggcagtgtaatcgattactag

SEQ ID NO: 53740 - DNA, 180 bp, Glycine max
  Peptide Sequence Number=SeqID_145425
atgaagaaacaacaatggaagagaagcggaaggcaaaggagaagaggagaggggaggcaccatccactagggaataagccatggaagaaggagcttcaccaccaagaatgtgccttggataagaagcttgaagaggatgctttaatggaggaaaatatagagagagggggggcaggatga

SEQ ID NO: 53741 - DNA, 309 bp, Glycine max
  Peptide Sequence Number=SeqID_145426
atggaagcatgtttagcagtagaggacttgttgcaacagatgatagaccaaggccggttggaagtcggcgatgaggggggtgaagagcagcacatatgcatgcagtccgtagatgaggaaggtcttagaaagcctaagcctttggtgatatatttcaccagagacgtagctccccaaacgacccgatacccctcggtagttagacgtattctgtttccataccaaaatagccacacagttccgtggaggtatgcgcgtccaagcgaaaggaaggaagaagccaccgacatcagctcgctgtcggccaag

SEQ ID NO: 53742 - DNA, 1104 bp, Glycine max
  Peptide Sequence Number=SeqID_145427
atggggacaaatcaaaacagcaaaaggttttatcaagtcaaggttaaaagtctagatgtcaccagcctcaaggaattgggacgtttgatgggagctctccaaaggcaagccttctgcaaagtgtacagaaagattctagatttgaccgcggcgcaggtatttacggaagctgtcgtatccctcgcccaatactatgaccagccgttgaggtatttcacgtttggggacttccaaatggtaccgactattgaagagtttgaggaaatattaggatgccctcttgggggaagaaaaccgtatcttttctccgggtttcttccttccttgagcaagattgcagctgtggttggagattcggcaaaagaggcaaggcaagggatatggcgagccaagagaagtggggcccgtttgcggatatttagctttgttgatttttggggttgtcctctttccaacgttgacggtttggtggacttagccgccattgatgctttcctcgcatatcaccatagcaagaagagtccagtggtggctatcttggcagatttgtttgacacctttgaccggaggtgtgagaaaaacagtgcacggattgtctgttgtttacccgctctctgtgtgtggttggcttcacacctattccaacaagacacaagacaccggtgtccgcttcaaagttatcgctcatgcgccgaaaaaggaagagtcgattgggaccaacatttggctgggataggaggcaacgcaatcaattggtttcctcgttggaaggaaggcaaggaaggagttcttttctcgtgtggggactaccctaatgttccattgatagggactaggggttgtattaattataatcccgcactcgccataagacagctagggtaccccatgaggggagcgccaacagaagaaagtctctcgcctttccttgtgagggatctaggcgcgcaaagtctcaaggtgatacaaagagtccacaaggcgtggagaagtccgttgaggaaagacaaggagcttagaggcatccgaaatggcgtcatcgatggttatcatggatggctaagagttcacacgcgagggttagattggctctccaaattgaag

SEQ ID NO: 53743 - DNA, 646 bp, Glycine max
  Peptide Sequence Number=SeqID_145428
atggcaagagctggtgacaatggtggtgtatatcatcaactggacgaatctcagcgcttatttctggacgcgtggactacacaaatgcaacgtttgttgaaccgtaacaaagaagagccctacagacgaatagtcaaatcttcctcgtttactcttaaacctctatcccctagagaaatgtcttttccaaggagattcctcatggactgccaccttcaagaagcttcattgcctaacaagccaacttacaacagcaagccccaagagactcagcataaggatgcacaggtcaaagttgagtatgtgaaaagattgtatgaccaagtgaaggtgcaaattgcaaagaagaatgaaagttatactaagcaagccaacaagaaaaaggaaggaagtgggaatgatgagaatcatgaaactggccaaatagaggctaaaggcccaagtggagaaggacgaaggcccaagtggagaaggacgaaggcccaagtggagaaggacaaagcccccgagtggagaaggacttatcaaggtaatccttgtggcgtctaccctgacttatcttccttcattggaagtggcgtctacccagacttatcttccttcaccggaagtggcgtctaccctgacttatcttccttcaccggaa

SEQ ID NO: 53744 - DNA, 736 bp, Glycine max
  Peptide Sequence Number=SeqID_145429
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataagataccaggcgtttccccctggcggctccctcgtgcgctctcctgttcctgcctttcggtttaccg

SEQ ID NO: 53745 - DNA, 361 bp, Glycine max
  Peptide Sequence Number=SeqID_145430
atggctaagtttgaccttgaggtagtcctggagttttacgctaatgcctggcccacagaggagggagtgcgggacatgtgttcgtgggtgaggggtcaatggattccttttgacacagacgccctcagccaattcctgggtgacccgctagtgttggaggaaggccaggagtgtgagttcagtcagaggaggaacaaggccgacgggttcgacgaggaggccattgcccagctattgtgcacaccggggcaggatttcacccggaccgctgccgggagacgggtgcggatcatgcgcaccaacatgaccaccttgacccagatatggatgacgttgctgctcagcaatgtcttgcctagtg

SEQ ID NO: 53746 - DNA, 354 bp, Glycine max
  Peptide Sequence Number=SeqID_145431
atgagtgtctatcccacaaggtttttaccgctcgcaaaaaggacagtgcgaatctgggtcactcccgcattttactcttggctagcatggggcattgtatttggtctcccttcactagggaagccggaagaatcaagattctatcttcttaatgcgaaggatgtcacaaatgttaccttgatgggaacaagggggtgtattaattataatcccgttctcgccataagacagcttggctaccccatgagaggagcgccattagacgaaagcatcacgcctttcatcgcacggggttttagtgaccacaacgcgagggtactccaaggagttcgcaaggcatgggatgcggcgtga

SEQ ID NO: 53747 - DNA, 207 bp, Glycine max
  Peptide Sequence Number=SeqID_145432
atggtctctgagggatgggtcactggtaatcgattaccagatgaacctgcacggacgctgcagcgcacggtggagtggatactacccacgcctccaccatatcgtctagtggagcccgtccaagtgatcgaggtgacgtcatccgaggaagaccccgaggaggatctggaggagctacctcctgagcctaccgtggaatgcccttga

SEQ ID NO: 53748 - DNA, 207 bp, Glycine max
  Peptide Sequence Number=SeqID_145433
atgcatgaggaaatccaagctcttgaagcaaattccacttggacacttgttccattaccacctgtggatgtaccctccactagaactgatccacaagagatgtaccctctcttgttctcagtcaacaacccaagtagatgtaccctctacttgtaccacaaaggatgtaccctccaatgtgttaagacaaagatctcaggctgttaa

SEQ ID NO: 53749 - DNA, 475 bp, Glycine max
  Peptide Sequence Number=SeqID_145434
atgaccccaaggaagcttgcctcaaagagatccaggaaggataaagcggctgaagaaaccagttccgctcccaaatatgatagtcatcgttttaggagcgctgagcaccagcagcgcttcgaggccatcaagggatggtcatttctctgggagcgacgcgtccagctcagggacaacgagtataccgactttcaggaggagatagttcaccgacggtgggcatcactggttactcccatggccaagttcgacccagacatagtcctcgagttttatgccaatgcttggcctacagaggagggtgtgcgagatatgcgatcctgggtgaggggtcagtggatcccatttgatgcggatgccctctgccagttcctgggatatcctttagtgctggaggagggccaggagtgcgagtatggccagaggaggaaccgtgccgatgggttttatgaagaggccatcgcccaattgctgt

SEQ ID NO: 53750 - DNA, 204 bp, Glycine max
  Peptide Sequence Number=SeqID_145435
atggaaattcgaatggataaaagctataatttgtttgacccattcattggtgcacataatgtaaggcagtgtattatgtgccatatccagcaacaagaagggacaaacatggttgatatgtcatcaggtggtgttgaccctccccaaccccattcacatgattcaagtgggaaaggggcagttgcaaagaaaagacgatatgtg

SEQ ID NO: 53751 - DNA, 348 bp, Glycine max
  Peptide Sequence Number=SeqID_145436
atggttatgggggatcccatcagcagactctccttccctgtggagaaaacaccgagactttttcaagtctcacaaagttatctagaactacgtaggtctgagttcctcattggaggatacgtaggagcaagagccttgcttttgtcgaccgcaccaccttttgctgtcatgacccaagagctggtaacccgcggagacaccttacggttatccgtacctcgtcattcagtgaccccaagtgtgattgatgagcaaaggccagtgtggtcatttgcaccctttccggagatgtcaacatcttccggtcgagactttttcaagtctcacaagttatctagaactacgtag

SEQ ID NO: 53752 - DNA, 87 bp, Glycine max
  Peptide Sequence Number=SeqID_145437
atggataagagcttgaaggtaggagaagatgagtggagggagagggagagggagagagggggacacgaattttatgcctcaaatgag

SEQ ID NO: 53753 - DNA, 914 bp, Glycine max
  Peptide Sequence Number=SeqID_145438
gcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggggacttgggcccggtccgccactgaggacgcttctccagactacaattcggacgccgagggcgagcgattttcatggtgggcttttcccggttcgctcgccgttactaagggaatccttgttagtttcgttgttgcgcgtatcgataagcttaaactcagcggaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacacccaagtatcgcatttcgctacgttcttcatcgatgcaagagccgagatatccgttgccgagagtcattgtatcgccggggtttgtgtttgtcgcgaggacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcagggacgtagtcaacgcgagctgatgactcgcgcttactag

SEQ ID NO: 53754 - DNA, 839 bp, Glycine max
  Peptide Sequence Number=SeqID_145439
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcccgactggagggagcacaggctctgagtgtggcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53755 - DNA, 372 bp, Glycine max
  Peptide Sequence Number=SeqID_145440
atgcaccctcaccttgagaggactacacgtcctcgtcttctgagagctgcacacccccgccttaagaggactacacttcctccccttaagaggactacacgtcctctccttgagagggtaagtatgcacgtcgctcaactatttctaatgtcgtctactgtttgcagggatcatgcccgcaagacacccagtggacccggagaagtccaacagggtcctggggtttccagctctgattacgagtctctgccatttctacggagttcccatcgcccccagcagggtcatcaggcccctattaacagggctttcatcgagaagtattgtgcccccaggcaagcacaaggcgaggctaatcgaggccgtacctga

SEQ ID NO: 53756 - DNA, 259 bp, Glycine max
  Peptide Sequence Number=SeqID_145441
atggcagaatcgtcaaagaaacgtaagggttcatccgcctccgcttcggcttcaagagctcatcgtttcggagccacaagcgcatccacagcaccaattccaccctccttatcctcttccactttgttttcttccgaagaacaacagaaacggtactcaaatcttttctcatctcgttccattatcgaccctaagttcattgatatggaattcttttctgctgaaacctttgattgccttccagcatttcagaatttag

SEQ ID NO: 53757 - DNA, 705 bp, Glycine max
  Peptide Sequence Number=SeqID_145442
tgctggatttacgagcacttttcgtcagttgcggagtccaccgctgatcaggactacgacgaggcttctccgcgtgcgtgcagatggattgtgacgaagaagaccgtgaagagcatttgcatgccgtcgtatagggagcacctgaaccgactccggattccggatgtctgttggatcccgtatggggagcatcgggaggtccgggacttccacgtcagatcatgctactccggtctcttgcgctgggggcatgttgctgtgtattaccgaccggagagggtcgtgcgacagtttggttacacgcagaccattcctgctcctcctgtcgatcatgggtctcgtatgatgatatacacgacaggtgaggtgtgcgtggtgccaggggcgtgttccagtgactacatcgactggttcttccgcatctcccatcctttcatgacaccaggccacgcagtggatcctctacctcatggtcacgccccgcagccccgagttgtccctcaggccccgcagacggatatccctcacgaagtttgtgatgatattgctgagcggttggagcaccatctgagtctaggggtgctcacgcctggctcatcgacacatgaggtgatcgaagaatgcctcagattggccaggagtgtcacacaggaccatctagtatacgttaggtgtagacgcaggcggcgcactgatcaggcttag

SEQ ID NO: 53758 - DNA, 303 bp, Glycine max
  Peptide Sequence Number=SeqID_145443
atgggggtgcaaatagcagctaggcccacttggggccctccagaggattcctctagaagggcggttgcttctggaggaagccaccttgctcgcctgggcgagctaggtggcaagcatctcccccattttcctataaatagggggagaagtgaagaggaatttcgttcagccctcatgaaatccgagccgaggcgcttccgtaacgcttccgtgacgtttccgtggggattttcgcgaagattttcagccgttcttcgacattctttgttcgttcttcatcgttcttcggtcttcaaccggtaa

SEQ ID NO: 53759 - DNA, 336 bp, Glycine max
  Peptide Sequence Number=SeqID_145444
atgatattgcacgagaatagaaggcctaactctctaaaaatagtccccagtggagtcatcgattgtcgcaacctacctttcggcgggaaggcgatgtggggctcacgggcgcgtcttccaaggaaggaaggcgcgcggagtcgccaccaacgtttattcgaggaaaacgttagaaaaaccggaaaagtcgacaagggtgtttccctcgctcctacgtattcctcaattgcgatgaggaaatcagacctacgtagttctttcagaactaaacgttggttaagttgtttttatctttcccctcgcaagatatattctaaccgtacaaaagtcgtttaa

SEQ ID NO: 53760 - DNA, 471 bp, Glycine max
  Peptide Sequence Number=SeqID_145445
atgtccgcgatttatgattggtccgtgctcgcattgcgcaatgtttacgatcgccgcattcagggcaagccggtgctcgacagcgccgcgctgttccccgacgccgaacgtttcaccgcccagtggcggcagatccgcgaagaggcgctgaccgtcgcccacgatctgcacaatattccccgctttcacgagatcatgatccagcaggcgtcgatttccgccaacgacgcgcgcgactggcgcatgttcatcatgaaggcctacggccagccgatcgcccgcaacctggcgcgctgcccgacgctggcggcgttaatcgcttcgtccccggacgtgctgtccgcctcactctccttcctggcgcccggcaagcaggtgccgccccaccgcgggccgtttcgcggcattctgcgcggctatctggtgctggacatgcccaaacgcgccgacgggtgccgcgccgtgctgaaa

SEQ ID NO: 53761 - DNA, 294 bp, Glycine max
  Peptide Sequence Number=SeqID_145446
atggtggaaccattgaagaagcggaaaggcacttcgagttggagtcaacgacattccgagtcaccacgtgcactgattgacaattggaagttcgatttctctgtacatgatgcccgccgattggtttgtaccaatcaagcggatatgaccggaaggcttcttgccggttcattggcttttgaaagccgcatcctccattaccttattgttcgcatcctgcttcctagatcttcaaaccttgcccaggtttctgaagaatatctcattgtcatgtgggcctttcataaaggttaa

SEQ ID NO: 53762 - DNA, 532 bp, Glycine max
  Peptide Sequence Number=SeqID_145447
atgtttgtgttagaaaatgctccacaaccgttgaggcaactactctttgattctaacgactctcaagctaagaacttccagcaaaacattcgatcatataatgtaatgtttgcattcacatcacccggtctccaacttgacacaaggtataatacaggaagagggcctcctacattccgcgtacatggtcaaggtcatcatcttattggaagcctcctacctttggcaaataagtcaccaaagtttgcacaactatatatttatgatacagacaacgaagttaacaacaagctttcgcaaaaccccaacaaagatgttcttgatgaagacattatcattgcaacgaagaatatgctagataataacaaccattatgcgcagaagtttagaatggcaagggataaactacaatcttcaatagtctctgacctaaagcttaaactgatttatgatagacagtcagatggaagattatccaatttgccaaatactgctgaagttgctgctttgattgttggtgacgagcacacag

SEQ ID NO: 53763 - DNA, 975 bp, Glycine max
  Peptide Sequence Number=SeqID_145448
atggggacaaatcaaatcggaaaaagattctatcaagtcaagattaagggcctagatgtcactagccttaaggagttgggacggttgatgggacccctccaaaggcaagccttccgcaaaatatacggaaagattttagatttgaccacagcggaggtatttacagaagccattgtatccctcgcccaatactttgaccagccgttgagatgcttcacgtttggggacttccaaatagtaccgactgttgaagaatttgaggaggttttaggatgccctcttgggggaagaaaaccgtatcttttctctgggtttcttccctccttgagcaagattgcagctgtggttggagattcggcgagagagttggatcgtatgaagcaaactcgaaatggcgtagtgggcctatcatggaaatacttggaaggcaaggcaagggatatggtgaatcaagaggagtgggtcccgtttgcggatatactagctttgctaatctttggggttgtcctctttccaaatgtggacggtttggtggacctagccgtgattgatgctttccttgcatatcaccatagcaaggagagcctggtggtagctttcttggcggacttatttgatacatttgaccgaaggtgcgtgaagaacagcgcacgaattttctgctacttacccgttctttgtatgtggttggttttgcacctattccaacaagacataaggcattcatgtctgctccaaagttatcgctcatgcgtcgaaaagagaagagtagattgggaccaatacttggctgggataggaggcagaacaatcaactggtttcctcgatggaaggaaggaaaagagggagttctcttctcatgtggggactaccctaacattccgttgatagggacgaggggttgtattaactataatcccgcactttctataagacagttagggtaccccatgaggggagcaccgacggaatag

SEQ ID NO: 53764 - DNA, 339 bp, Glycine max
  Peptide Sequence Number=SeqID_145449
atgacgaaagtttatacggataaccactcggatatttccgcccgtcagcgtgactcaaaagtcagtatgacagatcttgcgagcgcggaagatgacgtgaatctccgcgtgtcaacgggcttgtcggtcgcgattgacgaaggccgtagaagacgatgtcagtctctgcgtgctatcaggcttttcgtcttacagatagcaaaaaggaatgtttatacggataaccactcgggtatttccgcccgtcagcgtgactcaaaagtcagtatgacagatcttgtgagcgcggaagatgactgtaaatctccgcgtgtgaacgggcttgtcggccgcgattga

SEQ ID NO: 53765 - DNA, 488 bp, Glycine max
  Peptide Sequence Number=SeqID_145450
catgggacactgacgatattgatcactgggaaggtcgatgaattcaagccagagcataatccacatccttttctcgccgaaagttcatttgccacattgtttccaaaataccgagaaacatatttgcgtgaagtcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53766 - DNA, 843 bp, Glycine max
  Peptide Sequence Number=SeqID_145451
atggtttacgcacaacaacagaaaaagctgctgcaagggtatctttcgcaaaccattgactcaccctttgccattgagttgggcatgacttacggcaaccccagcatgcaaagcgccattgaatcgctcaaggaacaaggttgcgatcgcattctagtattcccgctttatccgcaatacgcggccagcagcaccgcagcggccatggatgccgtgtggcgtgtattacttaaaatgcgtaacgtgcctgctattcgtacgatcaagcactaccatgatcatccgctgtatattcaggccttggccacccatatccaaacttactggaaacaacatggcaaacccgaaaaactggtcatgagttttcatggcgtaccaaaattccacctgctaaaaggcgatccctaccattgcgagtgccataaaacggcacgcttgctggcagaagccttaggcttaaataaagagcaataccaagtagcgttccaatcccgctttggtcgtcaggaatggctacaaccctacctcgccaacacgctggatgcactaggcaaacaacaactcaaacgcatagacgtcgtttgccccggctttagcagtgactgcctggaaaccctcgaagaaatcgccatggaaggtaaacacttgttccagtccgttggcggtggtgactatcactacatccctgcgctgaatagcgaagcggtgtggatagaggccatgcgggatattgcattagaaaacttacagggttgggtaagtaatgcgcttgaccaaacaaaagcgaatgctgaagcacaaaccagcaaacaactggcattaacgatgggcgcagatcgctaa

SEQ ID NO: 53767 - DNA, 135 bp, Glycine max
  Peptide Sequence Number=SeqID_145452
ggtgcggataaccgtaagggtgcggataaccgtaagggtcagtatgacaaagattatggggcggccgacaaaagcaaggctcttgctcctacgtatactgcaatgaggaactcagacctacgtagttctggataa

SEQ ID NO: 53768 - DNA, 832 bp, Glycine max
  Peptide Sequence Number=SeqID_145453
ttggcccagggcttcccggtatcaacagggacaccaggatttatttattctgcgaagtgatcttccgtcacaggtatttattcggcgcaaagtgcgtcggggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgttatcaaagttgccatgagtgatgggattaacaagtatgtcatggttgtctactctttggcactttccaccatcttgcttcttccctttgctttgtttcttcacagcgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgaggaatatgtgatacaggatatattcccgcttcctcgctcactgactcgctacgctcggtcgttcgactgcggcgagcggaaatggcttacgaacggggcggagatttcctggaagatgccaggaagatacttaacagggaa

SEQ ID NO: 53769 - DNA, 362 bp, Glycine max
  Peptide Sequence Number=SeqID_145454
atgccagctgcattaatgaatcggccaacgcgcggggagaggcggtttgcgtattgggcgctagcggagtgtatactggcttactatgttggcactgatgagggtgtcagtgaagtgcttcatgtggcaggaaaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaattcgctccaagctggactgtatgcacgaaccccccgttcagtccgaccgctgcgccttatccg

SEQ ID NO: 53770 - DNA, 725 bp, Glycine max
  Peptide Sequence Number=SeqID_145455
gatgtaccatctgtgggggagctcatgaatctggatgctgtattcctattgaagaacatcccactcgtgaagtcaattacatgggaaatcagcccagaaacaattttaatgcaggaggattttctagattccaacatggccagcaatataatcaacaacagggacaatggaggaaccaccttggaaatcagttcaacagagatcaaggtggaccatccacaaggccacaacaacaagggcctagtctctatgatcgtacaacgaagctggaagagactctagctcagcttatgcatgtttctatgtccaatcagaagagcacaaagtctgccataaagaatctggaggtccaagtgggagagcttgcaaagcaattggcggatagatcatcaagcatctttacagctaatacagagaaaaatcccaaggaggagtgtaaagctgtgatgactagaagcagaatggcaatccatgtggatgagagtgaagcagagaagaagatagaggaacataaaccacagctagcacctaagccaacacttgaacccgtttctgattttgtagaacttgaagagattaatgaggaggctgaagatgaaaaggaagaaaagacaccaataaaagagaaagaaaaagaaagaataaaagaagaagaaaaagagaaaaagttgaaaaatgaaaaacaattggcggaaagaagattggggaacataaacaatagctag

SEQ ID NO: 53771 - DNA, 475 bp, Glycine max
  Peptide Sequence Number=SeqID_145456
gaagcttttgccagagaggaatgtggtggtctactatacagagtttgatgagttcaaggaggaactcgagagatgccactgggatgaggagttgactgaatttggggacgacaacattgatgttgccattgtaaaagaattctatgcaaacctctatgaccccgaggataaatcacctaagcaagtgagggtgagaggtcatctgattaagtttgatcaggacacccttaacactttcttgaagacccctgttattgtggaagagggggaatcactctttgcttattctagattagcactcctgaggcctgaccctcaggagttagctactaagctctgtatcccagggaggggattcgagcttaatgctgatggctatccgttgaagatattgaggaagaagatgaccaccctagctcagacatggagtgctctttccttctctaacctgattcctacctctcatacttctgat

SEQ ID NO: 53772 - DNA, 485 bp, Glycine max
  Peptide Sequence Number=SeqID_145457
atggcgcccactaggcaccctttggacccagataagtccaacagggccctgggattccccgcactgatcacaggactctgccagtcgttcggagtccccgttgcacctaccaaggtgattcggccgcccatcacccgggtttttattgagaagtactgtacccagagacagggtcagggtgatgctccacaggccgtaggcgcgcccccaccacctcatcaggctggccaggctggggcatttgacatggagcagtatttacggcatttggttcgccagcaggcggccaaccaccgagcacatggctccgcttctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttgggagggagtggagatac

SEQ ID NO: 53773 - DNA, 594 bp, Glycine max
  Peptide Sequence Number=SeqID_145458
atgttactgcatagatttcctacctctaatgtccaatcttgtgaatttgggatgaccagcccttccgatgagtcgatctcttgctttctcataagggtggacctttgggtactagtacctatcgccttaagagggttgcatgccctcaccttcagagggctgcatgtcctcgcctttagagggctccacgtcctcgccttaagagggctgcatgccctcgccttcagagagctacatgtcctcaccttcagagggctacacaccctcaccttcagagggctacatgccctcgccttcagagggctacacgccctcgccttcagaggactacacgccctcgccttcagaggactacacgtcctcgccttcagaggactacacgtcctcgccttcagagggctacacgccctcgcctttagagggctacacatcctcacctttaaaggactacatgtccccgccttcagaggactacacgtcctcaccttcagagggctacacgccctccccttcagaggactacatgtcctggtgatgtgccattattttctcctatttcttaaccctttttgcaccattttaagtactgattag

SEQ ID NO: 53774 - DNA, 417 bp, Glycine max
  Peptide Sequence Number=SeqID_145459
atgggccccgacgggtgcagagaaacgcgaggaactggaaccagagaagcggcacgcaaaccgagacagggttttagcattcaaaaagtcaaatttttctctccttgtggctggctttttcttcttccttcttctccacctttgttctccattaaagctccaaactttgctcatcatttctactccaaattgcaaaaggaagccattttcggagtcgtgaagtgcacctctatgttgtgggacttcgaatttcaggaatttgctgaaagcatgctaaacttgacatgtttgataacactggtagagatgatggggagagttaacctagggttaaatgtgagaatggtagtgatgaaagcttgggcagagcaaatgagaaaaatgagtgataaatgtgaaagcaagagtcatttctag

SEQ ID NO: 53775 - DNA, 375 bp, Glycine max
  Peptide Sequence Number=SeqID_145460
aggatcccgatgactacacagatgcaacgtttactgaaccgtaacaatgaagagctctatggacgaatagaaggtctggagaaccaactgaatcagaatgctggaagacattatggtgggaacaaagggggcaatgatggaccgaggcaaaacagaatggaggagcagaacaaaattgagggagtaaaactcaatgtatctcctttcaaaggcaagagtgacccagacgcctaccttgactgggagatgaagattgagcatgaaagtttgactgtggaggagtactacaaaaagatggagatgacactagtgagagccaacattgaagaggaaattgaggacaatgactcgttttctgaatggtctaaatcctga

SEQ ID NO: 53776 - DNA, 103 bp, Glycine max
  Peptide Sequence Number=SeqID_145461
atgtgggatcggcacatgcttaaaggggcactcaaaccgggtgtatttacccccaaggtctacactccaaagagttcgtcagggcctctccctcctgatttag

SEQ ID NO: 53777 - DNA, 216 bp, Glycine max
  Peptide Sequence Number=SeqID_145462
atgctgttgtggtttcctcctttggttaacgcaaagagcgtgatggctctttggtttgatggacttcaaacctatgttggtgagaggtttgactccttggaacgtcaagtggacacacgattcgaggagatgaactcaaggattgcaaaggttgaagaagatgtcaccatcattcgtgactaccttgatttacctccaccaccaccatcagtttag

SEQ ID NO: 53778 - DNA, 311 bp, Glycine max
  Peptide Sequence Number=SeqID_145463
ggatcgcacccccaagacacccagtggactcggagaagtccaacagggtcttggggtttccagctctgactacgggcctttgccagttctacaaagtgcctgtcgcccccaacaaggtcatcaggccccctactaaccgagctttcatcaagaagtactgtgcgccccaagcaggcacagggcgagacaccacagtagcctggggatggtcggcagcgggcaacaagcacactgccaccacctctagagttcacctcaactcatccacaaaaaggttagagcgttgcctacaacacatggccgaccaatag

SEQ ID NO: 53779 - DNA, 213 bp, Glycine max
  Peptide Sequence Number=SeqID_145464
atggtttgtttaactgagatgatttgggttgatgacccttcaaaattggttttctgggtggatgacccagcctgggttggtgacccaaaagaagttgaggatgatttcatagtgatcggctctggaagagacaacttggatcctttacctgtacttcgccctcctttcagggaggctcctgatgccttaggaggcattaccgcttttctttaa

SEQ ID NO: 53780 - DNA, 156 bp, Glycine max
  Peptide Sequence Number=SeqID_145465
atgaaggggaaggagaggacaggtcaaccgtcaggagtagaagtagtggagccagaaaggaaagaatgcaagatagcttaccccgctttcacgggaagggtcgcttcgctcggggagtggaggggaaggagaggacaggttcagccgtcagagtag

SEQ ID NO: 53781 - DNA, 147 bp, Glycine max
  Peptide Sequence Number=SeqID_145466
atggagaattggcgaacagcgctaggcaatgacattcgcggggctccagacctgaagaatggagaattggcgaacagcgctaggcaatggcattcgcggggctgcagactcgaaggtggaggacacatgaacagtgctaggcaatga

SEQ ID NO: 53782 - DNA, 183 bp, Glycine max
  Peptide Sequence Number=SeqID_145467
atggttcgcatatccatcgctaagcgcggcttcatcgcacttagcgtgaagaaggaatctggaagagtacctgaatcaaagcagtgcactaagcgcgagatcagcttgctaagcgagtcatccgtctcttgccaggctcagcgcagcattggcgccaagcccaaatccacttactcgcgctaa

SEQ ID NO: 53783 - DNA, 444 bp, Glycine max
  Peptide Sequence Number=SeqID_145468
atgcacccatgcgcaatcaaggcacctttgttacctagatttatctatgtgtacttccaaggtgtatttgctacctacatcacacgcacttccttggctaaatttacatacatgcatactcaaagcatcttggctaccaaaaattgcacacgtgcacattctggcatttctaatacctatgcatatacaaaccttgtgatgaatcttggctatctacacaataaggatatatgtggggcaattactctagccctttcgaaactgaatgcatgtcccaaaaaatatgtgcaaaccaaattgccccatgggttgtttccttacaaaaatcacgcgctaatgccattgaggcatttcaccgaacacttggtgggcgcgcgtttaggcatcaatagcaagagaacggggacaatgtggcatgccccattacttcaaaatgcattatag

SEQ ID NO: 53784 - DNA, 294 bp, Glycine max
  Peptide Sequence Number=SeqID_145469
atggtgaaagttggaacctcttacgtgccgatcaacgtctcattttcgccaaaagttggcccagggcttcccggtatttattcggcgcaaagtgcgtcgggtgatgctgccaacttactgattttagtgtatgatggtgtttttgaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 53785 - DNA, 344 bp, Glycine max
  Peptide Sequence Number=SeqID_145470
tgatcacgcccccaagacacccagtggacccgaagaagtccaatagtggcctggggttcaagctctggttacgggtctctgtcagtcctacagggtgcccgttcccccagcaaggaatcgcacccacaaagacacccagtggacccggagaagtccaacagggccctgagggatcgcgcccgcaagacacccagtggacccgaagaagtccaacagggtcttggagttgccaagctctaattacgggcctctgtcagttctacggagtgcctgtcacccccagcaaagtcatcaggccccctactaatcgagttttcatcaagaagtactgcgtccccaggtag

SEQ ID NO: 53786 - DNA, 225 bp, Glycine max
  Peptide Sequence Number=SeqID_145471
atggcaagcatggggatctttggagaatctgcatatgagcataatgacacagcgcctcaggatgtagaaacgagccctttgctctttgaccagcctagcacactttctagcaaaagcacacttcctctgagtggaagaagaagaagaattcttcatgagagaggaagaagaagtttgttgagatacattcaaaaaggtcacaaagctggaatcagatttaaataa

SEQ ID NO: 53787 - DNA, 546 bp, Glycine max
  Peptide Sequence Number=SeqID_145472
atgttgctaagtagcaatgtcatctatatctgtgtaagagtggtcatgttggtgcgcatgatccgcactcgtctctttgcagtggcacgggtgaaatcttgccccggtatgcatagtagctgtgtgatagcctccctttctggttgtgcttgcacagttggccctcctccaatatcagggggtggcccaggaaccgtgcggatgtggagcacactgaaaatgaggacacgtagccctctaaaggtaagggcgtgcagccctctcaaggcgaggatgtgtagtcctctggaggtgaggccgtgcagccctctgatggcgaggaggtgtagtcctctcaaggtgaggacgtgtagccctctcaaggcgaggacatgtagtcctctggaggtgagggcgtgcagccctctgatggtgaggacgtgtagtcctctcaaggcgaggatgtgtagtcctctgacggtgaggggtccacccttccatgagaaagcaagagatcgactcatcgagagggccggtcatcccaaatccacaagatttggacattag

SEQ ID NO: 53788 - DNA, 174 bp, Glycine max
  Peptide Sequence Number=SeqID_145473
atggagctattgttcaagcaaaggaaccaagatcacaccaaaagtccaaacatatttgtgaaggtagatggaaaggagaatgcagcagatcccttcaccaagacgcttggcataaaagagtttgacaaacacaaatgggaattaggaatgaagttcatgaatgattggctctag

SEQ ID NO: 53789 - DNA, 630 bp, Glycine max
  Peptide Sequence Number=SeqID_145474
atgggtgatcaagaggagacacaggaacagatgaaagccgacatgtcggctctgaaagaacagatggcttccatgatggaggccatgttaggaatgaggcagctcatggagaaaaacgtggccaccgctgccgctgtcagttcggctgccgaagcagacccaactctcttggctaccgcgcgccatcctccctcaaacatagtagggcggggaaggaacacgctggggcatgacggcaacccacatctgggatacaaccgagcggcttacccttatggattgccgcccaactactcaccacctgtcctgcaagacgatgcgggccatattgcttctcccgtccttgaaagagagcctccccaacagcccgacgaggtccacgaagaccctcaagactatgctcgcagggatgtcgagttctatcccccgatccccgaagggccggcacccagcacgttgcctcagcccaacatcacaacacaaccaatagttttgtccatggaaggaccgcccccggcaactgaggaaaggaggaagctcgatctcctcgaggagagattgagggccgtagaaggatttggcaactatccgttcgcagatatgacggatctctgcttagtacccgatgtt

SEQ ID NO: 53790 - DNA, 237 bp, Glycine max
  Peptide Sequence Number=SeqID_145475
atgccaatctccccctgcaaatggatcagttgggatcgtgcccacaagacgcccagtggacccgaagaagtccaacggggccttggggtttccagctctgggatcgtgcccacaaagacacccagtggacccgaagaagtccaaaagggccctgggtttccagcttttggttacgggcctctgtcagtcctacagggggcccgttccccccaacgaggtcatgccatcgtgacatag

SEQ ID NO: 53791 - DNA, 702 bp, Glycine max
  Peptide Sequence Number=SeqID_145476
gcccctcatgggaggatgtgcggaaaaaagcacaggccatccagtagcaaaacactacccctccacgtgttgtctcgtgggggttatgaatatttagaacaaaagctcatggctgagaagacaaagaaaagactggaggaagctgcccagtctagaagcactgagggcgtcattgaccctccatctcccatcggatgccacgtgaagtggaagatggcccgcacaaagcaaattgggcagatgacgtctgaggcgtcacagggatcattcgtcccccatggacgtcagaatgtcctgactgctgccattggacctatagtagttgacccaacaaatcaggtaccagctggaggagttgatcacagaaaaagtgacttggtaggtaatggcatccttcagccagatgcagtcccagttttagtcttagatgcaatcacagggacttgcactgcctccggagccagagttggtcccttaggtgctcgcgtcaacacaaaggagagctgtgttgatcccttagggaacgatccagagacgggtgactcagacaaatgcaggctgtacattgaagaaaatcattcctgcctggttgcccaaggaagactttatgagggatccacagcggttcacaatatccctttgttgcatggccaagtgaaggttggtgttgaggaggttaaagatgtagagactcccgttcct

SEQ ID NO: 53792 - DNA, 336 bp, Glycine max
  Peptide Sequence Number=SeqID_145477
atgagtggactcgccactaacgtttattcgaggaaaacattagaaaaaccaaaaagaggtctacggattttgaaaataagggtttcagagttgtttacgcatggggaaggtcaacaaggcggtgcccttgctcctacgtatcctcagggacccctaagggtacatagatcacattcaatccctaaaataaaactaaccgatggttgcacgaagaacgcaaaacaagaaaaggacatagggaatgaccatggttgctatttggtagcgcctcagcttcgtttcttcttccttcttcctcttccttcttgttggacatgtggcctcaagaaatcttaa

SEQ ID NO: 53793 - DNA, 123 bp, Glycine max
  Peptide Sequence Number=SeqID_145478
atggataatgaatatttgaggggaggtgcaaccctcttttgctatcaccccatccaacatcttcatatatcactaggactcattagtgcaggtgtggatgggaagaagcccagagtttcatga

SEQ ID NO: 53794 - DNA, 765 bp, Glycine max
  Peptide Sequence Number=SeqID_145479
acctacaccgagcttcgcttcaactatctcggcctctccaatcccgatgacggtgccgatgagacctatggcctggcaagcgacagcagctatgttcagttcgcctacatccagcttggtggcctgaaggttggtatcgatgagtcggaattccagaccttcaccggttaccttggtgatgtgatcaacgatgacgtggtcgacgttggcgcataccgcacgggcaagatctcgtatacctttgctggtggtaacggcttctcggctgtaatcgccctcgagcagggtggcgacgatcatctgatcaccgactatgttccacacattgttggcggcctgaagtatgctggtggctggggttcgatcgcagctgttgcagcttacgattcagttattgaagagtgggcagccaaggttcgcggtgacgtcaacatcacggatcgtttctcggtttgggtacagggtggttatgcctccgctgaaacgaccgaccagaactacggttcctggggtggcgattgggccgtttggggtggtctgaagtataaggcaaccgaaaaggcgacgttcaacgtgcaggcagcctatgaagactggggcaagactgcacttacagcaaacgtggcctacgaactggtgcccggcttcacgatcacgccagaagtttcctacaccaagtgggatgacgatcatccggtacgtgaagctggttttgccgggaaagatgctttccagggcatgatccgcttccagcgctcgttctaa

SEQ ID NO: 53795 - DNA, 462 bp, Glycine max
  Peptide Sequence Number=SeqID_145480
ttaccctcaccgttgagaggactacacgtcctcgccttgagaggactacacgtcctcaccagcaaagggctgcacgccctcacctccagaggactacacctcctcgccttgagaggactacacgtcctcaccagcagaggactacacatcctcaccatcagagggctgcacgccctcacctctagaggactacatgtcctcgccttgagagggctacacgccctcaccttggttaccctcaccgttgagaggactacacgtcctcgccttgagaggactacacgtcctcaccatcaagggctgcacgccctcacctccagaggactacacctcctcgccttgagaggactacacatcctcaccatcagagggctgcatgccctcacctctagaggactacatgtcctcgccttgagagggctacacgccctcaccttgggtactagttaccctcaccgttga

SEQ ID NO: 53796 - DNA, 324 bp, Glycine max
  Peptide Sequence Number=SeqID_145481
atgacagatcttgtgagcgcggaagatgacgtaaatctccgcgtgtcaacgggcttgtcggccgcgattgacgaaggcgcagaagacgacgttagtctctgcgtgctatcaggcttttcgtcttacagacaacaaaaagtttatacggataaccagctcggacaacaaaaagtttatacggataaccgctcgggtatttccgcccgtcagcgtgactcaaaagtcagtatgacagatcttgtgagcgcggaagatgacgtaaatctccgcgtttcaacgggcctttcggccgcgattgacgaagggcgcagaagacgacgttag

SEQ ID NO: 53797 - DNA, 156 bp, Glycine max
  Peptide Sequence Number=SeqID_145482
atgatcacctttcaagtaaaaagaataacttggttcacgcataagaaagaactacgtaggtctgatttcctctttgatggagggttattgtcctttgagacaaacgtgagaggtgctaataccttcctcaagcgtaaatacaactcccgaacttag

SEQ ID NO: 53798 - DNA, 405 bp, Glycine max
  Peptide Sequence Number=SeqID_145483
atggagagaagtatgatagatgctgccagtggtggagcccttggagacatgacccctgctgaagccaaaaatttaattgagaagatggcttcaaactcccagcaatttagtgccagaagtgatgctattgtcattagaggagtgcatgaagtagccacgaactcattaggtgagactaagaagcttgaaggtacaatcccgggtggaggaatcatcccaaccttagatggtcgaatccttcacaacaacagcaacaacaacaacaaccttattttcagaatgctgctggcccaagcagaccatacgttcctccaccaatccagcagcaacaacaacaacaacaacagccccagaaacaacaaacagttgaggcccctccgtaaccttcccttgaagaacttgtga

SEQ ID NO: 53799 - DNA, 298 bp, Glycine max
  Peptide Sequence Number=SeqID_145484
atgtctcaaggtaagatccccaaatccttccacggccctcaatctttcctcaaggagatcgagcttcctcctttcttcagttgccggggacgatccttccgtgggcaaaactattggttatgtcgcgatgttgggctgaggcaacgtactgggtgccagcccttcggggatcgggggatagaactcgacatcccttcgagcgtagtcttgagggtctttgtggccttcttcgggctgttgagaggctctctttcaaggacggagaagcaatatggcccgcatcgtcttgcagacggtg

SEQ ID NO: 53800 - DNA, 408 bp, Glycine max
  Peptide Sequence Number=SeqID_145485
atgggatcgaatcaagcaccttcttttaagaaaaggttttataacgtcaaaatcaaaagcctagaagttgccaatttgcaagagttagggcaatggatggatcaactccaacatcaagctttccataagacatatggaaagatctgggatttggcaatgatagaagtgtctgttgaagccattgcatccctcgttcaatattatgaccaatcgctaagagtcatcctctttccaaacgtggatgggctagtagatctagcagcgatcaatgtttttcttgcttatcaccacaacaaggaaagtctggtcgttgctgtgttggccgatgcctatgacacatttgaccggagatgcgagaagagtggagcaaggattgcctattgcacactcgctctttatgtatggctg

SEQ ID NO: 53801 - DNA, 889 bp, Glycine max
  Peptide Sequence Number=SeqID_145486
atgcagtttgtctggccattcaagtctgagtatctgattgcttatttgagtgaagactaccagcacacgattatcgccaggaataaacgcgattatgtctggctgatgagaggggattccatgtcagagagaatatacggctatttatggcggttggtgggttggctcgataaccatcgctaccaggcgccggcggatgtcggagctgagagcatagactggtggcgtgtgttgccatttgtcgccctgcatattgctttgtttgcattgtactgggtgggctggagtccattcgccgtcctgtttgcggttgctatgtatgttgtccgtatgtttgcagtgactggcttttatcatcgctattttgcccataaaacatttcagacctcacgcgctggacaattcatatttgccctgataggagcgactgccgtgcaacgcggcccattatggtgggctgcacatcaccgccaccatcatgtgcatgcagaccaacctcaggacgtacactccccacatcagcatggtttgttatggagccatttgggctggtttctgagccatgccaacttcaaaacacagctggaacgtgtcagggaactgacccgctaccgtgagctctgctggctagaccggtttgacagcctggttccgatcgggatggccttatcgatttatgcattgggtgaactgcttgcgcattacgcgccacaattgcaaaccaatggctggcagttattagtttggggatttgtcgtgtctacgatcgccctttatcacgccacattttgcgtcaactccctggcgcatgtctggggaagtcgccgctatgccacacgtgaccatagccgcaacaactggctaatcgcgataattactctgggcgagg

SEQ ID NO: 53802 - DNA, 225 bp, Glycine max
  Peptide Sequence Number=SeqID_145487
atggagaatcatgaccaccaaagtcaggagatgcgacaacagatgcaagaacaaaatgagaaaattcgtcaacaaaatgagcaaatgaaacgcatattacaacacttgcatattcagtctatcatgccaactcctagtctatcgcctaccatagcagatggaactgagcaccatgttaatgatgctcaggttgatcgtcctcatgacatgggaaatgatcgttga

SEQ ID NO: 53803 - DNA, 238 bp, Glycine max
  Peptide Sequence Number=SeqID_145488
gagtgtggatgcttccgaatacatgaagactggtcagaagatctttgagcttttggatagctttgttgaggagattggagaaaagaatgttattcaagtggtgacggaattgcataagcaaaaggccaatcttagaaggatgtttacttcagatgaatggttgaagtctaaggcaactaaagagcctaaggggaagcaagcaacagcctcttgtaagtgtgttgaggttggtggataa

SEQ ID NO: 53804 - DNA, 465 bp, Glycine max
  Peptide Sequence Number=SeqID_145489
atggtgaaagttggaacctcttacgtgccgatcgaagtctcattttcgcaaaagttaggcccagggcggtgcccttcgccattcgtccaactgtcgggaaggcctgatcggtgccagggccttgctattatgaatcgccaacgcggcgaaagggggatgtgctgcagtttgcgtaattgggtaacgccagggtttcccagcacggagtgtataaacgacggcttactatgttgtaatgactcactgatgagggtgtctgaagtgggcttccaccgcggtggcaggcctcagaaaaaagtggtccccggtgcgtcgcaggaatatcgatacggaatagattccgcaattccgcgtcactgccaacgtcgctacgctcggtcgttcgactgcggcgagcggaaatggcttacgaacggggcggagatttcctggaagatgccaggaagatacttaacagggaagtga

SEQ ID NO: 53805 - DNA, 473 bp, Glycine max
  Peptide Sequence Number=SeqID_145490
tgtgcagcccgatcttattccttgacataacgttggacatcatgtgcagcaactccagctttccttcattgtctaagtgcttatgttttaacaaaatcttagccaatcttttaagctcagtagagctaagcactaacaatctccccctttggcaaattttgtctaaaacatacttagacacttctgagcaggtacgagcagttatgcaagtgggatcagcaactttcattatcagagtaatcaagcacaacggaaattcttcaagttgcaaatctacaagtcttctccaggatgtcaagacatctcacgtgacatcagctttctgctcctgctccccctgtcttcatgcttactgcagcgtcttctatcagctactcgtcttttccaggtcagtcaagacatctcatgtgagccatcagctttctgctccccctgtcttctgctcttactgtagcatcttcatcagctactag

SEQ ID NO: 53806 - DNA, 309 bp, Glycine max
  Peptide Sequence Number=SeqID_145491
tgctaaaaggagcagtcgcgctaagcggaccctgtgggctcagtgcacatccaccgctaagcgcaacttcagtgtgcttagcgtgacaagggaatctggaagagcacaaggatcaaggtcgcgcactaagcgtgagatcagcttgccaagcgagatgtttgtctcttgccaggctcagcgcacaactggcgccaaggcacacaattttagcaagcaatacagaattccagagcaagtacaccacagtgctaattttgagatagaagatctggaggcagcaagaggagcaactttacagagaagcctagg

SEQ ID NO: 53807 - DNA, 893 bp, Glycine max
  Peptide Sequence Number=SeqID_145492
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggcccttccactccttgaaacggcctttccacagagccgcacttccgactcgagatcgagtgcaagttcggcaagcgccggacggccggcgagatcatcccctacgtcgatcacctcgcagaaggccgagatgtcgcatcactgtccggtccgttgcgccttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53808 - DNA, 528 bp, Glycine max
  Peptide Sequence Number=SeqID_145493
atggtgaaagttggaacctcttacgtgccgatcaacgtctcattttgcgccaaaagtggcggcgctgccctcggcgccagctgcggtcccgcagccagggcaccaggatcagcttattttcgaatgatttccgtcacctcagctgttcctcctgttcagctgaaatctgatccggggtggtgcgtcacaattcggcacacaagcataccagccggaagcatcagcgcggcaagctgcccttcgccattcggtgcgcaactgtctgggaaagggcctgatcggtgcgggcctcttgctattaatgaatcgccaacgcggcgaaagggggatgtgctgcaagtttgcgtaagttgggcgctaacgccggagtgtatactggcttactatgttggcactgagaaattcgtcgtcttccccagctcactgatcgctacggctcggtcgcttcgacctgcggcgcagccggaaatggcttacgaacggggcggagatttcctggaagatgccaggaagatacttaacagggaa

SEQ ID NO: 53809 - DNA, 450 bp, Glycine max
  Peptide Sequence Number=SeqID_145494
atggaagagggattttcccatggttcagttccaattgttttaggcaggccatttatgaaaacaacccgaaccaagatagatgtttatgctggcacattgtctatggaatttggtgatattgttgttcattttaacattcttgatgccatgaaacatccatctgaggatcattctatttttcgggctgagataattgatcagattgttgatgattatatgtttgattctgttcttcatggtaggaaacatccatttttatctgatctgcatacttgttattcctcgtgcaatgaatctgaatctgagtttgaatttgatcctgtatctgatttttatgctgagagtaaatttgaatttgagtctgattctgattttctgggtgttgtacctcttgatgttgattttttagagtcagaatgcactaaccatgttgcaggaatgatcgaggcc

SEQ ID NO: 53810 - DNA, 837 bp, Glycine max
  Peptide Sequence Number=SeqID_145495
atggcagagccatcaaagaagagaaagggatcatcctccaccgctaccgctgctgcccatcgccgtcacggcccatccggagcacccacagcacctattcctccttctttgtcatctccaagatcatcaacattgttttcatccgatgatcaacgtctacggtacctttctcagttctcttctagaataatcttagaccctaagtacctagacgtagagttctttaatgatgaaacgtttgattgctatcaagtgtttcagaattctggtcttgttgatttcatgtcatttaaattgccatattatcctgaacttgtaaaggtcttctactgcaatttaaaaattcaggatggtattattatgtctgaggtgcatggtacttctatggtcattgatcagtcacttttcttttctttgactcatttacccagtcaaggtgcaccttttgagggcaccattgttgatgactggaaattcgattattcgagtcatgatgctcgtcgcatggtctgcaatgatcaagctgacatgaccggtagattgttggccgggtcattaacttttgataatcgcatcatgcattatatcattgttagaattttgcttcctcggtcttcaaatttagcacaagcctctgaggaggatttgattcttatgtgggcttatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 53811 - DNA, 323 bp, Glycine max
  Peptide Sequence Number=SeqID_145496
ggtggacccttgggtactagtaccctcaccttccgaggactacacgtcctcaccttcagaggactacacgtcctcacctttagagggttgcacgtccttgccttcagagggctacacaccctctcctttagtgggctgcacgccctcgcttttagagggctgcacgccctcgccttcaaaggttcagttcctgggccaccccctgatcctggaagagggccaactgtgcaagcacaactagaggaggaggctatcgtacaaccactatgcatactggatcaagatttcacccgtgccgttacaaagagacgagtgcggatcat

SEQ ID NO: 53812 - DNA, 636 bp, Glycine max
  Peptide Sequence Number=SeqID_145497
atggcaccgaaaaagctttccgcgaagagatctaggagggacgccacggctgaagggaccagtgccgcccccgactttgatagtcaccattttaggagcgccgagcatcagcagcgtttcgaggccatcaaaggatggtcgttccacagagagagacacgtccagctcaaggacgatgagtacgctgattttcaggaggagatagctcaccgacatgggacgtcgctggtcactcccatggctaagtttgacccagacatagtcctggagttttatgctaatgcttggcccacaaaagagggagtgcgggacattcggtcatgggtgaggggtcagtggattccctttgacgcagatgccctcagccagttcctgggtgacccactagtgttggaggaaggccaggagtgcgagttcaatcagaggaggaacagggccgacgggttcgatgaggaggccattgcccaactattgtgcacaccggggccggatttcgcccggatcgctgctgggaggcgggtgcggatcatgcgcaccagcatgaccaccttgacacagatgtggatgaaattgctgcttagcaatatcttgcctagtgatcataactctgaccttcctctgccaaagtgtcagctg

SEQ ID NO: 53813 - DNA, 237 bp, Glycine max
  Peptide Sequence Number=SeqID_145498
atggggatacaaaagaattctcaggcgattagtcctttgaacacttttgtattagggaaagggaagaatcaaaagaattctcagattgtgtcttttgaattctttgacaagggagaagggagacacaaaagaattcaggcggttagtcctttgttcttttggaaaagggagaagagagatagaaaaaggattcaggcgaattcattttggcaaagggagaagagaatgaaaagatga

SEQ ID NO: 53814 - DNA, 346 bp, Glycine max
  Peptide Sequence Number=SeqID_145499
atggtgaaagttggaacctcttacgtgccgatcaacggctgtctcgatttcgccaaaagtgaatgcccatctgatcggttcaacatgctgttccctcctgttcagctactgacggggaatggtgttatccgtcacaattcggcacacaagcataccgagccggaagcatcagcgcggcaaggctgcccgctttcccatgtcagggaaacctgtcgtgccaactgcttaatgaatcggccaacgcgcgggcgatcgagtgcgggcctttgcgctattacgccagctggcgctaaagggcggatgtgctgcatactggcgattactatgttgggtacactgagccagg

SEQ ID NO: 53815 - DNA, 411 bp, Glycine max
  Peptide Sequence Number=SeqID_145500
atggcattattgattgctgcgaagtgcatcctcacagtgtatgatggtgttaatttcgaggtgctccagtggcgtatctgttgtctatcagctgttccctcctgttcagctactgaaattcggggtggtatccgcgtccaattccacaaagcataccagccggaagcatcagcgctggcaagtgtaaagccggggtgccaagacgctgacgctaactcaccacaccgccgcgttaattgcttgccgctacagggctgccgctttccattcgggaaaccatgtcaggtgcgcaactgcattaatgaatcggccaacgcgcgggcgatcggtgcgggcctttgcgctattacgccagctggcgctaaagggcggatgtgtgcatactggcgattactatgttggcgtaactga

SEQ ID NO: 53816 - DNA, 729 bp, Glycine max
  Peptide Sequence Number=SeqID_145501
atgtcttttccaaggagattcctcatggactgccaccttcaagaagcatagaacatcaagttgatctccttctagaagcttcattgcctaacaagccaacttacaactacaagcgccaagagactcagcataaggatgcacaggtcaaagttgagtatgtgaaaagattgtatgaccaagtgaaggtgcaaattgcaaagaagaatgaaagttatactaagcaagcctacaagaaaaggaaggtactagtacttgaacctggtgatgatcctagacatttgagggcaaatgttttccaagaaggagggaatgatgagaatcatgaaactggccaaatacaggctaaaggcctatgtggagaaggacgaaggcccaagtggagaaggacaaagcaccccgagtggagaaggatgaaggcccaagtggagaaggatgaagccccagaggcagagacactatcaagactattaattacttatcaaggtaatccttgtggcgtctaccctgacttatcttccttcactggaagtggcgtcaaccctgacttatcttccttcactggaagtggcgtctacccggacttatcttccttcaccggaagtggcgtctaccctgacttatcttccttcactggaagtggcgtcgtccaaaaactctacagcctgtatcaaacgatccgccccgtaaggttcacatcatctggtatcagagcttcggctcttgatacag

SEQ ID NO: 53817 - DNA, 252 bp, Glycine max
  Peptide Sequence Number=SeqID_145502
atggtgaaaagttggaacctcttacgtgccgatcaacgtctcattttcgccaaaaagttggcccagggcttcccggtatcaacagggacaccaggatttatttattctgcgaaagtgatcttccgtcacagctgtccctcctgttcagctactgacggggtggtgcgtaacggcaaaaagcaccgccggacatcagcgctggcaagtgtagcggtcaccgctgcgcgtaaccaccacacccgccgcgcttaa

SEQ ID NO: 53818 - DNA, 411 bp, Glycine max
  Peptide Sequence Number=SeqID_145503
atgaaaagagaaaaacatgcctcctatagtagtcataactcttgcaagagcctaagtgaagaacttcgtaactattatgaaggaaggcataggtcacatcttagacctcactcccataggagagaaaatgaaagaaagcctcaagatgttaacattaaactcacatacttccatgggaaggacaatgtagaggcttacttagattgggaaataagggtagagcaaaaacttaaaagaaagcctactttaaaatcttatggctatcattcttatccaaagaaagaccaaggtctaggcatcttaggggcagcaccttctaagcccaatgatcataaggggaagacaatagaaaagcaaccccctaaggctaaggacacattacttctcaatgctccaccaagaaaaccatga

SEQ ID NO: 53819 - DNA, 939 bp, Glycine max
  Peptide Sequence Number=SeqID_145504
atgggatcaagtcaaaagccttcacttaaaaagaggttctatccagtcaaggtcaagagcctagggatcaccagtctaagagagttagggcagttgatgggtaaaatctgggacctagccatggtagaagtctccacagaggccattgcctccctcgcccagtattatgatcagccgttgaggtgcttcatctttggggacttccagctatcaccaatggtggaagaatttgaagagatcctaggatgcgagtgggccccgttcatagatattctcgcactgttgattttcgggggagtcctctttccgaatgtggatgggttggtggacctggcagcgatcgacgcttttctcgcctatcacaaccacaaggaaagcttggttgtcgctatgctagccgacctatatgacaccttcggccgaagatgtgaaaagagcaatacaaggattgtttgctgtacttcagctctttatgtatggttagtttcgcacctttttcgccaagagatgaggcatgcttgcccattagaaagctaccgttcatgcacagagaaaggaggggcgaattgggaccaactcttagcaagcaaagaaggagcatccatcaactggttccctcgatggaaggaaggaagaaccggagttcttatttcgtgcggaggatttccaaatgttcccttgatggggacgaggggttgcatcagctacaatctcgttcttgctacaagacaacttggctaccctatgagaggggcgccactagaggatgagctcacgcctgtcatttcacgaggtttcaataagaccaacatggagacacttcagaaggtccgcaaggcatgggaggtggtaaaaaagaaggacaaagagctcagagggaataataatgggcccattggtggctaccgtgggtggttgaaagcccgtgggatcctctag

SEQ ID NO: 53820 - DNA, 831 bp, Glycine max
  Peptide Sequence Number=SeqID_145505
atgattatgaggggccaagacatttatagtagccaagatgaggctactacttcaccttccactaatgaaaatgaagaagcaataggggaagaatctagggaagaaatctatccccaagaagaaggacaacctttaatggttaaggaggagtgtaaggaggtaagtgtctcctccaagaggttagctaagaaggaaagtcattttgaaataaagacaaatattaaagaaacttcccctcttagacaacctccacatcttatcctttgtaaaaagacacttgttagcactgtcacacctcttggccttgaggttattccccaagtaaaagagttgttggatgagggtttggttcataagagcttaaatccttctgctttgttggtgcccaaaataggtattattaggcaccaaatccctaaaataagtgatatgatgaatgtgttgagtgttgccaccttcttttgtaaaatcggtcatgcacacaacatcttcatgattcatgtacatagggactcattaggtagtggtcaaggggttcccatgaaccctaagagaataaaggtcactcctgagtggcccactccaccaacaccactcattgagttggtgagaaaccatgttccttcatgggaagatgcccaggaaatgggttttcagaccttaccttacttcaatataccaaacacaactaatacatatgtggagggaatgatgcaatcctatcccgcaagggcattgggtagaagactccaagtagattgggctagagatccaagggtaggccctagggttctcatgagccttagggtagatttcgaacccatgggttaa

SEQ ID NO: 53821 - DNA, 318 bp, Glycine max
  Peptide Sequence Number=SeqID_145506
atggaggcgatgcttagtaactcaaaatattggaaagccgtttccaatgactcctctgcggcttccacgtatggcatagaggaagggcaacttaccaggacatcttcctcacctgatactatgaccaaatgtccttccactacaaacttcaacttttggtggagtatgaggccctatctgtactgggaggtcgatctctccgcttaccttttggcggctaccgtcaaaggcatggacaaccatggaacttggcctcagatgggaagcgttaaatggcaatttctccaacgtgcttttgggcatcacgttcaggcttga

SEQ ID NO: 53822 - DNA, 504 bp, Glycine max
  Peptide Sequence Number=SeqID_145507
atggtgttaatttcgaggtgctccagtggcgtatcatgtgtctatcagctgtcccttcctgttcagctactgacggaatggtgttatccgtcacaattcggcacacaagcatacacgccggaagcatcagcgctggcaagtgtaaagcctggggtgcctaagacgctgcagctaactcaccacacccgccggcttaattgcttgccgctacagggctgcccgctttcccatgtcagggaaacctgtcgtgccaactgcattaatgaatcggccaacgcgcgggcgatcgagtgcgggcctttgcgtattacgccagcggcgctaaagggcggatgtgtgcatactggcgattactatgttgggtacactgatgccagggtgtttcagtcacgaagtgcgttcatgtggcaggagaaaaaaggctgcaccgggttaagtgagagggccgcggcaaagccgtttttccataggctccgcccccctgacaagcatcacgaaatctga

SEQ ID NO: 53823 - DNA, 997 bp, Glycine max
  Peptide Sequence Number=SeqID_145508
atggattgggaccagctcttggccgggataggaggtagaataatcagttggttcccccgatggaaggaaggaaaagaaggagtccttttctcatgtggaagatacccaaacgttccgttggtaggaacgaggggatgtattaactacaatcccgcgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagcttagaggcattcgtaatggcatcattggtgggtaccacgaatggctgaaggttcgcatacgaggtttagattggctcgccaagttaaaagtcgtcagcaaagagaattttgaagcaccggaagaggacgaagaagtccaagctctcaaaagcgagttaggaaaggcaaaactcgccaaggagaagttcaagttggctgctacacacgttcggaaggagtgcgccggggctcgcaaggaagagtatggccggaacaaatttcgcggagctctatggggtagcaatagtgaactcaagttgcgaagggaagaaagggaccagtcgcgagcacatggcatggttttgaaaaaggagttaattgcctgttcaaggtccaaaagaagcttgtctcagcgtttatgcgagacggagaccaacatgctagctatcatcgccaagtaccaagaagagttaggtctagccgcggcccacgagcataggattgcggacgaatatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctatt

SEQ ID NO: 53824 - DNA, 306 bp, Glycine max
  Peptide Sequence Number=SeqID_145509
atggtgaaagttggaacctcttacgtgccgatcaacgtctcattttcgccaaaagttggcccagggcttcccggtgctccagtggcgtatcatggtttctatcagctgttccctcctgttcagctactgaaacggggtgggcgctgccattcgccattcaggctgcgcaactgttcgggaaagggcctgatcggtgccgggcctttcgctattatgaatcgccaacgcgcgaaaggggatgtgctgcaagttgcgattaagttgggtaacgccaggagtgtcccatcacggcttacatgttggtaa

SEQ ID NO: 53825 - DNA, 428 bp, Glycine max
  Peptide Sequence Number=SeqID_145510
atggagctttatttacgtattgcgcctgagctttacttaaaacgtttagtgcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53826 - DNA, 217 bp, Glycine max
  Peptide Sequence Number=SeqID_145511
atgttggttaccttggccgacaacgagctgatgttggtggcttcttcttccttttcacttggaggtgtatacctccatgggactgcatggctgttttgctatgggaaaggaacaggtttagctgtcgagggggccaagcatttttcgatggaatggcctggggttttcccatggtacgtgcaagttgcgttacgatcatacccttttgggaaaaggg

SEQ ID NO: 53827 - DNA, 123 bp, Glycine max
  Peptide Sequence Number=SeqID_145512
atgaagaattgggaacgaggatttcatgagagcaatggaggagcagggacacattgtaatcgattacaacatttggtaatcgattacagtattgtagtaatcgattaccagagtgatttttag

SEQ ID NO: 53828 - DNA, 279 bp, Glycine max
  Peptide Sequence Number=SeqID_145513
atggaaatttacccaaacctgtggcaacagtggaagtatgattggtgggtacccagtttgcagcgccaatcctgtgcaggattgcatactgtcgcaacctacccttcggcgggagggcgacgcgagactcgcgggatgcgtgttccacgaaaggaatacgcgtggagtcgccaccaacgtttatttgaggaaaacgtcggaaaaaccggaaaagacgagatctacgaactttttagtgaaaggttcgggagttgtatttacgcacggggaaggtattag

SEQ ID NO: 53829 - DNA, 267 bp, Glycine max
  Peptide Sequence Number=SeqID_145514
atgctccacaggccgcaggcgcgccaccaccacctcatcaggctggccaggctggggcatttgacatggagcagtatttacggcatttggttcgccagcaggcggccaaccaccgagcacatggcagaggttgcatggcccggagattggcccgaggcccaagcgggagaggcgcccccagaagctcccggcgatggagaagaggcccacgaggacgaggagatggccgatttgcttgacttcttgggagggagtgaagatacatga

SEQ ID NO: 53830 - DNA, 725 bp, Glycine max
  Peptide Sequence Number=SeqID_145515
ggctggattctttccctacgctgcgcaaagtgcgtgccggggcggaatacaaatacgtcaccctgaaagatcgtggtgaacccattgcactggcgacttatggcgagctcttcagcatcgatcgccagaccatcattaacgatgatatggatatgctgacccgcattccaatggcgatggggggcgctgcgcgtgcaaccgtcggtgacctggtctgggctgtgctgaccagtaacccaaaaatgtcggacggtaaaccgttgttccatgccgaccacggcaacctggtctcttctgatctcagtattgaagggcttgatgccggccgtcaggcgatgctgttacaaaaatccggtgagcgccgtctcaatattcgtcctgcctttatgctgacgccagtggcgattgaatcccgtgcgaatcagttgattaaatctgccagcgtaccgggtgctgatgctaacagcggcatcaataacccgatccagaactttgtgacggttctgtccgaggctcgcctggatgacagcagcccgacagactactacctggcagcggcgcagggtcgtgacaccatcgaggtggcgtatcttgacggcatcgatacaccctatctcgaacagcagcagggcttcaccgtggacggggcagccttcaaggtgcgaattgacgccggtgtggcgccgctcgactggcgcggactggttaaagccaccaaaaaataa

SEQ ID NO: 53831 - DNA, 234 bp, Glycine max
  Peptide Sequence Number=SeqID_145516
atgtcgctgcatgttctttatctttatgcgttttctggatttcccccagggatttcccgtctgctgtatccctcgttacaatctttcaaagaaatggacgggcaggatcatcttgagctaccttcttgggtgaggaccaaatgtggacagcagaaaccaatcaaggtacttaggaacggatgcaagtggggatggggtcacgaccgactgatcgttgccctttctctgcgctag

SEQ ID NO: 53832 - DNA, 531 bp, Glycine max
  Peptide Sequence Number=SeqID_145517
atggagactcaaatagggcaattgcccaaacaattgcaaacctcttcaattggcttttttgcagccatcgaggagaacccaaagggtcattgcaaggctattatctccaccatagagtgtgacatgggaggtgaagaaaaagaagaagaggtaaaagaaaacaacatgttagaggaagagataaaagcacaagccaacccttcaacccaagatatgcaatcctcacttaatcctccattgtttgatttttgcaagctaagcatctataagcaaggagacgatgggaggatggcaaaattcgagaaatacatggagatgctacaagggaagaaggatgaaccacttattgaaaaactcacatgggacatgctaaatcaagtaaggcccacaagacatttggaggacaagggatgttttatgatccccatcacattgggaaatctctctatcgaccatgcactacttgactttggcacgagttgcaacctcatgcctcattctttctttgagagattggtcgccttaacctaa

SEQ ID NO: 53833 - DNA, 1228 bp, Glycine max
  Peptide Sequence Number=SeqID_145518
gcatcattttataccttttgatcatcctgagcattccattactggtgaatttgtgcattctattattggtgattttgaacatcctgatttggagcattataattttgagcattctgattctgagcattctgattttgcacattctgagaacatggcacaacctccaccccatgagaggactctaagggaaatggctgcacctgatttcacctacgaaagcttgtgcatccaatacgctgatgaggatgtcccatatgttcttaaaactagactgattcatttgcttccaaagtttcatggccttgcagagggagtggtaaaggattggctgtattaccttgctccaaggtccatcacgagctgggatgaccttaagagagtattcttagaaaaaaatttccctgcttccaggaccatagccatcaggaaagatatctcagagaagtatgatagatgctgccagtggtggagccctggagacatgactcctgctgaagccaggaatttaattgagaagatggcctccaactcccagcagtttagcgccagaaatgatgccatagtcattagaggagtgcatgaggtagctacaaacccatctacatcatctgaaactaagaagcttgaaggcaaactggatgcattggttaacttggtaacccagctggccttgaatcagaaatctgtacctgtcgcaagggtttgtggtttgtgctcctctgctgaccaccatacagacctttgcccttccatgcagcaacctggagcaattgagcagcctgaagcttatgctgcaaatatttacaatagacctcctcaacctcagcagcaaaatcaaccacagcagaacaattatgacctttccagcaacagatacaaccctggatggaggaatcaccctaacctcagatggtccagccctcagcaacaacagcagcctgctccttccttccaaaatgctgctggcccaagcagaccatacattcctccaccaatccaacaacagcaacaaccccaaaaacagccaacagttgaggcccctccacaaccttccctcgaagaacttgtgaggcaaatgactatgcagaacatgcagtttcagcaagagaccagagcctccattcagagcttaaccaatcagatgggacaattggctacccaattgaatcaacaacagtcccagaattctgacaagttgccttctcaagctgtccaaaatcccaaaaat

SEQ ID NO: 53834 - DNA, 453 bp, Glycine max
  Peptide Sequence Number=SeqID_145519
atggcctttgtggataactgggtggtgggtaaggaggaggtttgttattggctaataacgacattgttgggttggtgggaaacttggccgtataggaatggcagtcacagcatgggtttctccctctttctcaccctcttcatttgccccaattttctcagtcgtcctagtaggatgatcaaatttgcctcttttcagacccacatcgatcctttcactggcgaagaccaaatccgcaaagctttgagggtgcgtagcccaccatcttttcatagtagagtatcgataatgtgtctaccatcacgattatcgtctccctttccatcattgggggtaccacctgggccgccagatccctccaccttttgggcctgttctttgaaagatccgtccccctttctgcacatgttctatagttgcatcctatccggaaccatatcaaaattgtactga

SEQ ID NO: 53835 - DNA, 314 bp, Glycine max
  Peptide Sequence Number=SeqID_145520
aaactgccgggaatcgtcgtggtattcactccagagcgatgaaaacgtttcagtttgctcatggaaaacggtgtaacaaggttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggctgcgcaactgttgggaagggcgatcggtgcgggcctcttcgctattacgccagctggcgaaagggggatgtgctgcaaggcgattaa

SEQ ID NO: 53836 - DNA, 318 bp, Glycine max
  Peptide Sequence Number=SeqID_145521
atggaggtcatcaaaattgattggggtgtcccttgcattcacggcatcaatgattgctctatagccgtcgtcgagaccatgaaaagatccatctggatattggaggagatcatagtcatcaaggagagcttcaacttgttgtttccaattaggataattgttgggaagaagtttggtgacattggtgaaagtgatgcaagcaaggggtttggatggctcatgggggttgggaatgaaggagttgttgtcggccataggaggcaagggtggggaacgacgtccttaattgaagaaatagggaatgagtggatcgtttag

SEQ ID NO: 53837 - DNA, 849 bp, Glycine max
  Peptide Sequence Number=SeqID_145522
gggaagagacgtcagcggaaggtaaagaaaaattcaagtcagcggctgttaggatccgaaaaaagaatgccgaactaagagacgtcaacatagccaccaccaaggccttagagcaagagaccaagagggccagcaaggaagaacatggccgaaacaagttccgaggggctcagtggggcagtaacaacgaacttaagctccaaagagaggaaagagaccaattgcgattagatggcataattctgaaggacaaattgaagacttgcctaaggtcaaaaaggagtttgtctcagcagttatgtgagaccgaaacaaacatgttggccatcatcagccagtacaaagaagaattaaatttggccaccgcccacgagcacaaagtggcggacgaatacgcccaagtgtacgcagaaaaggaggctagaggaagagtgattgactcattacatcaagaagcgacgatgtggatggaccggtttgctctcactttaaacgggagtcacaagcttccccgattactggcaaaggccaaagcaatggcggacgtgtactccgcccccgaggaaatccacgggctcctcagctattgtcagcatatgatagacttgatggaacatatgaaagtcgacatgtcggctttcaaagaacaaatgacttctatgatggaggccatgctagggatgaaacaactaatggagagtaacgcggccaccgccactgctactagcacggctgccgaggcagacccggctctcccgactgctgcgcaccatcccgttccaaacatggtgggacgagagagaagcacatcaggacatatcagaaaaccccatccgggatacaaccgag

SEQ ID NO: 53838 - DNA, 327 bp, Glycine max
  Peptide Sequence Number=SeqID_145523
atgagatatgaactcgtccctgtgtcgctttttgtgaagacaaaggaagagagagccaaacttattgatggaagcttgcttgtggagcttctatggaggctggatcttagagcttcaatgtggtcctttaatggtgattttccaccatggagatgcagcggaagacaaaggaaaataggtgagaggaggcgccatccattaaggaataagccatggaagaaggagcttcaccaccaagatgagccttggataagaagcttggagaggatgcttcaatggaggaaaagaaagagggagagaaagagagaggggggagcacgaaattga

SEQ ID NO: 53839 - DNA, 722 bp, Glycine max
  Peptide Sequence Number=SeqID_145524
gatgccatggacagtaccttcagaccagattagggattgccaaagtggacggccaacaactttctcagttcatttcggatgcacagcaggcagtatgggcgtcgcgagaggtaagggagcagctacagaagaaccaagtgtccgtggtgccggccaacttctattcaaatattccgaccctggaggagattgcggattcgtttgaataccgcaacattagtgagcctccttatttggacgtgggtattttcgactcgttgagcttgcgtgaagagttgattagcctggctgaatactctgcggacttcgatccgccgaaggacggcgactccgaaaatcctacagcttttttttggggaaatgaccagttcccgttcattgatggaatggtatatcacgctgttctgcgcaagcttaagccgcgcaacgttgtagagattggcagcggattttcttcattggtcgcgattgaagctctgagactaaacggctccggaaaactgacctgtattgaaccttttccaaggaggttccttcaggatcgggcggagtcggggcagctagagcttattcgccagaaggcccaatccttcgccgacctgaacgatttgcttcaggacggcgatgtgcttttcatcgattccacgcatacggtgaagatcggtagtgattgcctgcacctttacctgcgcctcctacccaagatcaaacgccggatctgg

SEQ ID NO: 53840 - DNA, 270 bp, Glycine max
  Peptide Sequence Number=SeqID_145525
atggatcgccgacatcccgctgccggtcatcaccgcgccggcgccgccttccagctccgccaacgcgcgttgcaccacgtcgcgcgtcgggttgccgcggcgcgaataatcatgggctcggggttggttgaagtcggtaaagttataggtgctggacagatgaatcggcgggacaacgcagccgtactgttcgtcgtcgttcaggccgctgcgtacggcaatcgtggctggtttacgcgtcatgggctcgctcggctctcggttcggtga

SEQ ID NO: 53841 - DNA, 201 bp, Glycine max
  Peptide Sequence Number=SeqID_145526
atgacaccggggggcggagcctatggaaaaacggctttgccgcggccctctcacttccctgttaagtatcttcctggcatcttccaggaaatctccgccccgttcgtaagcctttccggggctcggccgcagctgtttcgagacgctggccgagcgcacatcgaattcactgcagcccgaggaggatatatccttcactag

SEQ ID NO: 53842 - DNA, 231 bp, Glycine max
  Peptide Sequence Number=SeqID_145527
atggtgaaagttggaacctcttacgtgccgatcaacgtctcattttcgccaaaagttggcccagggcttcccggtagcgagatcttggaagcatgtatatacaaaaatatcctcacagtcaagcttattcgcaataccgtgcgacctcgaggggggagcccgggctgccccttcgccttcaggctgccaactgttcgggaagggcctgatcggtgcggcctttgctattaa

SEQ ID NO: 53843 - DNA, 554 bp, Glycine max
  Peptide Sequence Number=SeqID_145528
tgattccctttgatgcagatgcctcagccagttcctgggaagacctgctggtgttagagaaaggccaagagtgcgagtttagtcagagaaggaacagggccgatgggtttgacgaggaggccattgcccagctggaggcaggtgcggatcatgcgcaccaacatgactaccctaacccagatatggatgacgttgctgctcagcaatgtcctgcccaggatcgtgcccacaagacacccagtggacccggagaactccaacagggccctagggtctccagctttggttacgggcctctatcagtcttacagggtgcccgttccccccagcaagggatcacgcccgcaagacacccagtgcacccggagaagtccaacagggtcctggggtttccagctctgattacgagcttctggcgagacaccacaacaacattgggatggacgatagtgggcaatagacgcaccaccaccacctctagagttcacctcatctcatccacaaaaaggcgtctagctcaagacgttaatgaagcgctactaggaggcaaccta

SEQ ID NO: 53844 - DNA, 669 bp, Glycine max
  Peptide Sequence Number=SeqID_145529
atgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacatattgcaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 53845 - DNA, 672 bp, Glycine max
  Peptide Sequence Number=SeqID_145530
acttatcaaggtaatccttgtggcgtctaccctgacttatcttccttcactggaagtggcgtctacccagacttatcttccttcactggaagtggcgtctacccagacttatcttccttcactggaagtggcgtctaccctgacttatcttccttcactggaagtggcgtcatccaaaccttcgtagcctgtatcaaacgatccactcctactcagattgactgggctcatttggttcggtaccgaatgcttaaggcattacgggccaatgcacctctaccttacccacaattgataactttgtttctgcgtcattttcaaattccgtttgatgatgaaccatttgttcaagtcaagcgttcctttgcaattggtgctggtgcagtgacttcctttggttaccgtaaggatcggaatgttcaatggctgaagaaggacgcactccctcctcaagatgagcgtactccttcacctccttctcagcgagaagattcaacactcatgaatgaagtccttacggaattacgaggtcttcgttcttatgttggtgaacgtttcgactcattggatacacgttttgccgtcatggatattcgcctcacacagcttgaagaggatgtaggttacattcgtcagagtttcgatcttccaccaccacctccaccttcttag

SEQ ID NO: 53846 - DNA, 312 bp, Glycine max
  Peptide Sequence Number=SeqID_145531
atgttggtgcgcatgatccgcactcgtctctttgcagcggcacgggtgaaatcttgccccggtatgcatagtagctgtgtgacagcctccctctctggttgtgctcgcacatttggccctcctccaatatcagggggtggcctaggaaccatgtggagcacactgaaaatgaggacatgtagccctctaaaggtgagggcatgcagccctctcaagacgaggatgtgtagtcctttggaggtgagggcgtgcagccctctgatggcgaggacgtgtagtcctctcaaggtgagggcgtgcagccctctgaag

SEQ ID NO: 53847 - DNA, 381 bp, Glycine max
  Peptide Sequence Number=SeqID_145532
atgagcgcatgtgcagtttttggtaccccaaaatgctttgagtatgcatgtatgaaatggccccgaggaagcttgcctcaaagaggtccaggaaggacaaggcggccgaaggaactagttccgccccggagtacgacagtcaccgctttaggagagttgtacaccagcagcgcttcgaagccatcaagggatggtcgtttctccggggagcgacgcgtccagctcagggacgacgagtatactgattttcaggaggaaatagggcgccggcggtgggcaccactggttactcccatggccaagtttgatccagaaatagtccttgagttttatgccaatgcttggccaacaaaggagggcgtgcgtgacatgagatcctgg

SEQ ID NO: 53848 - DNA, 219 bp, Glycine max
  Peptide Sequence Number=SeqID_145533
atgaaggacgatgagttaatccaatcgaaattacctcccgcgacacaatatcaactaccaaatgtcaaagacagtaacaataaacctgtcatggcagttccattcaaaacaaaagatgtcaatgaggaagtaacctccaaagacattaagagcctaatggaacaggcaaattatactaacaaatatttacaagttttaggagaaaccattaaatctaag

SEQ ID NO: 53849 - DNA, 426 bp, Glycine max
  Peptide Sequence Number=SeqID_145534
atgtcggctttgaaagagcaaatggctttcatgatggaggccatgttagggatgagacaactcatggagaataacgtggccaccactgccattgttagttcgactaccgaagcagatccaactctcccagctaccgcacaccatcctctcccaaacgcggtagaacgagaaaggagcacactggggcacatcagcaacccccatttgggatacaattgggtggcttacccttatggactaccacctaatttcacgccaccagccatgcgtgatgacgcaggtcatgtcccttcccccatccttgaaggggagcttcctcgacagtcagacgaggttcacgaggatcatagagtgtatgcccaagtagacgtcgatttctaccccccggtccccgtcgagggtccggcacccaacgtactgccttaa

SEQ ID NO: 53850 - DNA, 648 bp, Glycine max
  Peptide Sequence Number=SeqID_145535
atggggcctcaccacccatcaatgcatggtgttcttagacttattgttactctagacggtgaggatgttattgattgtgaacctatattgggttatttacacagaggaatggaaaaaatagcggaaaaccgaacaattatacaatatttgccttatgtaacacgttgggactatttagctactatgttcacagaagcaataactgtaaatggaccagaacagttgggaaatatttcaagacccatgcttcgggcttccggaatacaatgggatctccgtaaagtggataattatgaatgttacgaagaatttgattgggaagttcaatggcaaaaagaaggagattccttagctcgttatttagttcgaattggtgaaatgatggaatccataaaaattattcaacaggctttggaaggaattcccggcggaccatatgaaaatttagaaattcgctgctttgatagagaaaaagagccagaatggaatgagtttgagtatcgatttattagtaaaaaaccgtctccgacttttgaattgccaaaacaagaactttatgtaagaattgaagcccccacgggcgaattgggaatttttctaataggggatcaaaatggttttccctggagatggaaattcgtccgccag

SEQ ID NO: 53851 - DNA, 417 bp, Glycine max
  Peptide Sequence Number=SeqID_145536
atgaaaaagagtttacatcaactacttagtaagaatccccaactgagggttttagcctttcatggcaaggaaactccttttacactgaagaagaggaatcaagagaaattgcttgctcacaaaggagtggggatgtctcctccacctctaggaatctcacaatctctcaaaaactcactaatctccctaaaagatgaaaacttggccccttgctctgctctatgctctctgaaattcacactctttaggcctttctattgtgaaaagttctctttttggctctccttttattctgtgcaaatcaggattaaaaagggcttcctgatcttgatgtcgcgcttagcgccattctcgcgcttagcgcgagtaagtgaatttgagcttagtgttgagggagtaaacaagtattctggttga

SEQ ID NO: 53852 - DNA, 225 bp, Glycine max
  Peptide Sequence Number=SeqID_145537
atgactaaagcacgtcaaaaggaggtacggaaagtaaatgaaatgaaaataaaagtacgcgaaacaagtggggaccaccaaggactaaagaacgatgtagaacgaatgaaagacggcggaaaatcttcacgaaatcaagcacggaaacgtttcggacgcgttacggaagcgcctcggcttggattttcttcacggaaacaattttttttcactaatttcaagtga

SEQ ID NO: 53853 - DNA, 162 bp, Glycine max
  Peptide Sequence Number=SeqID_145538
atggagctagaactgaagatcataaggctctcagagagtggcattgatgatgaagaagcagctgaggaagaaggagaagcagctgaagaagaagaagaagctgctgaggaagagggggagctgtatgactttgagggggagactgctgctgatgatgattga

SEQ ID NO: 53854 - DNA, 287 bp, Glycine max
  Peptide Sequence Number=SeqID_145539
atgaacgaaataaagatgaaagtaaaaaaaacaagaaatgaattgaaagtctcagattcaaaaacttacccgttgaagaacgaagaacggatgaagaacggtgaagaacaacagaaaaccttcacggattcgctcacggaaacatctcggaagcgttacggaagtacctcggcttggattttcttcacagaaacatttttttccactcagcctatttataggaaaaggggggaggaggttgctgcccagctcgcccaggcgagctgggttgcttctgggcgagctgg

SEQ ID NO: 53855 - DNA, 369 bp, Glycine max
  Peptide Sequence Number=SeqID_145540
gaaggcataggtcacatcttagacctcactcccataggagagaaaatgaaagaaagcctcaagagaccttctaagcccaaagatgataaggggaagacaatagaaaagcaaccccttaaggctagtaagcaagagaagactagctccatgaagtgctttaaatgtcttggaagaggacacattacttctcgatgccccaccaagaaaaccatgattatgaggggccaagaaatttatcgtagccaagatgaggctactacttccccttcctctagtaaaagtgaagaagcaaaaggggaagaatctagtgaagagatctacccccaagaagaaggacaacctttaatggttaaggaggagtgtaaggag

SEQ ID NO: 53856 - DNA, 202 bp, Glycine max
  Peptide Sequence Number=SeqID_145541
atgggagcctgggaaattgtctccttcttagatacaacgtcttggggtagcacagtgcctgacggctttttagtgataatccccaaggtggtcatatctctcttgatggtctctagaggtatcatcccattcgaagaatatattgcagcagtagggactactagcaacaatatgttatcaaagagaaaaactctagatgagg

SEQ ID NO: 53857 - DNA, 465 bp, Glycine max
  Peptide Sequence Number=SeqID_145542
atgccatatgtggaggccacagaggagtcgttagaaaccgctttccactctttcgaggtggtaagcatttcctccatggactccttttctgggcaaccttgcctgtcagatacggcagtaatggtggcccgggtaatgttggggaatggctacgagcccggaatgggtttaggcaaggacaactgcggcataactagcctgataagtgccaaaggaaatcgtgggaagtttgggttaggctacaaacccacacaggcagatataaggaaaagcattgcgggaaggaaaaacggaggtcaaggttcgcgattaagacaagaagacgaaggaagcccaccctgccacataagtaggagctttctaagcacgggtctaggggacgaaggccaagtcgttgcaatatgcgaagatgatgctccgagtggttcggatttggtagaccatgccctcctgatttccaactag

SEQ ID NO: 53858 - DNA, 195 bp, Glycine max
  Peptide Sequence Number=SeqID_145543
atggagaaaaatgaagaaacaacaatggaagagaagcttttgtgctctgattaccacttgatggaagcttgcttgtggggcttctatggaggctggatctttgagcttcaatggggtcctttaatggtgattttccaccatggagatgcagcagaagacaaaggagaagaggtgagaggaggcgccatccattaa

SEQ ID NO: 53859 - DNA, 408 bp, Glycine max
  Peptide Sequence Number=SeqID_145544
atggcttccaactcccaacaatttagtgccagaaatgatgctattgtcattagaggagtgcatgaagtagccacgaatttatcttcatcagccgaggctaagaagcttgaagcttatgctgcaaacatctacaatagacctcctcaacctcagcagcaaaatcagccacaacagaacaattatgacctctccaacaacaggtacaatcccgggtggaggaatcatcccaaccttagatggttgaatccttcacaacagcagcaacaacaacaacaacaaccttattttcaaaatgttgctggcccaagcagaccatacgttcctccaccaatccagcatcaacaacagcaacagccccagaaacagcaaacagttaaggctcctccgcaaccttcccttgaagaactt

SEQ ID NO: 53860 - DNA, 839 bp, Glycine max
  Peptide Sequence Number=SeqID_145545
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataagaaagattacaaaaccagcctacctccaagactatgtgtgaggtctgtgatgagctggcataggatcttgctggattatccataccgtagcaggcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 53861 - DNA, 135 bp, Glycine max
  Peptide Sequence Number=SeqID_145546
gctcccaacacacttccaatgaaaggcctttttgttacaaaatttgaaagcaatagagtgcttcttagtctaatagctcttaaggtggttggccccttgcttcttgactcaaattcttcaagcgatgttgcttaa

SEQ ID NO: 53862 - DNA, 378 bp, Glycine max
  Peptide Sequence Number=SeqID_145547
atggttaagaaggagtgtaaggaggtaagtgtctccttcaagaggttagctaagaaggaaagtcattttgaaataaagacaaatattaaagaaacttcccctcttagacaacctccacatcttctcctttgtaaaaagacacttgttagcactaccacacctcttagcttgagtgatcaaggggttcgcacatatcctaagagaataaaggtcattcttgattggcctactccaccaaatataaaggaaatctggggctgccatgacttaacaaacttttacaaaaggcttgtagcaccagtcattgagttggtgtcgagggaaagagcccagagtatgaagaacctcgggagccaagtacttggagcggtcaattaa

SEQ ID NO: 53863 - DNA, 165 bp, Glycine max
  Peptide Sequence Number=SeqID_145548
atgacgggagatgcatcaaagtttactcatatttctcccaagaatagtggacatgtgacttatggagacaacaacaaaggtagaattctcggagtcgaaaatatagataaaacatcaaatcatgctcaatgttttcttagtaaagatgattattctttgttatga

SEQ ID NO: 53864 - DNA, 354 bp, Glycine max
  Peptide Sequence Number=SeqID_145549
atgacctttactgcacctctcaaagctcagttgattcaactagtacccaaacgtggtcattctctaagttcaatgtgtcggacttctcctgacaagtacaaggggtctacttgccccaagaaccaattaaagatgtattgtcagaagatgggggcatacacaaaagatgagaaactgctgatacatttcttccaagaaagtcttactggggcagctgtcacctgtatcagtacaattctaatatggctccggataggatgcaactacagagcatatataagagggggcacggatctttcaaagaatacgcccaaaggtggagggatctggcagcccaagtggcacccccaatga

SEQ ID NO: 53865 - DNA, 312 bp, Glycine max
  Peptide Sequence Number=SeqID_145550
catgactcaaaagtcaatatgacagatcttgtgagcgcggaagatgacacagcaaaaaataatttttatacggataacaactcgggtatctccgcccgtcagcgtgactcaaatgtcagtatgacagatcttgtgagcgcggaagatgacacagcaaaaaagaacgtttatacggataaccactcgggtatttccgcccgtcagcgtgactcaaaagtcaatatgacagatcttgtcagcgcggaagatgacatagcacagaaagttttgaaagtgaggacaaccacttgggtatctccgcatgtcacgtga

SEQ ID NO: 53866 - DNA, 399 bp, Glycine max
  Peptide Sequence Number=SeqID_145551
atgcctcaaaatgttctttacgatgccattgggatatatcaacggtgcttcttagctctgaaaatctcgataactcaaaaaatacgcccggtagtgatcttatttcattatggtgaaagttggaacctcttacgtgccgatcaacgtctcattttcgccaaaagttggcccagggcttcccggtatcaacagggacaccaggatttatctgttctgcgaagtggcggaggtcttccggtcgtggacgagtttttcgatgcgcaaaggttgtcgggatcaagcttatcgatttaccgtcgtactcgagggtttgagggctccagggttctttttcagcttttgttccctccttcagctactgacggggtgggtaatttcgaaaagcaccttggccggtaa

SEQ ID NO: 53867 - DNA, 551 bp, Glycine max
  Peptide Sequence Number=SeqID_145552
aggactgtacgctcgccatcagagggctgcacgtcctcaccttcagaggactgcacgtcctcaccttcagaggactgcacgtcctcacctttagaggactacacatcctcgccatcagagggctgcacgccctcaccttcagaggactgcacgtcctcacctttagaggattgcacgtcctcaccttcagagggctgcacgtcctctccttcagaggactacacgtcctcgctgtcagaggactgcacgttctcgccttcagaggactacatgtcctcaccttcagagggctgcacgccctcgccttcagaggactatatgtcctcaccttcagagggctgcacgccctcaccttcagagaactacatgtcctcgccataatagggttgcacgccctcaccttcagaggactacacgtcctcaccttcagaggactacacgtcctcacctttagaggattacacgtcctcgcctttagagggctacacgtccttactttcagtgggctccatagccacaccttaagagaatttaaggtcctctacccttaa

SEQ ID NO: 53868 - DNA, 1957 bp, Glycine max
  Peptide Sequence Number=SeqID_145553
atgtccgagcttaatgaaaagttagccacagcctgggaaggttttgcgaaaggtgactggcagaatgaagtaaacgtacgtgacttcatccagaaaaactataccccgtatgaaggtgacgaatccttcctggctggcgcaactgacgcgaccaccaagctgtgggacagcgtaatggaaggcgttaaactggaaaaccgcactcacgcgccagttgattttgacacctccgttgcttccaccatcacttctcacgatgctggctatatcaataaagcccttgagaaaatcgttggtctgcagactgaagcaccactgaaacgcgcaatcatcccgttcggtgcgtataaccgcgagctggacccaatgctgaaaaaaatcttcaccgaataccgtaaaacccacaaccagggtgtattcgatgtttacaccaaagacattctgaactgccgtaaatctggcgttctgactggtctgccagatgcgtatggccgtggccgtatcattggtgactaccgtcgcgttgcgctgtacggtatcgacttcctgatgaaagacaaatacgcgcagtttgtttccctgcagtctgacctggaaaacggcgtaaacctggaagcgactatccgtctgcgtgaagaaattgctgaacagcaccgtgcgctgggtcagatcaaagagatggcagcgaaatatggctgcgatatctctggtcctgcaaccaacgcccaggaagctatccagtggacctacttcggctacctggccgctgttaagtctcagaatggtgcagcaatgtccttcggccgcgtatccaccttcctggatgcgtacatcgaacgtgacctgaaagcaggtaaaatcaccgagcaagacgctcaggaaatgattgaccacctggtcatgaaactgcgtatggttcgcttcctgcgtaccccagaatacgatgaactgttctctggtgacccaatctgggcaaccgaatctatcggtggtatgggcgttgacggccgtacgctggtcaccaaaaacagcttccgcttcctgaacaccctgtacaccatgggtccttctccggagccgaacatcaccgttctgtggtctgaaaaactgcctctgaacttcaagaaattcgccgctaaagtgtccatcgacacctcttctctgcagtacgagaacgatgacctgatgcgtccggacttcaacaacgacgattacgctatcgcttgctgcgtaagcccaatggttgttggtaaacaaatgcagttcttcggtgcgcgtgcaaacctggcgaaaaccatgctgtacgctatcaacggcggcgttgatgaaaaactgaaaatgcaggtgggtcctaagtctgagccgatcaaaggcgatgttctgaacttcgacgaagtcatggaccgcatggatcacttcatggactggctggctaaacagtatgtcactgcgctgaacgttatccactacatgcacgacaagtacagctacgaagcctctctgatggcgctgcacgaccgtgacgttatccgcaccatggcgtgtggtatcgcaggtctgtccgttgctgctgactccctgtctgcaatcaaatatgcgaaagttaaaccaattcgtgacgaagatggtctggctatcgacttcgaaatcgaaggcgaatacccgcagtttggtaacaacgacgctcgcgtggatgacatggcggttgacctggtagaacgtttcatgaagaaaattcagaaactcactacctaccgtaacgctatcccgactcagtctgttctgaccatcacctctaacgttgtgtatggtaagaaaaccggtaacaccccagacggtcgtcgtgctggcgcgccattcggcccaggtgctaacccaatgcacggtcgtgaccagaaaggtgctgttgcctctctgacatccgttgcgaaactgccgtttgcttacgcgaaagatg

SEQ ID NO: 53869 - DNA, 676 bp, Glycine max
  Peptide Sequence Number=SeqID_145554
ggcgaaagccgcaaaccggaattctcaaaaggccagaagacgtgacagacctttcgaaaacgctggaggagctttgtgccgagcgcggcatgcggatgaccgaccaacgccgcgtcatcgcccgtgtccttcaggaatctgcggaccaccccgatgtcgaggagctttaccgccgttcatccgccgtggatccgcgcatcctcgattttggcgcattgccgagaacgtgagtgttcgatcgctcatcagtcacgaggtttcgcgtgatggccggttttcggctggcttagaaccaggctgccagaagagcatcttcgttcatctgatcgagcagaagcgcacaccggcgtcatcgaatttcattcggcgagatcgccagccgcatggccatggaaaagattgcgcctgtcccgcgaagcacgccggtcgctatcgcctatacgcgggcgtgcatggcatgatgtggctgcggacacgctctatattgcgatcgttctcctggatcggctcacgctcgtgccgcattgctgccgctgcaattgctcagggcctggcccttgatgtcgacggcttcgccggccgcattccgttcgcctggacaccgcatcgcgactggccatgttctgggcatccgcttcacgtccacggggatgtggctagcgcgcgaaaccgttga

SEQ ID NO: 53870 - DNA, 300 bp, Glycine max
  Peptide Sequence Number=SeqID_145555
tactgtccccagagacagggtcagggtgatgctccacaggctgcaggcgcgccccccccacctcatcagggctggccaggctggggcatttgacatggagcagtatttacggcatttgggctccgcttccttttcatcccctactccagcccagttcagggcagaggttgcatggcccggagattggcccgaggcccaagcaggagaggcacccccagaagctcccggcgatggagaagaagcccacgaggatgaggagatggccgatttgcttgacttcttgggagggagtggagacac

SEQ ID NO: 53871 - DNA, 1041 bp, Glycine max
  Peptide Sequence Number=SeqID_145556
atgatgcgtatgtctaaaaagacgttaagtgataccattcaagctatcttgattcctatcgaagggatgacatgtgccagctgtgcaggacgtgttgaaaaagccttaacaaaggtccctggcgttaaaagtgtctcagtcaacctcgccaccgagcgagccactatccaagcgagcggagaagtagaccgaaatgccttgattgaagctattcataaaactggttatgaagttccaacatccagggtggagctcaatgtgatgggcatgacctgtgcctcatgtgtgggtcgtgtggagaagagcactcagttacagggcgtagctgagcgtcaaaaagagactgaattactcagcttaaagtgggaccttattgtggcagccgcgctgtcgttacctgtgtttgtgatggaaatgggcgcacacttgataccaggtgttcatgagttaatcatggataccattgggatgaaatctagttggtacacgcagtttgtgttaacaactctggtactggtttttcctggtagacgcttttaccagaaaggctttcccgcgctactaaagcttgccccagacatgaactcgctcgtcgcagtaggtactgccgcggcttttggctattcggttgtcgcgacttttgctgccgggctgttgccacaaggcaccgtcaatgtgtattacgaagcagctgcagtcattgtggttttgatattacttggccgttttctggaggcccgggccaagggccgcacttccgaagcaatcaggcgcctggctaacatgcaggtcaagcaagcgcatgtcatgcgcaatcatcgctttttggatgtccctatcactgaagtggtcctcaatgatgtgctcgaagtaagaccaggtgagagcgtgccggtagacggggaagtcaccaatggtaaaagtttcgttgatgaatccatgatcactggtgaacccatgcctgttgagaaaggcctgggtaattctatagtcggtggcaccatcaatcagaaaggcgttttggagatgcgtgcgacagcg

SEQ ID NO: 53872 - DNA, 712 bp, Glycine max
  Peptide Sequence Number=SeqID_145557
atgatgaaaaatgcgacttttaaatggatggtacgcccgatcttactgggggctgtgatgaccgcctttgcaatgccttttgaagtaacagctgcacctgcatcaaattccagcactttgaatgaaacgtctgttacttaccatactgaagtggttgacggcgtcaaggtgttttacagagaggctggcccgaaaaatgcccccacggtattgttacttcatggttttcccacctcgtcacacatgttcaggaatttgatccctcaactggctgaccgctatcacgtgattgcacctgactatcctgggtatggtcaaagtgaccagccggccatggataaattcaattatagctttgatcatctggcatcgattgtagacaagttcacggttcaacgaggattaagcaaatatgccatttacgtgcaggattatggcgcaccgatcggttatcgcctggcttcggcgcatccggaaaaaatcactgccatcgttgtgcagaatgggaacgcttacaacgaggggataaacaatccgttctgggacccgattaaagccttatggaaaaacaaaactgaagcgaatgctgctaagcttcgcccattcctggaattgaatgcaaccaaatggcaatatattgaaggtcttcgtgacccgagccatgtcagccctgacacctggatgctagaccaggcttacctggatagaccag

SEQ ID NO: 53873 - DNA, 553 bp, Glycine max
  Peptide Sequence Number=SeqID_145558
tttttgttcaacacttgcattgtcaagaaaagttcactgggcaaaaacttgtgctattctattttcttcctctcctccattcttacaaaaagcttttcaagagacctactcttggttacaaacactgaacacaagggaccaacgttccttgggttcattgcaagaagcaggaattgcttcttggtttatcactagacacaaaagaccaacgtcttttgggttcattgcaagaagtgagtataacttcttggttgttatcactggacacaagggaccaatgttccttggggttcattgcaagaaattttacaaggatagtggaaatctcaagcgggttgcttggggactagacgtaggcatgggttgtggccgaaccacgtctcgatacatcatggacctcaggcatatacccgagtcaaaaggtaaagaccatttgattttctctagagcttctgttgttcattttcgagcgtctcgatacatcacgggcctcaagcatatacctgagtcaaaaggtatggccattcgaatttgtcgagggcttccatgttga

SEQ ID NO: 53874 - DNA, 1182 bp, Glycine max
  Peptide Sequence Number=SeqID_145559
atgggtgcggacttttgccacttcggcgcttacgccttcaagacgctgctcaatcatcgctttcagcgcctggccttcggtttcgcgggccacgataaagtcatccagggtaccgtcgagggcggcaaggatttcggcggcgatggcatccagatcctgctcaccggcagccatgacgccaggccagcgcagaatatcaaccgggttgatttcgccttcatcactttgcattttgacccagttcgccgcattcacgagctgtttagccagtttttcattcaggatcagttcgccctgcgcactggcatcaggctcaaaacgcaggttacattccactttaccgcgcgtcagacgagtacggatgcgctcgcgtacaacgggctcgaggctgcggaactgctccggcatacggaaatatgtttccagatagcgctgccacattcgtttcaagccggagaattcatcatgcgtccagcaggtcgtagcgccaatcaggtgcgtcccgtcaccctgacccgtaactatacaaaacacgctgaaggctccgttctggttgagtttggtgacaccaaagtgctgtgcacggcttccattgaagaaggcgttccgcgtttcctgaaaggtcagggccagggctggatcacggctgaatacggcatgctgccgcgtgcaacgcatacccgtaatgcccgtgaagcggcaaagggtaagcagggcggccgtaccatggaaattcagcgcctcatcgcgcgtgcgctgcgcgccgctgttgatctgaaaacgctgggcgaattcaccattaccctggactgcgacgtcattcaggctgacggtggcacgcgtactgcatcgattaccggtgcctgtgtggcgctggcggatgccctgaataaactggttgcggccggtaagctgaaaacgaacccaatgaaagggatggttgccgcggtgtccgtcggtatcgttaacggtgaagcgctttgcgatctggaatacgtagaagactccgctgccgaaactgacatgaacgtggtgatgaccgaagacggacgtatcattgaggtgcagggcaccgcagaaggcgaaccgtttacccacgaagaacttctcaccttgctggctctggcccgagggggaattgaatctattgtaacgacgcagaaagcggcgttagaaaattga

SEQ ID NO: 53875 - DNA, 150 bp, Glycine max
  Peptide Sequence Number=SeqID_145560
atgaagaaacaacaatggaagagaagatgcggcggaaggcaaaggagaagaggagaggggaggcaccatctactagggaataagccaaggaagaaggagcttcaccaccaagaattgccttggataagaagcttgaagaggatgctttaa

SEQ ID NO: 53876 - DNA, 186 bp, Glycine max
  Peptide Sequence Number=SeqID_145561
atggaggtggtagaggtaacggatggaagtgaagacaatgacgatggtgacaatagtggtggtgttggtgaaatggtggaaatagcatcgcaccggcttgatgaacttcaaccagcaagtgatgaagtgatatctcgtagcatcaccggccttaagcttcatatggtggccccatttctggcttga

SEQ ID NO: 53877 - DNA, 288 bp, Glycine max
  Peptide Sequence Number=SeqID_145562
atgagggttcatatcaacatcaatctagtttctaactttgatctaggcattgttggaagttttcctatttgtttgaagttgaaaatatttaaagcatgtctatggtttgctcataccaatcccctgcatttggatgtattcaagagtgttgcatgctttgaggcagaagtggttgcaatgacagctgcacttcttggaagtaaggaaaagaattctggaggacaaatatgtggcaacatgacaccaagcgggactgagtatattattagctatcaagtcatgtcgtga

SEQ ID NO: 53878 - DNA, 408 bp, Glycine max
  Peptide Sequence Number=SeqID_145563
atgcccactgggaggaaggaagccatatcttttctctgggttctatccctccacgacaagagttgccaaggtagtgaaaacctcagcacaagagttggaccgtgtaaagcaaaacagaaatggagtagtcggagtaccaaggaagtgtttggaggaaaagggcaaaggccttggcaaaatcaaggcgaatgggcttcttttattgacatcttggcgcttttgatctttggagtagtcctctttccgaatatggaagggttggtggacctagcagtgatcgacgcttttctcgcctatcataaccacaaagaaagcccggtcgtcgccattttggccatgtatgacacgttcaaccggggatgtaaaacgagtaacgcaagaattttttgttgtgcactggctctctaa

SEQ ID NO: 53879 - DNA, 237 bp, Glycine max
  Peptide Sequence Number=SeqID_145564
ccgtacgactccgcctcctccaaggaaaaagtccatcacatcggccatgtcatcgtcttcctgggcctagtctccatctctggaggtccctgcgggccctgcccctgtctgaaaatcgggccaatctccaggccatgctgtcgcaacctacccttcggcgggagggcgacgcgagactcgcgggatgcgtgttccacgaaaggaatacacgcggagtcgccaccaacgtttatttga

SEQ ID NO: 53880 - DNA, 405 bp, Glycine max
  Peptide Sequence Number=SeqID_145565
atgggtgaagtagaggagatacaagagaagatgaagcctgacatggaggccatgaaagagcgaatggccacgatgatggccatgatgagcaagaggaagataatggaagccaatgcggttacaatttccgctaccagcactgttgctaaggtgaacccgatgcccccatctggcctcaaccaaatgaatcatccaacctcagctatggtaggcaaagatttgggaagtacgggcggcccccatgatgtgcaaattcaaaatgagcacgccttcccaccatatggcctacctcccaactatacaccacccaatgtggcatacactcccaataaggatgtcaataactccactcctatacccattgagagccaacaaccccaaactgatcatacacatgtctcttaa

SEQ ID NO: 53881 - DNA, 1411 bp, Glycine max
  Peptide Sequence Number=SeqID_145566
cgcgcattgcgtcggaagcacgtattcagccgctggtgaccactcatgtgcacacggcgccgctgccggtgatggtgcagccgccagccaccgccaccgtggaggaggaaacgaccgctgcggcaccacgcagccgttccgggctggtgttaatcggcatgttgatcagcgcggtgttgttactggtgctggccttactcgcgccaccgagcgtgaagagatcgatcaaaacctgcagctggtgagtgacagcatggcgcgctttatccagctggccgaagaggaacgccacatctatatcaaccgcaccaagctggctgaccgttacagctggtttatctgtcaaaaccccatcgagcagaaggatgcgttatgggggattactgatgctggcgctggtactggcggctatcctgatttatcagctgtcgcgccagaggcgggacagctggtggtgtcgcatgggcagtggaaagtgcaaaacagtctgtttcaggccaccggcaattacagcggcatgatcagttattactcgccacaacagcaactgcagcgccgcgaaccggtagacgtctcttttgagctgcgccacagcttctccggcgccgcgctgcgcagcgaaaccactgctatctcctacaacctcgctaatcgtgcctcaccacagaatattgaacgctatatctccgccggcctggcgcccggccatgtcaattacggctggatttatcgtctgcagaatgtgcgttatgtgattggcaataatgcgaatccaatgaatagtgctatagcagggttagaagaatcttgctggactgaaccgactcaattaatggttcttgatactaaggcgttaaaattcaatagttataagaaaggtgcagaaagctccctgggcaataggactttattaccccgcatattccctgttatttgtaataagagcaaaatcacgcggcctccgggtaatctttcagatgttctttggttggaaggtgacatgggtccattgctaactccttctgatcagaacaatagattttttgtgccgcttcctccgcggccagacaagcctttggctcatattattaccgatcctcttggggttgttattcctgtgccgatagtttgtaatattaatgaaggtaatgctttaaatgttgagtttggtcgtatggtggacgcagcaatccagttagcgactggggtaaccgatttctccagcgacctgattgctaccagtaataaggatttaggtgtggcagtgtttcaccgtgggcagctaatgaaaccttaccaaccttcacctgtaaagctggttaatggcgaagccctggaaactattacactctcgccggttaaaaggaaaggtgcgaaactttccggtggtgagtttactgcttcagccacg

SEQ ID NO: 53882 - DNA, 450 bp, Glycine max
  Peptide Sequence Number=SeqID_145567
atgctaacatccaaaatctcagttaaggttgtgggggatttcatcaacatactctccttccccgcatgtttgcattttagcgaagaaaacaccgagactttttcaagtctcacaagttatccagaactacgtaggtctgagttcctcattggaggatacgtaggagcaagagcctcgcttttgtcgaccacaccgccttttgttgccatgacccaagagctggtagcccgcggagacactttacggttatccgcgcctcgtcattcagtgaccccaagtgtgattgacgagcaaaggccaatgtggtcatctgcgccctttccggagatgtcagcattttccgatggagacttttcaagtctcacaagttatccagaactacgtaggtctaagttcctcattggaggatacgtaggagcaagagccttgcttttgtcggccgccccataa

SEQ ID NO: 53883 - DNA, 47 bp, Glycine max
  Peptide Sequence Number=SeqID_145568
atggcgttggcttgggcgctgtccgggggtatatgggtgtggagccg

SEQ ID NO: 53884 - DNA, 169 bp, Glycine max
  Peptide Sequence Number=SeqID_145569
ggatcgtgcccgcaagacacctagtggacccgaagaaggccaactgggtcttggagttgccagctctaaatacaggtctctatcagttcaagggagtgcctgttgcccccagcagggtcatcaggccccctaccaatcgagttttcatccagaagtgttgcgcccctag

SEQ ID NO: 53885 - DNA, 573 bp, Glycine max
  Peptide Sequence Number=SeqID_145570
atggctccgaagaagcattccgcaaagagatctaggagggacgtcgcggttgaagggaccagtgccgctcccgagtttgatagccaccgtttcaggagcgccgagcaccagcagcgcttcgaggccatcaaaggatggtcgttccacatagagagacgcgtccagcccagggacgatgagtacacagattttcaggaggagatagctcgccgacattggacgtcgctagtcactcccatggctaagtttgaccctgatatagtcttggagttttatgctaatgcttggcccacagaagagggggtgcgagacatgcggtcatgggtgaggggtcaatggattccctttgacgcagatgccctcagtcagttcctgggtgacccgctagtggtagaggaaggccaggagtgcgagtttagtcagaggaggaacagggccgatgggttcgacgaagaggccattgcccagctattatgcacaccggggcaggatttcgctcggaccgctgcagggaggcgggtgaggatcttgcgcaccagtatgccacccaccagcacctctagactcggataa

SEQ ID NO: 53886 - DNA, 222 bp, Glycine max
  Peptide Sequence Number=SeqID_145571
atggttggatgttgtattacttggatgttgtggaagcttgagaggattgatggggacccggcgttgagaggaacgaggataagggctacgtgggagtacgtgagctcagtgaagagtggtacctggagatatgtggcgggggtcaggagaccttggggacgtcaggtggggtgctattgcccaaaaccaagcttgaccaatcccgacccaacccggacatag

SEQ ID NO: 53887 - DNA, 642 bp, Glycine max
  Peptide Sequence Number=SeqID_145572
atggatttgtccggcttcgcgaatcatgcaaaagctcttgcgaccgaatttgctggcatccgccaccgcgataatctcgcgcgccacctcgcacatcacgcgattgaggtgcgcctcaccggggtgaggcgtggtaatgccggcgctcagatcgaacccgtcgacgcccaaaaacagcttgtcgaagcggtactgacgcaattgctgctcggcggccggaccgtagagcgagtaagagttgcggcgcacgctgccccccagcaccatgacctccaccccgtcgtttcccgaaagctcgtaggcaatgttcagcgcattggtcatcaccaccagatcgcgccgccccttcaggaacggcacgatctgcgtggtggtggagccggaatcgaggatcagcgcatcgccgtcgcgcacatagccggccgccgcgttggcgatcagcgttttgacgtcgcgattcaaccgccccttgtcccgcagcggccgatcgaaagcgaattgctgattgagcatcgcgccgccgtaagcgcgcagcgcacacccttttcgttccagaaagcgcagatcgttgcggatcgtcaccgtggataccgcaaactgtttgctgagctgctccacgcgcacgctgccgtgctcgcataa

SEQ ID NO: 53888 - DNA, 651 bp, Glycine max
  Peptide Sequence Number=SeqID_145573
atgcaacactaccctatcagcacctatgattttgggcaagccctgaaccataatagagaatatagcagtggaattcacggtgggatcgctcaaattaccgtacccgtctctgaaccgcgtaatccgaagtcgctcttcggtgatggagataccgaagtggacgataaccgcgacgaggacggcgaagaggaagtggatccagagcaagggggagcctttggggatgtgagtgatggtggttttggagaagccgtcggcgaggggggcggtgccggcggagaggttgagggggaggaggacggcgagggcgagggcggcgagggagaggaggagggcacagctgccgccctcgatgaggaggaactgcgcggcgtcggcgccgcagtgtcgagcgatttcgcggccggtggcgtgccagacggcgaggagcttcgaggcgagggcggcgggacccggcatgcggcggtggtcgctgcggagcttcacgaggaggaagatcagaaggcagcacgcagagccgatcgcggatatgttgagcaagtagtcgatgttgccgtaccaggtgccgaaggggtcgccgtcgtcaccggaggacgacggcggcggagggagggggtctcccatcggaaattagggttctcagaagtctga

SEQ ID NO: 53889 - DNA, 86 bp, Glycine max
  Peptide Sequence Number=SeqID_145574
atggcagcggaatggagaagaaagagagagaggagacgccacttcaaggagaagatgagtctagaagaagttcaccaccataggag

SEQ ID NO: 53890 - DNA, 174 bp, Glycine max
  Peptide Sequence Number=SeqID_145575
atggcaaaggggtgcggaatgaccataatttgtctccgcatgtcatcgggcccgccgcctctggatgacaaaaggggtcagtatgacagagattgtggggcggccaacaaaagcaaggctcttgctcctacgtatcctccaatgaggaactcagacctacgtagttctggataa

SEQ ID NO: 53891 - DNA, 860 bp, Glycine max
  Peptide Sequence Number=SeqID_145576
cattgtatactcccgcgggtcggaaggcggcgggggaaggaggaggacactgggcgggatctatcagcagcgaattccccatacagatagaggcgcctatcaaaaagatactccgaaggcttcgggatcgaggtatcattagccgaagaagaccctggccaatccacgtggcctgcttgacgaacgtcagcgacggagacatcgtaaattggtctgcgggcatcgcgataagtcctctgtcctactacaggtgccgcgacaacctttaccaagtccgaacgattgtcgaccaccagatccgctggtctgcaatattcaccctagcccacaagcacaaatcctcggcgcggcatataatccccaagtactccaaagactcaaatatagtcaatcaagaaggtggtaagacccttgcagagttccccaacagcatagagcttgggaagctcggacccgttgcggcagcttccgcgccagcaagatacggacggcgaagccaaagcaatactaaacaagcgagaaaagccctatctattctattagtcaagcctaaacttattgaaaacgaaagcgctaacgagcaagaaaacgggaagggtgtgataccaccacctatcaggcccgacgagcggtccacggagctgcatccctactcacctggtccatgcacatcgctctctccaggaggttggccgcctatcctagatcttcccattttcaagaggatcccgggctcgatctggtttagtatcaaggaatttccctcttgcttgagtaatgggaagcgggctagtccccgaaaatgcccgttcgcttgtcgttggggatccaaatcttacttgctgaaactgtacttgtag

SEQ ID NO: 53892 - DNA, 639 bp, Glycine max
  Peptide Sequence Number=SeqID_145577
atggcgccagcccatgtacagcggatcgttgaggcgctgtgggttgttggtgccgacgtccaacactaccggcagggtgtaggccgggctgatgccgccgcaggcggtgtacagcgacagtttgccgatcggaatgcccatgccgccgatgccctggtcgcccaggccgagaatgcgctcgccgtcggtgaccacgatcaccttgacgttctgcttggtggcgttttgcagcatgtcatcgatgcgatcgcggttcgggtaggagatgaacagcccgcgcgcgcggcgatagatatcggagaagtgctcgcaggcctcgccgacggtcggggtgtagatgatcggcatcatctcgctcaggtgcgagtccagcaggcggtagaacagggtttcgttggtgtcctggatgttgcgcaggtagatgtgcttgtcgttatcgttcttgaaatcctgatactgacggtaggcgcgttccacctgttcttcgatggtttccaccgcttccggcagcaggccgtgcaggttgaagtggctacgttcttcctcggtgaaagcgctgcctttgttcagcagcggaaattccagcagaatcgggccggcgtaagggatgtagagcgggcgtttgctttcgtattctag

SEQ ID NO: 53893 - DNA, 225 bp, Glycine max
  Peptide Sequence Number=SeqID_145578
gtcgactctagaggatccccttttattgagaagtattgcacacagagacaggcccagggggatgctccgcaggccgcagacgcgccaccacctcatcaagctagtccagccgattcgtttgatacggagcagtatttgcggcatttggttcgccaggaggcggccaaccaccaggctcatgtacaaactcatgattgtctttaccagatgagcctcagcctgtag

SEQ ID NO: 53894 - DNA, 180 bp, Glycine max
  Peptide Sequence Number=SeqID_145579
atggaggaaagaaaaattatggagaaacttccagaagaagagaaggctaaggatgagactcttcttcaacaagcagtgactgagtctcaaagttttcccaaagaattactgggagctaagtgtcaaagaagcgtggtaatcacattacaggcaaaggcactgtcatgggaagacagataa

SEQ ID NO: 53895 - DNA, 201 bp, Glycine max
  Peptide Sequence Number=SeqID_145580
atgtacatggtaacattgcagggttcgtttgtaccccatggtcggcaagacataactgaacatttggctgccattttggacgacctgaccatgggggtcgcgtatcgggcagcaggtcaggtgtcactattactcagtactacggaagggcatcaaggacatgcagcagctcgtccacgtccatcagccaacaacaactag

SEQ ID NO: 53896 - DNA, 531 bp, Glycine max
  Peptide Sequence Number=SeqID_145581
atgcaatctcagggacttgcagtgcctcctgagcctctagtcctcaagtgtggcttgtacatagaagcagatcctgcccgccaggttgccgtggggagagtttatgagggatccactgttgttcataacactcatttattgcctggccaagtaaaggtgagtgtggaggaggttacagatgcagatgctccagttcctgtacccactgatgaggtttccttagtggggcaggcacttcacaccttccttgcttggccgacacatttggtcaagtctttatcacagcaggtagctgtgcctccggcaaaaccacctccgaagcccgatccggaggtcgatgatccgctttatctgatgacattgaccatcccagagcttttcttgaggccttatcaggttagatgggatgccactgtgttcggggtctttaatccagatttccccctctacataaagcacgaagacctctccaaaatcgcacacggtggtcaatgtctcagcatatcagtgttacagttgtggattctgtaa

SEQ ID NO: 53897 - DNA, 404 bp, Glycine max
  Peptide Sequence Number=SeqID_145582
aagtggttcttccggaaacactccggaagaagggttcttccggaaaggtcttccggaagtttgaaacttcttccggaagtgggcgtcttccggaattcttccggatgaaccacttcttccggaaagttcccggaagacgttttccggaagtcttccggaagaagtgttctttcggaagacgtttggttacttccggaagaacacttcttccggaaactttccggaaaacttactatcctaaggttccactgctacaagctataacaatgttgtatcaaaggggagttagggagactaacctcgttcgcggagaagaagaagacgacgttcgcgcttgccttgccggagaagaagaagcagttcgcggagaagaagaagcagttcgcggaaggaatgaggaatga

SEQ ID NO: 53898 - DNA, 324 bp, Glycine max
  Peptide Sequence Number=SeqID_145583
atgggagttggtcgtggaggtaatcaagaagaggctaaggtcttgggctacaaaacaattgtctttgggtggaagagtattggtgatgagaatcctgaaactggccaaatacaggctaaaggcccaagtggagaagggcgaaggcccaatttctctctgggttccttgttgaaccaatctcagacttatcaaggtaatccttgtggcgtctaccctgacttatcttccttcaccggaagaggcgtctaccctgacttatcttccttcattggaagtggcgtcatccaaatctccatagcctgcatcaaacgttctgccccataa

SEQ ID NO: 53899 - DNA, 228 bp, Glycine max
  Peptide Sequence Number=SeqID_145584
atgtgggtgtcgagggagcggtttccgacagttttcaggcaggaggagaaagagaagagcgatttcaggcaggaggatgacaaagagaagaaggagggcaagaaaacttttttttttagtagtgatcgctatcttccgccacatgcacgaccaagatgtggccacctgcggttgccgtggaactggaaccggaaggggaggagttttgagagtttggagcaaaggtag

SEQ ID NO: 53900 - DNA, 174 bp, Glycine max
  Peptide Sequence Number=SeqID_145585
atgtatcaagagaggactagtttagaggaatactttctcgaggcatcaactctcaaaagtaaccaaggagtgatggatggacgaaatgattgtgcgatagctgatgctctccaagccttagctcaggctataaggaatccctataggggagaagctgctggagctgttgagtaa

SEQ ID NO: 53901 - DNA, 414 bp, Glycine max
  Peptide Sequence Number=SeqID_145586
atggccctacaaattggccaccaaattgattgggctcatcttgttcgctaccatatgcataaggcattacgggtaaatgcacctctcccttatccccacctagttactctgattctacagcacttcggcattcctcttactaatgaaccttttgtcaaggttaaatgttcatttgccattggagccactgcagttgaatcctttgggtataggaaagatctagacggtcaatgggttcgtaaacaggatctcccaactaatgctccggatgaatgcattccatctccaccaccaagagatccatcctcttcattactgaatgatatccttagtgagcttcgggatcttcatgcctttgcggagaaaggtttgattcaatggattgacgaatcatgcaatatgaggatgacatga

SEQ ID NO: 53902 - DNA, 279 bp, Glycine max
  Peptide Sequence Number=SeqID_145587
atggagagaattgtcatgctgtttggagcatttggcagaacagaaattttggattacattaggttgaccatgttcactgagtcccagtcccagtctcaggattattttggagagtgcggctactatgtgatgcattggatgtccaccatcattttaggaacttttaggaataattgggaagcgtattttaatgatgcaagaccattggagccagaaagattaaaagcattgcggattcagtgggcacagttttatctccgagttagagatcaggcctag

SEQ ID NO: 53903 - DNA, 90 bp, Glycine max
  Peptide Sequence Number=SeqID_145588
atggcagctctcccagacgagctgagacttactcctgaagtaactggctcgcccaagcgagttgcaactagcccaggcgagctggtataa

SEQ ID NO: 53904 - DNA, 297 bp, Glycine max
  Peptide Sequence Number=SeqID_145589
atggcattagaagagggaaaaatgaagatcgagaagttcgatggcagagatttcagcttttggaagatgcagatagaggattatctatatcagaagaagttgtatcagcccttatcaggggttaagccagaagacatgaagcaagaagaatggaacttgctagatcgacatgctcttggcgtgatcagattgacattagccaagaatgtcgcgttcaacatcatgaacgagaagactactgcaggcttaatgaaggcattatcagatatgtacgagaagccgtcagcagccaacaaa

SEQ ID NO: 53905 - DNA, 513 bp, Glycine max
  Peptide Sequence Number=SeqID_145590
atgtgggacaaaggaactaagaccacaaactctaacatcaagttgatccgcgagtcttccatggatcaccttgatccgtatgttgattttacttctatggatcgagtttggtttatggatcaagttgatccatttcaggaaaatccagaagatagggtgttgggtcatgctcggaaggtggagggatcaatgaggaagaagacgaatgcaaggaaagagcagagaaagagcaaagaggagagaatggctatagaacaaaaagagagggaggaggagttgaaacgcttaaagaatttgaataagcaggaaatacaggaaaaggttaaaaagataatgaagactgcagggatccatggtgatgatattatcccattgtccagggaagaaattgaagaggaatttgacccacaggagtatgatagaatgatgaagaaggcatttgacgagaaatattataatgtagaggatgctgaccctgacttttgtagtgacatgatgacaatgagaagctag

SEQ ID NO: 53906 - DNA, 889 bp, Glycine max
  Peptide Sequence Number=SeqID_145591
atggttaagactagaggattaggccgtgcattaggtagggttggtgccaaaggtttggggagaggaggggatggtgatgatactgatgtcattcttgacgatgatgtgcctgtggtgcctgcgaactcgcctgcggtaccagaggcagaggctgctgtagctggggatgagcccatggtagatgctgccacacaggacaccggtgcagagactgacgcacaggataccggtgcagagactgacggggacgagcttgagggatttcttggtggacccagggacccattagtgcttacagagtatgctgaccatgttgcgggcagcgtatggtctggacaggaacatcttgagttgaagttatgctcccatgggaggaaggtgcataacttgggcaggtctattcctgcaattgaggacatggttgctgggacaggattaagtcctttgatcgcgtgttcaatagacaccggcgatcggggacttatatcctcctttgttgagaggtggcaccgggagacttctaatttccatcttcctgtgggggaggtttcgatcacgctggatgacatcgcgtctcttctccatctgcctatcgttggcgcattccatgacttccagcctttgtgcaccgacgagacggtgttgctgttggttgagttactgatggtctcagcagagcactggacagttgccgctcatgcttatcttctacatcttttgggttgcactctttttgctaataagagtgcaacccatgttcatgtcgcacacatacaggccctacgtaacctcactcttgctgggcggtatgcatggagagctgctggcctcgtccatatgtacaatcaacttaatgatgccagtctcagcaccagccgacagtttgctg

SEQ ID NO: 53907 - DNA, 357 bp, Glycine max
  Peptide Sequence Number=SeqID_145592
atggttaggtggataattttaaagaacctcgcgctagaggatgctgagacacaacactatgatatgatgtgtctaggtagattcaaggttcagaagcttattgattttgataatatcacaagagaaaatacaacattaaaaatatatcatggtcatcttagtgaagttgactctagaagatatttccaacaacttattgacaatgtagattattgccactgtaacggagtttatcacatagatttaaagcttgaaaatcttttacttgattcactaggaaatataaagattttcgattttggtttaagtgcatttcctaagcagatgaacttgttgccaaataacttttatatatga

SEQ ID NO: 53908 - DNA, 468 bp, Glycine max
  Peptide Sequence Number=SeqID_145593
atggccaaaaattatgaaagcgatgaagaggtttctttgaagaagagttggtacatagatagtggatgctctaaacacatgacgggagatgcatcaaagttcactcatatttctcccaagaatagtggacatgtgacttatggcgacaacaataaaggtataatccttggagttggaaaaatagaatctatccatgttgcttttgatgaaactaacctaattttgccaagaaaagatactctagatgatatttcaaattctttagaaggaatgcatattcatggtgaagatcacaaaggcaaaggaaaaggaaatgatgaagactttcaaattgatgaaacaaaatcaagtgcatatcttccaaaagggtggagaacttctagataccaccctcttgataacattatcggtgacatatctaaagggaattctctcaagatatgcaaaatgaatttggaatgtcaatga

SEQ ID NO: 53909 - DNA, 504 bp, Glycine max
  Peptide Sequence Number=SeqID_145594
atggcagaatcctcaaagaagagaaagggatcctcctccaccaccaccgctgtaggccaatgtcgccacgacacatccggtgacccaccagcaccaaatcctccttctttttcatctcacaggtcattaactttgttttcttctaatgaccagcatcaaaggtactattcccaattctccaatcgtgtcattctcgatcctaagtatttagatgcattactggccaatgcacattttctgtatcctcatcttgttactttgtttcttcaacatttcaatgttcctttagaggatgagccttttgttaaggttaaaagatcttttgctattggtgctggtgttgttacttctttcggatactggaaggatatggatggccaatgggttcataagcaagacctgccacctcccattctcgatgaacacacaccctctccaccaccgcaacgagatacctcttcctccttattgaatgacgtcctcattgagctacgggatctttga

SEQ ID NO: 53910 - DNA, 129 bp, Glycine max
  Peptide Sequence Number=SeqID_145595
atggttgattttgaaccaaggaaaaaggttgattttggtggaggagactttctagagaaagctagtgaaaagggtcctttgaaggatacgagttccttatccatttcgaaggggagcacttacatttga

SEQ ID NO: 53911 - DNA, 414 bp, Glycine max
  Peptide Sequence Number=SeqID_145596
atgggaacaattaatacctttggagtggagtttgatgcgggtgcatcatgtatgtcaaagctttgccaagagcttggtttcgttaaggtcgccttcgacgatgaagacatcatgcttggatacgtgggagccgacgaagccaactgcgccgatgacgagaacggacatgttgccttgacggtggatatgggcggaggtgtggacctgcttctcccactggatcccgccctaggaggcggagaggtagaggctgccgaaatcaatgaaccattagaagttgagatcaaagccgaggaacttgaaggagaggactttggcggtgacagtgaagcaaaagagggaggcgagggtttggaggaagtgagggtgacagtgagagtgacagagagggtttggaggaagtgtgaaaagtga

SEQ ID NO: 53912 - DNA, 357 bp, Glycine max
  Peptide Sequence Number=SeqID_145597
atgggattatgtaggaaagaggttcctatagtggaatggtatagaaccaaggttgtgcctgacactgaaatgatcaaggagtttctgtcaaagtacagtaccacatctgggaaattgtggcagcaacaacaagggaccaaacatttcattgggagaggcttgttgatggcaaatggtgaagattggcgccaccaacgtcacatggttgcccctgcattcatgggagacagacttaagaactatgttgggcacatggtggaatgcacaaaagatatgtttcaatcactacaagatgcattagagggtggccaaactgaggtagagattggagagtgcttcattgaatctcaagagtga

SEQ ID NO: 53913 - DNA, 531 bp, Glycine max
  Peptide Sequence Number=SeqID_145598
atggatgacgcagctgaagaggtattccaacatgcagaagaagtatttgatgatgccaagggttttccaagtgggtcgtgtgacccatcaatgctgactgcctatgctgatcatgttgcagtcattgtttgtaatagagaggaacgtcctaaattgaagttattttcccatggaaggaagggacttatattggcttttgtcgagaggtggtataaggaaacgagcaatttccatcttccagtagaagaggtcaccatcaccctcgataatgtggcctctttgcttcatcttcccatcataggtgcattccacaacttcgagactcttcatgtcgacgaagcggtgttgatgttagtcgagttacttgaagtcggtagagatgaagctagagctgagacagtacaatgtcatagggcatatgttgcactcttttttctaacaagagtgcaacacatgtgcatgtcgtgttcttggatgccttttgagaccacagttagagtggaacctgcgcatggggagctgccagcctag

SEQ ID NO: 53914 - DNA, 387 bp, Glycine max
  Peptide Sequence Number=SeqID_145599
atgcactatgtagcaggcaatgacaacattgtacctccaaaatggattgtgttgaataaagataaggccaccacacagctgcaaatgttcctaaaaccaacaaccccagtcttgacacctcaaggattggatatttatgtctcaggcattgccaagaagatggctgaaaaaagcagggaagctggaaagaatatcagggaatcagatgataatactgtccacctcatgagtagttttctacagaagaatgaaaaaaatgagaaaaaatgcccatccaagataggactcatgacctctggaagcgaaaagaacgacggagtccaggtggaagatctaagaatgagtggcggagagagaattacctgcggcggagatcgggaaagttag

SEQ ID NO: 53915 - DNA, 261 bp, Glycine max
  Peptide Sequence Number=SeqID_145600
atgtcttcaagcattatccatgcgccgccttcatcgcgacctgacataaatattgcgctctacagctgctccacatcagaaggtgcatgtgcaggtgcttcctccatagttgttgctaccatcgggaactcaggaatatttggttccacatgtctcatcttgcacgataggtggatgtctaggcggatccctaggctatgtctgcgtcatgaatggatgcaaaatcatgtagaaccagtggatgtagtccgatgcatgtaa

SEQ ID NO: 53916 - DNA, 390 bp, Glycine max
  Peptide Sequence Number=SeqID_145601
atgacaccaccaccaccaatgtctctatcatctcgtacctctgatgtggaggatgacgatctacccaacaccattgacggactcgttggcagcggtgggagggaggtcgatggggtcgcacatagatcaagcttgggtgatggtgtttggttcatggctgttgtgtttgcttccattggtgacaagattggggacgttgatgttggtggtatgattgtggtcgtagtgggatggcatgcacacaatgatgtggtgttggcggtgacccgacaacgacaaggtgacatgaagtggtgtaatgatattgttggtatggtggtgatagtggcgcaacgcgacattggcatggtgatggtaggcttggtggcgcatggtgcaacagtggattgg

SEQ ID NO: 53917 - DNA, 276 bp, Glycine max
  Peptide Sequence Number=SeqID_145602
atgtatctaaataacctcatcactagggatagaatttcaggaaatgaccttgctcctttggatatagagattgaaggaacttgtagaagaaacaacgttgcaagaagaatgagagaacaacaagaggtgcaggccaatcaagggccatcatcctctatatcatcttcctttttccctgtgatcaacccacatcaaaattttgaagaacacattatggaagagggccaaccacaaaggatcactctagaagactactctagttcctctacaccttag

SEQ ID NO: 53918 - DNA, 402 bp, Glycine max
  Peptide Sequence Number=SeqID_145603
atgggcttcaatctcgagctggccaagggtcccaggctccctgtgcagaaacaacctgagagaggaatgcctttggtgtcatcactggctactagaaagataatcagtgaaggctctgggccaagagatatttgccatggtggaggctctacaacatggggaagaactgctttggttgagaagaagaaggccagcgggaaagccgagtctggacgtactggactgggctatctgagtaatttgcaaagaaatcatgatgcccatgtccatgtctatcttcatcacgagcccatatatcaggcgagcccgatccatgttgagggtggacgtgtgggaggtaagagcgagcctggccgcaatggcctgatgattaggatagatatggaggtactaggagtatga

SEQ ID NO: 53919 - DNA, 376 bp, Glycine max
  Peptide Sequence Number=SeqID_145604
atgactctaacaaattcatttgaaagggagaaatgtgttggagcaaggattaggtgcaatgaaggtgaaggtgcattgcagtggtcggcggtgacaaacgaggtacgcagaagatgctgcgtttgtcgcgaacgtacagatcactttcggatcaagttgatccatgagtggatgtatgaaataatgtctgaacgagcgaatatggattacgaaaatgcagaagcgtgtggtgtgaatgaaccacatgttgattgtttggatgcgttcaagactcctcaggtgtttgagtgccgagaggatgttttgcgatgggctcgatccgtgactcatgaaaacggatttgtggcagtgattttaaggttggacacaaacacag

SEQ ID NO: 53920 - DNA, 1479 bp, Glycine max
  Peptide Sequence Number=SeqID_145605
atggaaacacaaatgacatcgagggagaagagtgcttacctcgacaatgtcgacgagctgaagaagaagaagaagaagaagaagaacaaagcaacgggccaagaagcagaggagaagacaacgccacataatggaactgggccacagggtcgtagaagaaggaagaaggtcgcggaacaagaagaagaagcacaaaagaagaatgaaggaataatggaaagatttcatgaggaagaaattgaagagccagtgagtccaacagggcaatacttgacaagctcttcactaagtgtgtacattcttggtgtcttggaaagtgaggttcccattgatgactctcaaaccgtgccacttcttcagaatctcttccttcccatcaactcacgtttctcctccatcatgattagggacaaaaatggggagaagaagtggaagaaagttgaagttaagctggaggaccatatcaaagttcctacatttcccaatggcaagtcatccaacttgttcttatatgatgaataccttgatgagtacatgtccacaatagctgtggaacatttaccacaaaataggccactatgggaacttcacattataaaatacccaacaagcaatgctaagggtaccttggtgttcaaactccaccatgcccttggggatggtttttctctcatgggtgcccttctttcatgcatgcaaagagctgacaacacctctcttcccttcacactcccatcaagccaaaggcccaaagcatcatcaatttccaacaccaaagggtttttcaagaaattgccctccattttcttccaaactatatccgaatttggatggagtttcttgaaaagtaagttgattgaagatgatcaaacaccaataaggtcttgtgcggaagacttcaagactcgccaaatgaccatctcagatgtcaccttctcattggatcttatcaaagacgtgaaatccaaacttggagtggagatgattgagaagaccaatagtcgttctgcatgggggaatcaatatgcctttttgcatgtttcaattccagagcttagtgactccaaatatgcaaacccacttgagtttataagggaagcccataaggatatgaccaaaaagaaaaattctttggccactcctctcactggcatgcttctagatatgctcagaaaactcagaggtcctgaggctgcagctagctacttacgcagtactttgagaaactcaagcacaacaatctcaaacatcattggaccagtggagcaaatggctgtggctaatcatccaattaaagggttttacttcatggtagctggttcacctgagagtctcaccatgacgatcatgagctacatgggaaagataagaattgcatttggagtagagaagaacttcatcgacaagcaattattcaagtcgtgtttggagaattctcttgagatgataaaggaagcagcaaaaaagatttccgcataa

SEQ ID NO: 53921 - DNA, 519 bp, Glycine max
  Peptide Sequence Number=SeqID_145606
atgagtctcagaggaatgagagacctcccaagaccctttggtattgaagaaattttcgagaatacgaagaacatggttgaagccaacaacatcatgcaaaacatggcttggggaagtgcttcctcctcccatattccaagccaaatcaccccaactcctaacaataatgggagggtgtatgttgcaaatccaataaatcagtttgatggagctagtaaacatggaatgaacatgcaacaaattaatgcttgctttggttacattcccacaatggctcaagaaagtactaattctacttcctcatatccaaggcaattcaattgcttgcaaaacatccctcaaagccaacccatatttgaagatttaaagccacttgattataagaatgagatggtagattttagttatcaagttgatgtgccactagattcaactaatcaacttgttaatggtgatcttgtgggtttggacaataaacctaacgaatctatcttgcaaaatattcctgttcaatattag

SEQ ID NO: 53922 - DNA, 222 bp, Glycine max
  Peptide Sequence Number=SeqID_145607
atgggtggttgtgccatactattgcagtcatgggcttggtaccgcatgccttttattgcaccaagagtcccacgacccgaaacaacttttccactggctaaaaaattatttacatatagcgaaatatggagtggtggtagattagaatatagggccacacctcatggtgacttggtcggatataggtctcgtatagatcatatggagagtcatgaggtttaa

SEQ ID NO: 53923 - DNA, 276 bp, Glycine max
  Peptide Sequence Number=SeqID_145608
atgttttctgggttgaatttgaatcaggaaggagagaccctaatagactctttggatctaggccttgcgggtaaatacacccggtttaagtgttcctttaagcttgtgccgatcccacatggttggagcattctcgcaaaacagtgtgaccttgacttgtctccctatgattttacctacgcgccgccagctcacccagcgagtcgtttgtctcttctcgcgcttagtgagccaatctcgctaagcaagccttcagaagttgaaacgtccaagtag

SEQ ID NO: 53924 - DNA, 1281 bp, Glycine max
  Peptide Sequence Number=SeqID_145609
atgcattttgcttctatgctatttttgccctcatctctactcatttaccttagcaatccaaaggtcgcctgggaaagatatgagcagaacgttcactcccggaacatccttccaaagaggaacgttactttatatgttatagagtacgacgagttccgccgggaacttgagaggaggcgatggcataaagccttgaccaggcagcctgatggtcgcattgatgtggccctagtcaaggagttttatgctaatttttttgatccagaggagaagtcctcgaggcaagttcaagtacgaggcaagctgattaagtttgacggggagacgctgaacacattcttagagacccccgtggttttcgagccaggggagcgctacttagcttattcaaggttctgccatacgcatctagaccctcaggagcttgctttaagctctgcattccaggggcacggttttgttctaaatactgaaggagcaccctggaagctcttgaggaaggatctcaccactctggtgcagacctggagcatcctctcttattctaacctcgcctccatctctaatacgtctgatcttaatatggacagggcgaggttagtgtatggattggtcacgaatatggacatggatgtgggctcgttcatctctagacagatatctcagatggcccagtccaactcctccaggcttggcttccctgcccttatcaatgccttatgcatcgccaggggagttgttccagactcgttgaccttcaagtcccttagccctgccattaatttggcttacattagaaagaactgctggaacccagatgatcccacaatcacttttccagggacccgcaaggctcaagctcgggcaccctcagacgcttctgctccttcctcctctgctcctacttctccagcacctacaccagcaccaccagctcccgctccaacaccctccggcacctccgctcagagcacagagatcttagtgtcgatgctgcagagcctccaccatggcttatgcctggtgatgcagagtattcacaacttggctcagcatcgacccattattagcatggaggatttcatggcccaggtggcctggccaggagtccagccttctcctatgggggaaggtgaggctcctacagcccaggagctgcagccagaggtcgaggcagaggctgaggaaacgcctaaggtcacacctgctaccactaaggaaggagacggcgctgcatctgccgattacattgcaaatatggcagcagcacaaagcacctag

SEQ ID NO: 53925 - DNA, 540 bp, Glycine max
  Peptide Sequence Number=SeqID_145610
atggatgtgaacaccatgttaatgtgtaatgatcaattttcatgtgttggaccgattgagttgttatgcactgttggtagaacaccagatgcaattttaaagttacttgaatgccccaacatccctactcatgatgcggttctgtattacaacggaaggtggaaaatgccatgccaaaacaactttgtgggttacgcgttcacaggaataaatccccaaaaatttgatattccaaaaggatgtaccatagatgaactgaaggatttaatcaagcaagtagcacctaaagggaatcctcctcatgggattcatgaatcccaacttgtaaggcgtttgttttatcgacaacctgctcatttggaatattctgacaaagttttaaaatttgaaattattgagctgaaatctgacgacgacgtgctgaaggtgttgttagagtccaattactggaaacaatttgtgccaatagaaattttggctctgtttagtaaagtggttttggaaaatgatgacgaggtggttacgtccttgcatttttga

SEQ ID NO: 53926 - DNA, 333 bp, Glycine max
  Peptide Sequence Number=SeqID_145611
atgctccaaccatatgagatcagcataggcttaaaggagcactcaaacccggtgacccccaaggcctacactccgaagagtctgtcagggcctctccctcctgattcagggttttcctctaagctcagatattattttgaaattcccaacggtgagaatgttcggaattgggttgcgaacatgatactcaaatttcacgacgatccaacggtgaacgggttcaagatcgtcatttttctgagaatggtttggtgggctgcgggaaaaagaaagggttttgagaggagaaggggaaaaacgaaaatgaggccaaaaaggagacaactgacttaa

SEQ ID NO: 53927 - DNA, 741 bp, Glycine max
  Peptide Sequence Number=SeqID_145612
gaatcggggtacaagaacttagttgtgtatgtgtgtcttaatgcggtcttggttgagtttagtcttacaagaggaatctgcggacgaggcttgatcaggactaggctaggctatcatgaggaattggggtctagcagtccaggagacaacataggaacgggtaaaatgaatatcttgacgacacacgatcaagagtgggaacaggagttaagtccttacaatcaatatgaagaagaaagaactcctaatcttgaaagtgtgttcgaggaattcatggcataccatgcgagctcaaaagctaatcaaaactcaatgaaaaatcatgaaattcattttggtaagagctactcaatagaaaactttcacgggggaccaaagttacaaccttaccatcaaaatgaagcagaaagaggatccaatctggataaattgttgatgcaattcatggaaacaactaaatcaactcaacgagcactccaaagtgtagaaatccaagttggtgagctggcagaagcagtgactcaatttatggtcagacaagaaaaatcctttgtagaggttgaagctcaaaagaaaagccatgtaaaagagcatgagtcaagagaaaaagatgaggagaaagatggggaacaagcacaacaacaatgggagaagtactcaacagtagaaaaccaacaagaaaatattctccaaagcaataaccttcctcatcaactgattgacaagaaaggaaggcaatga

SEQ ID NO: 53928 - DNA, 837 bp, Glycine max
  Peptide Sequence Number=SeqID_145613
atgagcaccacatcttcaaccgcatcaactgagatgaaaaatggcatcatccgaccaccactgatcatccaatttatcactgccttcaacaatgacaagaataccatacaacttccagcgttctatcatacacaatgggcaccaaactatcctgagtttgttcatctcagatataatggagccatttatgaaatacgagtcagacaacacaaagacaaagtgtatttagcagatggactccaaaacttccggaaagatttgaaaatctatgagtcaaccagcatcaacttttttgcatgtgaccatcactctgtttttgacatacatttcataccaccactggagcggcaaacttgcggcaggcagaggcattcatccagaaagcacatctggactcttcaacttactcaggaaatgttggatgatcctgaacccctgaaactcccacattgtacagaagttcctcttaaagcttgcggtaaccacatgacagtcttaaggcgacatggccccccactgcaatggaaagttgaaaccctgaatcctgctattggtggaaaaggacaaccccaaaatctcctcccgaaatgcgccgtcgtgaacgttgttcacaccaccgccaactgctctcaatcacaaataggcgacaatgcagcaccaccattgacactgctgctcgcaccacgatcaccagacaagtttctaatgccgccaaatgaagaaccttcaaatgacaacatttccaaggagaagatgaagttgattttgctaccaatcgtcacatatctaacctcccaagccatgtcacctgacacatacacaggctacaaacactga

SEQ ID NO: 53929 - DNA, 336 bp, Glycine max
  Peptide Sequence Number=SeqID_145614
atggaggccctgaaagagcaaatgatcacaatgatggaggtcatgatgagcatgaaaaagataatggaagtcaatgtggctgccgttgctgctacaagcactgttgctgaggtggagccgactcccccatttggcctcaaccaaataaatcatctgacctcggatagggtaggtcaaggaagcaaagagttgggagtagataagacaacactattttgctttttgttatgccatgatactagtgcagaaccaatagagtggcaagtcccactagtgttttttttatcaggtttgaatccagcaaaatcagaatcagagtattctactaagttgtaa

SEQ ID NO: 53930 - DNA, 759 bp, Glycine max
  Peptide Sequence Number=SeqID_145615
atggcacatgctgccaattgggtatcggtccttagtattccttcaaaagaatttatgttgcaaaagggaataacacaaggtgatctgttagctcctttccttctcaccataacgacaaaaggcctaagtgacttgatgagggaagtagtttcaaaaaatcaatataaaggtttcaaagtggggacaaaggaggtggagaggggcttgtgggagagggttttgaactcaaaatattcggggttgaaaggtttgggtgagggtggtgtgagatcccatgaatctatttggtggagagatttaaaattgaaaattggagatggacctcttggaattgttgtagactccagatcacatgaccagctttggcattttttaccggtgcttgcatttgaaggaggaactagaagaaatatacctaggtttgaggtggtaaaagcaaaccctggaatgaatccagagctgtcatgcactgatgacttaactctgccttttattttgtttagccagtggaatagcagcagaatttggtggcctaaaagatggctatatgttcccatgtacaatgggtctctcaaggatgtatgtatgcttctcaactctcccacatgtccagtacttgatggtttaggacaagtttgggtcaatgcaacatctccacacacaactattcttgtagctaatgaaattatgaactcagagacattgagtggtactcagcagagaataatgggtgaaaagctgctgcagaggatccagtga

SEQ ID NO: 53931 - DNA, 339 bp, Glycine max
  Peptide Sequence Number=SeqID_145616
atgtttcagtactttacggatcaagtgatccgtaagtatgttacggatcaagtgatccgtaagtatgttacggatcaagttgatccggaacatgcttatggatcagatcgcgttctacgccatcgctggcaacaatggtggaaaaaggacagggtcacagtgcttacctcgacggtggacggtcacgaagctccctcgacgtggacggtggcgttgctcttcgcggaagcctcctcaatgcaccatgacaacctcctaatcacggcaacaatggcggcaacctcctcaacgaagaagaagaagaaatcctctaaggtgaaaagaatgaagaagaagtag

SEQ ID NO: 53932 - DNA, 1299 bp, Glycine max
  Peptide Sequence Number=SeqID_145617
atggttaggaccagaggattaggtcgtgtcttaggtcacgttactggcagagtcattgtgactgcgacgcacgatgagccagtggtccctgcgccagatgttgaggctgatgtatttccggatgagccgatggcaccagttgattctgaggatattgtggcaaacattcctatggacacaggcgcggaggctactgaggatgagcatgagggatttccgggtggtccgagcgacccatccgtgttgacccagtatggggaacacgttgcttgcagcgtatggacgggagaggagcgtcctgagttgaagttatcctctcacgggaggaaggtccatagtttaggcaagcttgtccctgccattgagggactcgttgttgggacaagactaagtcctctgatcgcgtgttcggtagacaccgacgatcagagacttttgtcctcatttgtggagcggtggccccgggagacgtctagtttccatctcccggtgggagagctcacgatcacgctggacgacgtctcctcgcttctccatctgcccgtggttggcgacttgcacgcctttcagcccttgcacgtggacgatgcggttcagatgctggtggacttattgatggtctctgtaaagtctgccagggcaggtcattggacagttgcggcttgcgcatatcttcttcatcttctggattgcactctatttgctaacaagagtgcaaccaatgtgcatgttgtgtacttggacgcccttcgtgaccttagtatgacgggaaggtacgcttggggagtggctgctctagtggattgcgacgaagaagaccgtgaagaacataagtacaccggcgtacagggagcgcctggaccgacttcggattctggatgtctgttgaatcccgtatggggaacaccgaccggtccgggacttccatgtcatatcatgctattccggtggatgcactactcggatcatattgttccagtaggtaaggtgtgcactatgtcaggtcagtgtgccagtgactacatggactggttcttccgcatctcacatcctttcatgacaccaggccatgcatcagatcttctgcctgatggtcatgccttgcagccccgagtcgtccctcaggtcccgcagacggatatccctcacgtgtcggagccaggagcatcatcgacatctgtggaggagcttggacatgcagtggatgtttatgatgagattgttgagaggttggagcgccatctaagtctaggggtggatgaccaggagtatgacacaggaccatctagtatatgttag

SEQ ID NO: 53933 - DNA, 141 bp, Glycine max
  Peptide Sequence Number=SeqID_145618
atggtgattttccaccatgaagatgtagcggaagataaaggagaagaggagaagcttcaccaccaagagagtgtcttggataagaagcttagagaggaagcttcaatggaggaagagaatgagagggagaaagtggcatga

SEQ ID NO: 53934 - DNA, 297 bp, Glycine max
  Peptide Sequence Number=SeqID_145619
atgaggccaagctctatggtggtcagagccttcgatggcagtcaccgtgatctggttatagtatcaggtgaggaggacatactagtaagttgttcatcttctatgccttatgttgaagtagcaaaggagtcactagaaacgttgtttcaagcattggaaattatgaatagtgcttatgtggagtctccttcgatacaaccatgtttgtttgatacctctttgatggtagctcgagttatgctaaaggataggtatgagcctggaatgggtttgggccggaatggtggtgccgcataa

SEQ ID NO: 53935 - DNA, 147 bp, Glycine max
  Peptide Sequence Number=SeqID_145620
atggtggaaaaccttcacgaaatcgcccacggaaacgtctcggaagcgttacggaagggaaatgagggaggtggttgccgcccagctcgcccaggcgagctgggttgcttccaccagaaagcaccaccttctgttggaacaccctag

SEQ ID NO: 53936 - DNA, 231 bp, Glycine max
  Peptide Sequence Number=SeqID_145621
atggccgcggcaaagggtttttccgtaggctccccccccctgacattcatcaggaaatctgacgctcagatcactggtggcgaaaccctacaggactataaagataccaggcgtttccccctggcggctccctcgtgcgctctcctgttcctgcctttcggtttaccggtgtctttccgctgttatggccacgtttgtctcattccacgcctgacactcagttccgggtag

SEQ ID NO: 53937 - DNA, 537 bp, Glycine max
  Peptide Sequence Number=SeqID_145622
atggcgcctaccaggcaccctctggacccggataagtccaacagggccctgggatttcccgccttgatcaaaggactctaccagtcattcggggtccctgtcgcacctagcaaggtgattcggccgcccatcacccgagcttttattgagaagtattgcatgcagagacaggcccagggggatgctccgcaggccgcagacgtgccaccacctcatcaggccggtccagccggattgtttgatacaaagcagtatttgcggcatttggttcaccagcaggcggccaaccaccgggcacatgtacggacccatgattgtctttatcagatgagtctcagcctgcagagtcagggctttacttcttttccgtgccctactccggaccagttcagggcagaggtcgcatggcctggagattggcctgaggcccgggcaggagaggcaccggcagaggctcccgacgaggcagatgaggcccgcgaggacgaggagatgaccgatttacttgatttcttaggaggaagcggggccacatga

SEQ ID NO: 53938 - DNA, 180 bp, Glycine max
  Peptide Sequence Number=SeqID_145623
agtgagtgggttaaggagcctttttccgcctttcgtctttccagtcaagcagtgaatccggttatcgactcggcagctatggaatctaagccaattgaatcagcaaccgctggtacagtaagcggtgttcaaatagccgttgttgggatcttctccgctgctagctcttcttcttactag

SEQ ID NO: 53939 - DNA, 408 bp, Glycine max
  Peptide Sequence Number=SeqID_145624
atggcattgaaagaggctattaaaatagagttgtcacataaaggatcctcggagtcactaataattcagccagacatacaacaattaggcgcgtgtgtcagcactaagggaagtaatgctcaaagcaatgcccagccttcacgggaaaatgatggtgatgtgataccaaagatgggattgtatgtgcagcgtaaggatggtacactagggttggtggccatggggaaaataatggatggggattcagtgatacacactgtggcttatgtagatgatgttgcaagggatgaagaaattattccgcacaaagtgtatgcacatggagataagccggctaatgtggatgcagatgatccaatgtgtggcctgataaaatgcacctacatcgatattcctaacatattctga

SEQ ID NO: 53940 - DNA, 477 bp, Glycine max
  Peptide Sequence Number=SeqID_145625
aggttacacgccctcgccatcagaggactgcatgtcctcaccttcgtagggctacacgccctcacctttagaggactacacgtcctcgccaacagagggctgcacgccctcaccttgagaggactacacgtcctcgccaacgtagggctacacgccctcacctttagaggactacacgtcctcgccaacagagggctgcacgccctcacctttagaggactacacatcctcgtcttcagaggacttcacgtcctcaccttgagaggacttcacgtcctcgccttgagaggactacacgtcctcgccttgagaggactacatgtcctcaccatcagagggctgcacgccctcacctccagaggactacacgtcctcgccttgagagggctacccgccctcgccttgggtactagttaccctcaccttcagaggactacatgtcctcaccttcgtagggctacatgccctcacctttag

SEQ ID NO: 53941 - DNA, 126 bp, Glycine max
  Peptide Sequence Number=SeqID_145626
atgcttctgcagtcgctctcggagtgggcaaccacaatgtcgacgaagaacgttgttctggcagatctactacgctgctccttctgctacatccacaactgctacagaccacccatactccagtga

SEQ ID NO: 53942 - DNA, 531 bp, Glycine max
  Peptide Sequence Number=SeqID_145627
atggcccgagttatgttggggaacggttatgaacccgggatgggtttaggcaaagacaatggcggcataactagtctgataaaaacccaagggaatcgtgggaagtatggtttaggctataagcccactcaggcggacatgaaaagaagcatcgcgggaaggaagaacagtggtcagagctcgcgttggaaacaagaaagtgaaggaaacccgccctgccacataagtagaagctttataagtgcgggtctgggagacgaaggtcaagtggtcgcgatatgtgaagatgatgttccaagtactttggatttggtccgaccatgccctcctgatttccagctgggaaattggcgggtggaggaacgccccggcatttacgcaacaagcataatattcgatgacgagtcccccgaaggtactaatacctgggacccgtctatcaacttcgagcaagaaatgaaccaaacggaagatgaaggagatgaggatgtgggactttccttcggagctagaaagaatggtcgcccataa

SEQ ID NO: 53943 - DNA, 282 bp, Glycine max
  Peptide Sequence Number=SeqID_145628
atggcggttccaaagtcagaaaagatgcaaagacaagatgaaactaacaagaaacaaaaaagctctcgggaacggaagcttcgagcacactccagacatatgatcaaagatcccaacggtcagatcgtggacaattgtcatgttaagctgctggccaaagttggagaagatccaacggttaacgaaggctggacagcgtttttactgaggcagcttcatgtagcttcctctagaagcttcattaagaggcttcttcaagaagcttccccgtggcttctttga

SEQ ID NO: 53944 - DNA, 444 bp, Glycine max
  Peptide Sequence Number=SeqID_145629
atggagagaggaaaggaaatccaaaccaagagcactgctttgatgttatcattggtgagatctatgggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 53945 - DNA, 414 bp, Glycine max
  Peptide Sequence Number=SeqID_145630
atggtgaaagttggaacctcttacgtccgatcaacgtctcatttcgccaaaagtggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggagcaggttggttcaggaaacggtgtctga

SEQ ID NO: 53946 - DNA, 573 bp, Glycine max
  Peptide Sequence Number=SeqID_145631
atgctgaaacaacttcgtccagcacttgtcatgatcgtttcgctcactgtcataaccgggttgctctacccgctcggcatgaccggtatcgcccaggcaatcttccccactaatgccactggcagcctgatcgaaaaggacggtacaatcattggttccgagttaatcggacagggttttaccggtgaccgctattttcacggtcgcccatctgcggcagggcaaaacggttatgacgccgcgagttctggcgggtccaatctcggcccaaccaatccaaaactcattgaacgaattaaagctgacgtcaccgccctgtcacaagatgaaggttcagcaccaccaccgattgaccttgtgacaacatccgcaagcggtctcgatccgcatatttcaccggaagcagctttctatcaggtgccgcgtgtcgcaaaggcgcgcgggatcgatgaagccgcactgcgagagattgttgagcaacaagttgaagctcgtgagctcggatttcttggggaaccggtggtcaatgttctgaagctgaaccttgttctggacaggaccagcaccaagtag

SEQ ID NO: 53947 - DNA, 333 bp, Glycine max
  Peptide Sequence Number=SeqID_145632
atggagaattgcactaagcaatccaatcagcatggctccaaactcgtgggtggtggacgcatgaacgaaaacgcaattcatggtgctccaaaaaaaggttgtagagaatggagaattgcactaagcaatcactacgcatggctccaaactcgtgggtggaggaggcatgaacagaaaacgcaattcatgagactccgaataaaacggttgagaatggagaattccactaagcaatcactacgcatggctccaaactcgtgggtggaggatgcgtgcacgaaaacgcaattcatggggctccgaaaaagggttgagaatggagaattgcactaa

SEQ ID NO: 53948 - DNA, 179 bp, Glycine max
  Peptide Sequence Number=SeqID_145633
atggggacgaggggttgcattaattacaatcccgtcctcgccataagacaacttggttaccctatgagaagggcgccatcagaggaaggcctcacaccttttattgctggagaggataatcactcaggaggatcgagagatgaggccacatcaagaagagacaggactcgtagacttag

SEQ ID NO: 53949 - DNA, 231 bp, Glycine max
  Peptide Sequence Number=SeqID_145634
atggggagagtttgtgagggatccactgttgttcataaaactcctttgttgcttggccaagtaaaggtagttgtgtctctggcaaaaccaccttcaaagcccgatctggaggtcgatgatccgctttatctgatgacattgatgatcccaaagcttttcttgaggccttatcaggttagatgggatgccatcgtgttcggggtctttaatcccgatttcccctctacataa

SEQ ID NO: 53950 - DNA, 224 bp, Glycine max
  Peptide Sequence Number=SeqID_145635
atggtgtctcctcaagggaggaatacatggacagttgatgatctcgtgccttatgtggagaaaataacgattttatcgaaagagcaagagagaatcacgcgaagggtggttgttgaagtggaagaatattcccaacaaatggcggagcgtggccttggaatgtattacacaccaccaacattttctcagtatccaacgcagatgtatcagtatccctccacccg

SEQ ID NO: 53951 - DNA, 570 bp, Glycine max
  Peptide Sequence Number=SeqID_145636
atggccccgagaaagcttgcctcaaagaggtccaggaaggataaggcggccgaaggaactagttccgctcctgagtatgacagtcaccgctttaggagcgctatacaccagcagcgcttcgaggccatcaaaggatggtcgtttctccggaagcgacgcgtccagctcagggacgacgagggtcagtggatcccgtttgatgtcgatgctatcggccagctcctgggatatccgttagtgctggaagagggccaggagtgtgagtatggccagaggaggaaccggtctgatgggttcgatgaggaggccatcgcccagttgctatgtataccggggcaggattttgcccggactgctgctggaagacgggtgccgatcatgcgcaccaacatgaccaccctgactcatatatggatgactttgctgctcagcaacatcctacccaccgaccataattccgaactccccctgccgaagtgtcagctggtaatggcgcctactaggcaccctttggacccagataagtccaacagggccctgggatttcccgagctgatcacaagactctga

SEQ ID NO: 53952 - DNA, 219 bp, Glycine max
  Peptide Sequence Number=SeqID_145637
atgaaaggaaaccaacaaaggggtaagtcacgtccccagtggagtcgccaactgtcgcaacctacccttcgacgggagggcgacgcgagactcgcgggacgcgagactcgcgagacgcgagtctcacgaaaggaatacgcgcgaagtcgccaccaacgtttattcgaggaaaatgtcggaaaaaccggaaaagacgcgatctacgaacttttaagttga

SEQ ID NO: 53953 - DNA, 246 bp, Glycine max
  Peptide Sequence Number=SeqID_145638
atggagctatcttttgctcagcacgtagcagatccgcctacaccagtacatgagagaccagctgacccctctactcctattttagagataccaaaggactctaccacactggtcctgacattgaacaccactcctccatctacacctgagcttcagttttcagatgaggaggggggacggattactactcctccggggacgccagtgttacatttccatgatgaggagcaggatcgagatgaatga

SEQ ID NO: 53954 - DNA, 322 bp, Glycine max
  Peptide Sequence Number=SeqID_145639
cttcattgagaagtattgcacgcctagacaagcgcagggtgatgcaccgcaggctgcggacgcaccgccaccacctcatcaggctgatccagctgggtcatttggcatggagcggtatttacagcacttgagccaaggtttcgctccttttgcgtgccctactttagatcagttcagggctgaggttgcatggcccggagattggcctgaggcccaggcaggggaggtgcctgcagaggctcccggcgatgcagatgaggcccacatggatgaggagatgtcggatttactcggtttcttgggagggagtggagccacatga

SEQ ID NO: 53955 - DNA, 474 bp, Glycine max
  Peptide Sequence Number=SeqID_145640
atgagttgtacatgttcgctaagcgcactgcttcatctcactaagtgcaccacttcagttcatccgctaagcgagaaaggcgcgctaagccaaaaatcactaatgtgcactaagcggtccatacggagtttggactgggattcagagctttgcatgtctagggtttctagattgagaaaggtccaagttccagagagttttaagagattttgctgtgtgaagatctgtagagaccagagcttgaagcaggagtcggcttcctggtatggaaagctaaatcctctgttggatcatccctgtagcaatgccttcaaaggttattttgatgatgtcaaagaattcaagaatcaagagaagtttcaagtttcaagttttcaagaatcaagaataatcaagaacaagattcaagaatcaagagaagactcaatcaagataagtattaaaaagtttttcaaaactttgaatagcacatga

SEQ ID NO: 53956 - DNA, 252 bp, Glycine max
  Peptide Sequence Number=SeqID_145641
atgtttattaactgctgctattgtaaaccatttttggccactggtaatcgattacatcctctgcgcatttgcatcaaatcatcacgatcatcatcaaaacatctaagacatttgcttctacaagaagcgctactaggaggcaacctagaattggttacgaagaagctccccctgaagcggtcctggaagggcaccattgaagagggttctagtgcggccccgcaagccgacacaggcttcgacaaacactga

SEQ ID NO: 53957 - DNA, 381 bp, Glycine max
  Peptide Sequence Number=SeqID_145642
atgggggagacgcatgaaatgatcgaaatgggtctaaaaagaggcaaatctgatcgtcatgctttgataaatgcaaaaaaaaaaaaacgggcaaatgaagagggtgagaatgagggagagacccatgctgtgactgccattcctatacagcgaagtttcccaccaacccaacaatgtcgttactcagccaataacaaaccttctccttccccaccacccaattatccacaaaagtcatccctaaatcaaccacaaaacctgtctaccacacaaccaatgctaaacaccacctttagcacaaaccaaaacaccaaccaaggaaggaatttcgcaacgaaaaagcctgtaggattcaccccaaattccggtgtcatatgctaa

SEQ ID NO: 53958 - DNA, 312 bp, Glycine max
  Peptide Sequence Number=SeqID_145643
atgcatgcaggacccaaatcgccagaaccagtggcgagtttggtgtccttgagcaaatcgccagcacctatggcgatacatgcatgcaaagaggaaaccgccagtctaaatggcgatatgctcagcgctttgggaaccgccagtcaaactggtgagttccatggaatgaggctgcagggctacgtcgcaggccatggcagtgcagctgatggacgcgtcagtgcaggcgaaaccgctattaccattggcggtttgccttgcacagggattgccaagaaaacgctattaccattggcaggttgcttcgtttga

SEQ ID NO: 53959 - DNA, 612 bp, Glycine max
  Peptide Sequence Number=SeqID_145644
atggcttccatgatggaggccatgttaggaatgaggcaactcatggagaaaaacgtggccaccgctgccgccgttaattcggctgccgaagcagacccaactctcctagctaccgcgcaccatcctcccccaaatacggtaggacgaggaaggagcacactggggcacaacagcaacccccatttgagatacaatcgggtggcttacccttatggattgccacctaattacacgccgccagtcatgcaagatgatgcggatcatgtctcttcccccatccttgaaggggagcctcctcgacagcccgacgaggtccacgaagatcatcaagagtatgcccaaggggatgtcgagttctaccccccgatccccatcgagggaccggcacccaacactttgcctcagcccaacctcacagcacaaccaatattcttgtccatagaaggaccacccccggcgaccgaggaaagaaggaaactcgatctccttgaggagagattgggagctgttgaagggttcggtgactatccgttcgcggacatgacggatctttgcttggtaccagatgtcgtcatccccccaaaattcaaagtgcccgatttcaacaagtaa

SEQ ID NO: 53960 - DNA, 393 bp, Glycine max
  Peptide Sequence Number=SeqID_145645
atggtgacgcgggttatgctcaggaacggatttgagcccagaatgggtctaggtaaggacggcctcaggaatgccgacatggtcgatatcaagggaaatccatacaaatatggattagggtatgaacccgggatgccggggaggaggaatgtgccgtcaagacttcgggtggatagggatgaagagcctccgctgatcgccatctccctcgggccgctatcctccgtagagtctgcctcagatgccgacatgacttcctcgggagaatccacctcaagaagtggatcctcatcaccctctagaaagtcaagggcatccacagcaggctcaggaggtagctcctccaggtcctcctcagggtcttcctcggatgacgttacctcgatcacttga

SEQ ID NO: 53961 - DNA, 270 bp, Glycine max
  Peptide Sequence Number=SeqID_145646
atgttgtggaagcttggagggattaatggggacccagtgttgagaagaacgaggataggggctacgtgggagtacgtgagctcagttgaaggtgggcaactggggatggtggatttatgtgtgatttgtagatgtgaagagtcgacttgcaccatcacccgatcgccaccgagtaccacatatgacggagtggtacctggagatatgtcgcgggggtcaggagaccttggggatgtcaggtggggtgctattgcccaaaaccaagcttga

SEQ ID NO: 53962 - DNA, 296 bp, Glycine max
  Peptide Sequence Number=SeqID_145647
atggcaatgttggatcaatttcatccgttcattcatgatttcattgaaaacattgtggatgtcaaagctaatgataactgtggatatcgtgtgattgctactttattaggtatgggtgaagattcttgggccttagtgcgcaaccatttgcttaaagaacttggcaaatggtcatatgagtatatcaacctctttggtggcacaaacagattcgaggaattaaggaggtccctacttgttgatggattatccatgtggatggatataaccgagatgggatatgtcattgcatcaag

SEQ ID NO: 53963 - DNA, 285 bp, Glycine max
  Peptide Sequence Number=SeqID_145648
atggtgcctgtgggtgatggagaaactacacgaaagcaaaggctgaaatgcttaaatgagaaatgctcttgggaacggaagcttcgtgcatactccagacatcgtctccaagatcccaacggtcagatcgtggacaagtgtcttgtgaagctgcaaacaaaatttaaagacaatccaacggttaacgaaggctgcacagtgtttttaccgaggcagcttcatgtagcttcctcaacaagcttcattaagaggcttcctcaaaaagcttcctcgtggcttctttga

SEQ ID NO: 53964 - DNA, 501 bp, Glycine max
  Peptide Sequence Number=SeqID_145649
atgtcggtggctccttccttcctttcgcttggaggcacgtacctccacggaactgcgtggctatttttgtatggaaatggaataggtctaactaccgaggggtgtcgaggcgtttggggagctgtgtctctagtgaaatgtatcaccaaaggtttaggctttctaagaccttcctcatctgcggattgcatgcatatgtgctgctcttcacccccctcatcgctgacttccagccagccttggtctatcatttgttgcaataggtctcctacggctaaacatgcttccataggcctcgtagataaaccttctaggggtcatcacgtccttcaaaggtttggacctgcgcggcctacccgactcgacgacattaaccgctccccctccatgattggcaagcgggtttgtttttacgttgggtcggtcctcttgaaacgtcagccatccggcttctatcaaactttggaccttgcgtttgaaggccatgcactgtttgattga

SEQ ID NO: 53965 - DNA, 481 bp, Glycine max
  Peptide Sequence Number=SeqID_145650
atggagtcatctaatgaaaaaatgatggacaaaagaaaagttttaggaaaaaataatgaggaaacaagaagttattttacatggaattttgaaatggaacgtgtattgactgatgtacttagagatcaaaggaatttggacaacaagggtgacgaaggttggaaaagtgacatccttggccagagcggatttgattgggatggcattaagcacatgataacaattgagaatgaaaatgtttggaatgaatattgcatttcgcataaatcggctaaaccgtttcgattcaaggtgcttcaaaattgggatgatatagtggatttgtgtgctaaagatagagtcaccggtcatggagctgaaactgctatggatgctgatgaagcgatgagtagagaaacaaatgaagtggaattcatggggttaggtgctactgccatagatttagaagaaccaagctctaatacaaaaggaaaaagacaag

SEQ ID NO: 53966 - DNA, 166 bp, Glycine max
  Peptide Sequence Number=SeqID_145651
atggctgcgagaaatgagcgagaacgacttcttaccgaggccttgaacaacttggcgcaagttatggccaatcagggaggcggtggaggagcaactatgtaccatgggttagatcgctttctgaggaacaacccacctacttttaaagggggttatgatcctgagg

SEQ ID NO: 53967 - DNA, 78 bp, Glycine max
  Peptide Sequence Number=SeqID_145652
atggcgcctcaacagaaatgcatgagaacaaatggcacagagcgtgtttgctctatgcccataattgggaacctatag

SEQ ID NO: 53968 - DNA, 255 bp, Glycine max
  Peptide Sequence Number=SeqID_145653
atgcacacacaaggtttcacaattccacaattccttagaataggcataactcacaaaaaggtccccagtggagtcgccaactgtcgcaacatgcccttttgcgggcgagcgaaggcgaggctctcgggtgcactttccaaaggaggaaagatgcgaggagtcgccaccaacgtttatttgtgggaaacgtcggaaaaaccgaaggaaactggtcaagatgaaaattctaagttcaggagttgtatttacacttaa

SEQ ID NO: 53969 - DNA, 258 bp, Glycine max
  Peptide Sequence Number=SeqID_145654
atgaaagctatgccaagcaagccaacaagaaaaggaaggaagtggtacttgaacccgacttatcaaggtaatccttctggcgtctacccagacttatcttccttcattggaagtggcgtctacccagacttatcttccttaaccggaagtggcgtctacccagacttatcttccttcactggaagtggcgtctaccctgacttatcttccttcactggaagtggcgtcatccaaaccttcgtagcctgtatcaaatga

SEQ ID NO: 53970 - DNA, 573 bp, Glycine max
  Peptide Sequence Number=SeqID_145655
atgcaatcacagggacttacactgcctccggaggcagaggttggtccctcaggtgctcgtgccagcacaaaggagagttgtgttgatccctcagggaatgatccagagacgggtcactcagacaaatgcgggttattttatgagggatccacaacggtttacaacatccctttgttgcatggccaagtgaaggttggtgttgagaaggttaaagatgtagaggctctcattcctgtacccactgacgaggtagctgtgtctccagcaaaacctccagaaagcccggatcatgaggttgatgatcccctgtatctaatgacattgaccatcccacacctgtttttgaagcctctccaggttatgtgggatgctaccgtgtttggggtgtttaatcaaaacttcccgttgtacataaagcacgaagatctctttgaaattgtacacgatggtcaatgtctcagcatatctgttatacaattatggattcagcatatgactgagacaagtatgcgagcggggaattccgatgtgtatggattcctcgagccacagtccattcagagaactgggtaa

SEQ ID NO: 53971 - DNA, 669 bp, Glycine max
  Peptide Sequence Number=SeqID_145656
atgggcccatcgatggctaccgcccttagggcagaactcgagcaagcccaaacagtcaaagaaaggttcaagtcggcagctctgaagatccgaaaggagaatgccgaactgagagatacaaatatagctacgaccaaggccttggaactagagaccaagagggctcgtagggaagaacacggtcggaacaagttccgaggggctctttggggcagcaacagcgagcttaagctccggagagaggaaagggaccattcacgagtagacagtttgatcttgaaagatgagttgaaggtttgctcaaggtccaaaagaaacttgtctcagtggttatgcaaaacagagaccaacatgttagctatcatcagcaagtaccaagaagaactaaagctagctacagcccacgagcatagagtggcggacgagtatgcccaaatgtatgcgcagaaggaggctagaggaaaggtgatcgactcgttacatcaagaggcaatgatgtgtatggaccggtttgctcttaccatgaacgggagtcaagaacttccccgattgctagccaaggccaaagcaatggcggacacctactccgcccccgtggagatccacggacttctcggctattgtcagcatatgatagatctaaagacccatataattagaaaccgctag

SEQ ID NO: 53972 - DNA, 459 bp, Glycine max
  Peptide Sequence Number=SeqID_145657
atgagaaaaagaaagaagaagagaatattactcaagtggattttaatgattatcgaagtaattttgaatgaagtgaaaaataaaattaagggtttcctttctcttgatcttgttacaggcgatccacctcagcagaagagaagtctaataattgagatagaggaagaactcaagaatattacaaaagggaagggagtggaaggtggaagagaaacatctgggttcattgcgaagacgaagacacctctgataaaatattacacacaccaggcaaatgtggctaaccggaaaggctctgcaatgaggaaacaaaacattcacagggatgagtttccgcgttgcaagagatgcgggaaggagcgcaggttccatctcaagagcacaccagacattaagaactaccatgatgctttaaacaacaaatgcaggacttgttctctttggccttatcaaaagtaa

SEQ ID NO: 53973 - DNA, 528 bp, Glycine max
  Peptide Sequence Number=SeqID_145658
atgaaactggccaaatacaggctaaaggcccaagtggagaaggacgaaggcccaagtggagaaggacaaagcccccgagtggagaaggatgaaggcccaagtaatccttgtggcgtctacccagacttatcttccttcaccggaagtggcgtctacccagacttatcttccttaaccggaagtggcgtctacccagacttatcttccttcattggaagtggcgtctaccctgacttatcttccttcaccggaagtggcgtcatccaaaacctccgtagcctgtatcaaacgatccacaatctcagacttatcaaggtaatccttgtggcgtctaacctgacttatcttccttcaccggaagtggcgtctacccagacttatcttcctttaccggaagtggcgtctaccccgacttatcttccttcaccggaagtggcgtctacccagacttatcttccttcactggaagtggcgtctaccatgacttatcttccttcaccggaagtggcgtcatccaaaccttcgtag

SEQ ID NO: 53974 - DNA, 492 bp, Glycine max
  Peptide Sequence Number=SeqID_145659
atggaaacatgtttagtagtggaggacctgttgcaacatatgatagatcgaggccggctagaagtcggtgatgaggggactgaagagcagcatatatgtatgcagtccgcatatgagagaagttttggaaggcctaagcctttggtgttaaacctattccgtttccataccgaaacagccatgcagttccgtggaggtatgcgcctccgagcgaaaggaaggaagaagccaccgacatcagctcgttgtcggccaagctctgagcctcatcgggctttgctagtgaaggtcttgaacgaagctcatgtagcccaagacatctccgtagaaggctttggaggactcgtcaataacatcactgccaacaactatctcgccttcgctaaagaagaaatccttgtcgaggggagagggcataacagggccacagtttgtcgcgcaatgtcgtttcctgctttcaggtacttagggacggacgcaagtagaggctag

SEQ ID NO: 53975 - DNA, 270 bp, Glycine max
  Peptide Sequence Number=SeqID_145660
atgcctgataatgcgcagagactaacgtcgtcttctgcaccttttgtcttccaggggcagcgagtcgagtggtgggcggagataccttatggtcatttgcgcctttcgtcgaccgagaggaacgaattcggcagttttttcactctcatcgtccaaaaacattcaagtccagagacgtgcggaattcttctctgctgggcagagacgattgggtggaatggcaaagggaagtgtcgtggttgtccaaatttgtcgttttcaaaacactga

SEQ ID NO: 53976 - DNA, 174 bp, Glycine max
  Peptide Sequence Number=SeqID_145661
atgggggaacacatgaaatgccaccaaccaaggaagaaatgggagaagtttgatcatctagaggaaaggctcagggccattgaaggaggcgaagattatgcctctgctgacatagaagagttgttcctagtacccgaacatggtcatccccaagttcaaggtgctagactttga

SEQ ID NO: 53977 - DNA, 706 bp, Glycine max
  Peptide Sequence Number=SeqID_145662
atgcggcttaaaaatcttgagcgtgaactggggctgtcgctgatcaatcgcagcaacaactttgacggcttcacgccagaaggggaacgcgtgctaacgtgggcgcgcgaaattgtttcggtgtatcagggactgaagctggaagtggagtcgctcaaacacggcgtcaacggcacgctgcggctgggcgtgatgccgcagtgcagcgtggcgctgccggcgttactgaaagcggtggaagcgcgctatccgcagctcgactatcgcgtttccgccatgagcgccgatcaactgctggaagcgcttaacagccacaccgtggacggcggtatcggcttttttgagctgacgtcactgcgggaactgcatttccagaccgcgctgctcaacgatcgcggtgtcgaagccattttccatcccgatcacttcccggcgctgctgcagcatgagcggctatcgctgtacacgctggcgagccagccgctgtgcctggccgagcccacgcgctatttccggcgttacctcgacggacagctgcgtgaaaccggcgtgctgccgcgggtgattgtggaaagcgcctcggtgatgcagctgattcagagtgcgcaggttggtctgggcgtcatggtgtcgccctgcggccatctgctaccggaaatgctgcaccatctggcgcgccggccaattgatatcgcgccaatgggac

SEQ ID NO: 53978 - DNA, 608 bp, Glycine max
  Peptide Sequence Number=SeqID_145663
gtcgactctagaggatccccgcagccgacagcttgacggttacatcacactgctgcagtgctggatatatgagcactttccctcagtcgcagagtccaatactgatcaggactacgacgaggattcaccgcgtgcctatgtttgttggatcccatatggggaacaccgaccgattcgtgacttccatatgatttcatgctattccggtctccagcggtcggggccctttgctgtgtattaccgaccagagagggtcatgcgacagtttggatacacccagaccattcctgctccgcctgtcgattcatgggtgtcgtatgatgatatacacgataggtggatgcactattcagatcatatgtttccagcaggtgcggtgtgcgctgtgacaggtcagtgtgccagcgactacatagactggttcttccgcatttcccatcctttcatgaaaccatgccaggcatcagttcctctgccagatggtcatgctccgcagccccgagtcgtccctcaggccccagagacagatatccctcacgtgtcggagctaggagcactattgacatctgcgaggcccgctgtggaagagcctagacatgcagtgataa

SEQ ID NO: 53979 - DNA, 488 bp, Glycine max
  Peptide Sequence Number=SeqID_145664
atgattcagttccatgagattgagagctttttaaagggtggaatgaatatcttgacggcacacagtcaagagtgggaacaagaattaagttctaactatcaatatgaagaagaaagaactcctaatcttgaaagtgtgtttgacgaattcatggcataccatgccagctcaaaagctaatcaaaactcaatgaaaaatcatgaaattcattttgttacaaccttcctatcaaaatgcagcaaaagaggatccaatatggataaattgttgatgcaattcatggaaacaactaaatcaactcaacaagcactccaaagtgtagaaatccaggttggtgagctggcagaagcagtaactcaatttatgtccagacgagaaaaatcctttgtagaggctgaagctcaagagaaaagccctataaaagagcatgaatcaagagaaaaagatgaggagaaagatgatgaacaaacacaacaacaatgggagaa

SEQ ID NO: 53980 - DNA, 423 bp, Glycine max
  Peptide Sequence Number=SeqID_145665
atgatgccttatttctatgtgtttagtcctagaatgcatgacaggatttttatggaatgtgctacacaagcttgtttcttgcaattccaagacactacagagcttcctaataggtggcatgtcccacttgtgctttttctatgtaatttgcaacctgcaaaatcaaaatctgaaaagcctgtaagatttaaggaggtaactttaggataccacaaacctacattggttgtgcccttaagttctgtgcacattgcttctcaatgccccaccaagaaaactatgattatgaggggccaagacatttatagtagtcaagatgaggctactgcttcaccttcctctagtgaaagtgaagaagcaaaaggggaagtatctagtgaagaaatctacccccacgaagaaggagggccatttaatggttag

SEQ ID NO: 53981 - DNA, 740 bp, Glycine max
  Peptide Sequence Number=SeqID_145666
atggaagaaagcatgtctcctttccttgtaagggatttcggcgcgcaaaatttcaaggctatacaaagaatccataaggcatgggaaaccccgttaaggaaagatcaagaacttaggggcattcgtaacagcatcattggtggttatcatgaatggctgaaagttcatatacgaggtttagattggctcgccaagttaaaagtcgtcagcgaagacagtttcgaagcactggaagaagacgaagaagtccaagctctcaaaaacgagttaggaaaggcgaaacttgccaaggagaagttcaagttagccgctacacacatccggaaggaatgtgccggattacgggaagagaatgcaactaccgcaaaagcccttgaacaagagaccaagagggctcgcaaggaagagtatggccgtaacaaatttcgcggagctctgtggggtagcaacagtgaaatcaagctgcgaagggaagagagggaccagtcgcgagcacatagcatggttttgaaagaggagttagttgcctgttcaaggtccaaaaggagcttgtctcaacgtttatgcgagacggagaccaacatgctagctatcatcgccaagtaccaagaagagttaggtctagccacggcccacgagcatagggtcgtggacgagtatgcccaagtatacgcggaaaaagaggctagaggaagggtgatcgactctttacaccaagaggcaaccatgtggatggatcg

SEQ ID NO: 53982 - DNA, 402 bp, Glycine max
  Peptide Sequence Number=SeqID_145667
atggaagaatcatcaaagaaacgtaagggttcatccgcctccacttcgacttcaagagctcatcgttccaaagccactagcgcatccacaacaccaattccaccctcattatcctcttccacattgttttcttctgaagaacagcagaaacgtgacggtgtaccatttgaaggtacactgaatgacgattggaagtttgatttttctgcacatgatgcccgccagttggtttgcaccaacaatgcggatatgaccggacgccttcttgtcggctcattggcttttgaaagccgtatccttcattatctgattgtgcggattttgcttccacgatcttccaatcttgcccaggtttctgaggaagatcttgttatgggcctttcataccgagcgtcaacttga

SEQ ID NO: 53983 - DNA, 300 bp, Glycine max
  Peptide Sequence Number=SeqID_145668
atgtgttccaatttctggccttgcaccgaccatctaatggaccatggactaaacggccactgcctgaaaggactatgtcccgtggaccgccgcccccccacaagggaatactctaaccctgggaaccggggcctggccaaagtccagggtggctcaaagttcgatcaaggagatccctgtcctgtgccctattcactaagagggggtaaccttgggcaataccaatccatttttggtttctataagcccggggggatttattatccagggaatactcctccaggttataaagcccactag

SEQ ID NO: 53984 - DNA, 585 bp, Glycine max
  Peptide Sequence Number=SeqID_145669
atgggggcatactcaagggatgagaagctactcatgcatttctttcaagatagcttggttgaagccgcaattggatttggcggcgagatgattaccatgatagtagacactcttccagtgttctacttcgagaagttggtgggctacatgccctctagctttgtggatcttgtattcacgggcgagaggatagaagtaggcacaagcaatagaaggatcggagcagctagggcaaaaagaaaggaaggggatgcccatgtcgtcacctcggcacctgcttggctgaaggctcagcaagcctcgcatggtactcatcagtatgctcagcaccactcgagttttttggcccgcgccagaaactcttccaacttggcacccgtccagccaaggacgtctgcaccatcgcaaagggcccctgctcagacttcagctctggcgcaacctcgtcccgctaacaatgccaatcttggcatgaattccaacatgggaagaaaccctttggtgaagaagattctggagttcaccccaatcccgatgacatatggggacctattgtcgttactagtcaccaaccagttggcagtg

SEQ ID NO: 53985 - DNA, 633 bp, Glycine max
  Peptide Sequence Number=SeqID_145670
atggctagaacacgaggtttaggttatgctataggtagacttattggcagagataaacatgatcaccatgatgcagctgatgttcccgagaggtgtaggtctactgcctcagcccgtaggcaacgggttcatcagatgactgcggatgcacgtgatatggttaaggaagttgctgacatggttgaggatgtccctgatctggctgaggaggcacctgagatgcgtgcggacgtacagggtgctgatggtgctgaggggtcagatgctgatgatgttgagggattccctagtgggccacgtgacccgtcagtgctgacatcatttgcgggccatgttgcacacgctttttggagtggacaggaacatcctgatttaaagttggtgtcacatgggaggaaggtgacattgattgggaggccagtgcctgagattgaaggactggttgttgttactggcgatcctggacttatatctgcatttgtggagaggtggcacaacgagaccagcaccttccaccttccggtaggagagttgatgatcacattggatgatgtgtcgtcactccttcatttgcctatcactggcgcattgcacagttttcatgctctttctatggaggaggggatcctctag

SEQ ID NO: 53986 - DNA, 423 bp, Glycine max
  Peptide Sequence Number=SeqID_145671
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaggaatgggtaacagtaacgacggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 53987 - DNA, 576 bp, Glycine max
  Peptide Sequence Number=SeqID_145672
atggagcaaagcatgctagctataatagggcagtacaaagaagagttaaaccagtctttgacccatgaacaaacgatagtagaggacttcgcacaagcatacgccgagaaggaagcaagagggagggtgattgatgcattgcatcaagaagcgaccatgtggatggatagggaactcaccataactaaaaaagcgcaaaggcacccctataacacccaatccaaaagtaagatggataacgaagaaggagtgcaagaacagatgaaggccgacatgtcggccttaaaagatcagatggcttctatcacggaaaccatgctaaaaattcaaaaatcaatagaagacaatgctacggcagccgcttccaatatagttagggaagcggaaccggtgctacagcccgcgatgaacatgggccgggaccgaagcgcgatgggttttaatcggaggtatagtcctcaagcctacccttatggtttacctccatacttcactccccgtaccgctccagacgatttgagccaagcccctaccttcgaggggcaactccctcctcatgtcgactatcctctgtag

SEQ ID NO: 53988 - DNA, 357 bp, Glycine max
  Peptide Sequence Number=SeqID_145673
atgggaagaggtggtggagaagttcctgaagaactccttgatgccttcgccgatgggaagatcaagctaaagactccagaagaagccatggagctgacagagaatatcacagccaatgatcacaccatccttcgtgatcgagcctacatgcccacaaagaaaagccttcttgagcttacttctcaagatgttatgctggctcaaaacaagctcctggccaagaccttagagactctcacaactagtctgagtaatgttcctcaacaactacatgtagtgcaacctcttccagccatgcacagtgagggatacaacatttgtggggctgctcatgagtcaggatcatgtatggtctag

SEQ ID NO: 53989 - DNA, 384 bp, Glycine max
  Peptide Sequence Number=SeqID_145674
atgaccactcttacacagatactctatcagacctacagggtgcccgttcccccccagcaagggatcgtgcctgcaggacacccggtggacccggagacgtccaacagggtcctggggtttccagctctgattacgggcctctgtcagttctatggagtgcccgtcacccccaacaaggtcatcaagccccctactaatcaagctttcatcaagaagtactgtgcccccagggaggcgcaaggcgaaacaccacaacagcctggggatggccagcaacacaccgtcgccacctccagagcccctcagctcatccacaaaaaggttagagtattgcctacgacacatggccgaccaataggcgaccaagtccaaatccaaaggtaa

SEQ ID NO: 53990 - DNA, 336 bp, Glycine max
  Peptide Sequence Number=SeqID_145675
atggggtacgcaccttcaagctttgcaaatttggtctttgccggtgaaaggatcgaagcgggtctgaaaagaggcaaatttgatcatcctgctttgatgaatgagaaaaatggggcaaatgaagaggatgagaatgagggagaaacccttgttgtgactaccattcctacacgaccaaatttcccatcagcccaacaatgtcaatactcagccagtatcaacccttctcattacccaccacccaatcatccacaaatgagccacaaggcctacctgccgcacgaccaatgccaaacaccacctttagcacaaaccgaaacaccaaccaagaaatga

SEQ ID NO: 53991 - DNA, 993 bp, Glycine max
  Peptide Sequence Number=SeqID_145676
atgacgaaagataacaattggtacctcaaagccttaccctgggtttggttggtttcgtacttgttccagcaagacacaaggcatccatgtccgctcctgagccatcgctcgtgtactgaaaagaggagaatagattgggaccagcttttggccgggataggaggtagaacaatcaattggttcccccgatggaaggaaggaaaggagggagttcttttctcatggggagggtacccaaacattccgctgataggaacgaggggttgtattaactacaatcccgcgctcgctataagacaactaggataccccatgaggggagcaccgatggaagaaagcatgtctcctttccttgtaagggagttcggcgcacaaaatttcaaggctatacaaagaatccataaggcatgggaatccccgttaagaaaagatcaagaacttaggggcattcgtaatggcatcattggtggctaccatgaatggctgaaagttcatatacgaggtttagattggctcgccaagttaaaagtcgtcagcgaagagagttttgaagcaccggaagaggacgaagaagtccaagctctcaaaagtgagttaggaaaggcgaaccttgccaaggagaagttcaagttggccgctacacacatccggaaggagtgtgtcggattacgggaagagaatgcaactaccgcgagagcccttgaacaagagtccaagagggctcgcaaggaagagtatggctgtaacaaatttcgcggagctctgtggggtagcaacagtgaactcaagctgcgaagggaagagagggaccagtcgcgagcacatagcatggtcttgaaagaggagttagttgcctgttcaaggtccaaaaggagcttgtctcagcgtttatgcgagacggagaccaacatgctagctatcatcgccaagtaccaagaagagttaggtctagccacggcccatgagcatagggtcgcggacgagtatacccaa

SEQ ID NO: 53992 - DNA, 717 bp, Glycine max
  Peptide Sequence Number=SeqID_145677
atgtcgctaccgccaaccgccaatatttttactgtcagccgcctgaacaccacggtgcgtcaactgctggaaaatgagatgggcctggtgtggctcagcgctgaaatttccaatttcactcagcccgcttccggtcactggtacttcaccctgaaggacgatggcgcgcaggtgcgctgtgccatgttccgcaacagtaatcgacgcgtcagctttcgcccgcagcacggtcagcaggtgctggtgcgtgccagcatcacgctgtatgagccgcgcggcgactatcagctgattatcgaaagcatgtatccggccggtgaagggctgctgcagcaacagtttgagcagctgaaagcccggctggcggcggaggggctgttcgaccagcagtttaaacaaccgctgccggagccggcgcgccaggtgggcgtgatcacctccgccaccggcgcggcattacacgacgtgctgcgcgtgctgcatcgccgtgatccctcgctgccggtggtgatctatccaaccgcagtgcaaggcgttgatgcgcccgccaccatcgtgcgcgccatcgagctggccaaccagcgtgacgagtgcgacgtgctgatcgtcgggcgcggcggcggttcactggaagatctgtggagttttaacgacgagcgcgtggcgcgggccatcttttgccagccgcctgccgatcgtcagcgccgttgggcatga

SEQ ID NO: 53993 - DNA, 549 bp, Glycine max
  Peptide Sequence Number=SeqID_145678
atggagaagagtatgactgatgctaccagtggtggagctcttggtgatatgacccctgctgaagctaagaacttgattgagaagatggcttccaactcccaacaattcagtgcaagaaatgatgctattgttcttagaggagtccatgaggtggccatggattcatcttcatctactgaaaataaaaagcttgaaggaaaacttgatgccttggtcaacctacagcaaaaccaacaacagcagaataattatgacctttcaagcaacaaatacaatccaggttggaggaatcatccaaatctgagatggataagtcctccacaacaacaacagtctgtccctccttttaagaatgtcgctggtccaagcaagccatatgttcctcctccaatgcagaaacaacaacagcagcagcagcaacaacaaagacaacaagcaactgaggcccctcctcaaccttccttagaagagttagtgaggcaaatgaccatccagaatatgcaatttcatcaagagacaagagcctccattcagagtctgacaaattag

SEQ ID NO: 53994 - DNA, 1428 bp, Glycine max
  Peptide Sequence Number=SeqID_145679
atgggcgcagaaggttttttgccaaccgcatcacgcattttttgccccacgccgccctggcggatactgaagcatcccacggcggcgtcgccgcgcaacccctggagaaatgacgtgagtgaactgatgactgaagtcagccccgagtttgaaagcaccatcatggaactgctggcacatggccgagtccaaagagtgggtgaagaaagcacacctgatccagaccgagctgatcggcctggacgaaggctgcggcaaactggcgatcaacctgatcaccgtgcatgcgcaggatcatctgatgaacgccatggtgatccaggatctggccgacgacatgatcgagctctatcgccgtcagtcgcagacggagggccgcccatgagcgcactcaaaatcgccgtgatcggcggcggcagcagctacacccccgaactggtcgatgggctgatccagcgcatcgaggagctgccggtcaccgagctggcgctggtggacgtcgaaccgggccggcaaaaagtggaaaccatcgccgccctgacccgccgcatgctggcgcgccacgggctggagcaggtgaaggtcagtgtgcactttgcgctggacgacgccattcgcggcgccgccttcgtgctgacccagttccgcgtcgggcaactgccggcgcgcgccgccgacgaacggctgggcctgaaataccagctgctcggccaggagaccaccggcgtcggcggcttcgccaaggcgctgcgcaccatcccggtgatgctggacatcgctcgccgggtggaaaaactggcgccggacgcctggatcatcaacttcaccaacccggccggcatcgtcaccgaggcggtgtcccgctttaccaaagcgaagatcatcggcctgtgcaacgtgccgatcagcatgcatcacatgatcgccaacatgctgcaggcgccttacgccgacgtgcagctgcgcttcgccggcctgaaccacatggtctgggtgcatcaggtcacgcagcaggggcgcgacgtcaccgccaaggtgatcgacatgctgtgcgacggcgcggcgctgaccatgaacaacatcaaggaagagccctggcagccggacttcctgcgcgcgctcggcgctatcccctgcccctaccaccgctatttttaccagacccgcgagatgctggcggaagagatggccgccgccggcgagcgcggcacccgcgccgagcaggtgatgcaggtggagaaagagctgttcgagctgtatgccgatccgcagctgaacacgaaaccggagcagctcagcttccgcggcggttctttctattccgaagttgcgctggagctgattcgtgctatccataataatctcggcacgcaattagtggtcaacaccgcaaaccgcggcgctatccatggcctgccggacgatgct

SEQ ID NO: 53995 - DNA, 312 bp, Glycine max
  Peptide Sequence Number=SeqID_145680
atggagcttagacgtatgcaattcaaagagacaagatcttcggcaactcgagaaacacgtcacaacatagatcatccaaccaattgtcaaaacaaactcaaccgtctccatcaagacattgattgcagagatcaaaacgttcatgaattataccacatcctacaaaaagacatggttaacaaagcaaagagcgttggagatgattcatggaaactgggaagaatcatatgccaagctgccaaaacttttgggagctttgcaatcttgtgtttctgggactgtggtcgctgctcaaacagaatccgtatttga

SEQ ID NO: 53996 - DNA, 1234 bp, Glycine max
  Peptide Sequence Number=SeqID_145681
taaagagaaatcaacagaggaagaggatcaagccacagaggagacccctgcaccaagggcaccagaacctgctccaggtgacctcattgatctagaagaggtagaatctgatgaggaacccattgtcaaaaagttggcacttggcattgcagaaagattacaaagcagaaagggaaaaacccccattactaggtctggacgaatcaaaactattgcacagaagaagagcacaccaatcactcctaccacatccagatggagcaaagttgcaatcccttccaagaagaggaaagaaatttcctcatctgattctgatgatgatgtcgaactagatgttcccgacatcaagagagccaagaaatcagggaaaaaggtgcctggaaatgtccctgatgccccattggacaacatttcattccactccattggcaatgttgaaaggtggaaatttgtatatcaacgcagacttgctgtagaaagagaactgggaagagatgccttggattgcaaggagatcatggacctcatcaaggctgctggactgctgaaaacagtcaccaaaaagtgtttgtcagaggaaaatgtattagattctcccactgctataatcaacaagtacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattggcactgccaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcctgatcaaaagactctcagacaatggcgttgatgatggagaagcagctgaggaagaagaagatgcagcagaggatacagaatcagatgatgatgattctgatgccaccccatga

SEQ ID NO: 53997 - DNA, 921 bp, Glycine max
  Peptide Sequence Number=SeqID_145682
atgtcctctcgggggaagaaaaccatacctttccttcgggtgtctcccctctttgagcagaattgcaactgtggtcaaggattcagcaagaggtttggaccgcataaaagagacttgaaacggcatagcgggcctaccacggaagtacctagaagacaaggcaaggggtatggccaatccaggagattgggtcccgtttatggatgtgttagctttgctaatttttggggtcgtcctctttccaaacgtagatggtttggtggacctagcagcaatcgacgctttccttgcataccacatagcaaggaaagttcggtggtagctgtcttggcagatttatttgacacatttaaccgaagggtaccccacgagggcattcataatggcatcattggtggctaccatgaatggctgaaagttcatatacgaggtttagattggctcgccaagttaaaagtcgtcagcgaagagagttttgaggcaccggaagaggacgaagaagtccaagctctcaaaagcgagttaggaaaggcgaaacttgccaaggagaagttcaagttggccgctacacacattcggaaggagtgtgccgggttacgggaagagaatagaactaccacaagggcccttgaacaagagaccaagagggctcgcaaggaagagtatggccggaataaatttcgcggagctctatggggtagcaatagtgaactcaagctgcgaagggaagagagggaccagtcgcgagcacatagcatggttctgaaagaggagttagttgcttgttcaaggtccaaaagaagcttgtctcagtgtttatgcgagacggagaccaacatgctagctatcatcgccaagtaccaagaagagttaggtctagccacggcccacgagcatagggtcgcggacgagtatgctcaa

SEQ ID NO: 53998 - DNA, 387 bp, Glycine max
  Peptide Sequence Number=SeqID_145683
atgtccaattttggatataatatatcgagacgctcaaaattgaacattgaaagctctcgagaaattcaaatgatgtctgatttagggataaaatatatcgagatgctcgaaattgaacaacggaagccctcgacaaattcaaagcgtcataacttttcactcggatgtccgattcaggcgcataacatatctagacgctcaaaattgaacatcggaagctctcgagaaatacaaatggtcattacttttcactcagatgtccgatttaggcgcatcacatatcgagacgctgaaaattggaacaacagtagctctcgagaaattcaaatggtcataacttttaactcagatgtccgattcgggaatataatatatcgagacgagtga

SEQ ID NO: 53999 - DNA, 588 bp, Glycine max
  Peptide Sequence Number=SeqID_145684
atgtctgtcatagaattatgtgttgaagttgatgttgcgggtgcttctgcaattaatttgacaaattcattattatcatgcggaaataatatgtctcacaatgaatctggtagtgcaacagttggaacaaattcagaagaagattttgatgatgatgattatttaatatctaattcatacgttaaggactcatcagatgaagatgaggatattgatgaaatgtctgacacagatgatgaagctgcccgtttgatcgaaccacttacaattgtgcaatcgggagaaggtggaagtcagactccattctgggattctgcttctcactatagtaatattaattggagtcatcctgaccaagaagaaatttgcggtttagatatgggatcaaattttaatatgggtcaagaattatatgttggtatggaatttgataccaaaagcgcagtaaaaaatgcattacaacaatatgtaatgaaagtgcatcaaagtttcaaagttgttgaatctaaatcgcagaaatatgtcgtctgttgtggaaatagaagtgatgacatcccatgccctttttatatgagggaaattttataa

SEQ ID NO: 54000 - DNA, 411 bp, Glycine max
  Peptide Sequence Number=SeqID_145685
atgtctgtttcatctcggggaatcacacgacatggaaacctgcctcgcagtggaagagctacttcaacggctcatggactgggggcagctcgaagtgtccgagaggggaatatgatcagccccaggtctgagtacccctcgacagtgcccaagccgacgccattttcctatcaaagcaataaggtcgtcccatggaaatatacccctcccgcttttggagaaagggctgcaaccgaggttgactccttgtcagccaaggtgaccaacattaccggccttagtggcgtaacccgcagtggtcgggtgttcactccccctcactcagcggaattgccctccaaggggaaagcacccatgacccaagagtccgtaggcgtggccccccctcaaaagaagtggatcccccggtag

SEQ ID NO: 54001 - DNA, 425 bp, Glycine max
  Peptide Sequence Number=SeqID_145686
atgactaccttgacccagacatggatgacgttgctgctcagcaacatcctacccagcgatcataattccgacctccctctgccgaagtgtcagctggtgtatgccatcctgacacggatgaacattcatgtggctcaactgatcgctgatgccatttatttatttgtaggtatgccacctaccaggtaccttctagacccagataagtctaatagggccctgggtttttcgacattgatcacgggtctctgccagtcgttcagggttcctgtcacacctagtaaggtgattcgactgccgatcacccgggctttcatagagaagtattacacgcccagacaggcgcagggtggcgacccgcaggccccagatgcaccgccgccacctcctcaggctaacccagctgggtcatttgacacggagcg

SEQ ID NO: 54002 - DNA, 295 bp, Glycine max
  Peptide Sequence Number=SeqID_145687
gcatggagcggtatctacagcacttggttcaccaacaggcggccaaccaccggggcaggtgcaaatacatgagtgtctctaccagctcagcctcagtcagcagggccagggtttcgctccttttgcatgccctactccagatcagtttagggctgaggtcgcatggcccggagattggcccgaggaccagacggaggaggcacctgcaggagctcccgacgatgtagaggacgcccgtagggatgaggagatgacagacttgctcggcttcttgggaggaagcggagccacgtga

SEQ ID NO: 54003 - DNA, 672 bp, Glycine max
  Peptide Sequence Number=SeqID_145688
atggcgtccggccaggcgggttggcgcctctgcgccagccaggcgcgcccggcggtcagcagcagcaacaggagcagcagaacgataccgaccagtcgctggttcagccaggcgtaccccaccaacagcgccgccggccccacggcattcagccagggagtgagaggagagggcgtcagcgtgagccgcagctggcgtttaaacggctcgtcatcggcgtgcagcgggctgtgcaacagccagttcagcagcgccgggcgtttgggcgttaccgccggagatggacttctcattacagcctcgtcaataaggtcgctcttgcggcggcctgaagttttttgcacgctcggtgctgtgattttggattctatgtggttttttcgttatttgtcagagtctggtcggatcaggaataactttcagaataatgaacctgctggccgcagcgggggtaaacgcgatggattgaagaatggcgctgtcgccgcgcgctttccggtttacggtggacgctttcgcgccgctgtcatgatggttgtaacagcatattcttcgccatcgcctgttgatgatgggcgtgttggcactggcgatcctggggtcgctgctgctggatttcaccatggggccgtccgggctgtcgctgtcgtctttatggcaaacgctgcttga

SEQ ID NO: 54004 - DNA, 1200 bp, Glycine max
  Peptide Sequence Number=SeqID_145689
atcgtacccggcggcgaaggcgtggcaggtgtcgatgcaaacgccgacgcggcttttgtcttccacgccgtcgatgatcgccgccaggtgctcgaatttgaagcccaggttgctgccctggccggcggtgttttcgatcacggccgtcacgccggcggttttatccagcgcgatgttgatcgattcggcgatgcgcgccaggcacttgtcttcatcgatttgcagcaggtggctgccggggtggaagttcagcaacgtcagccccagctgttcgcagcgctgcagctcgtcgatgaacgcctcgcgcgatttttccaacgcgtcggccaccgggtggcccaggttgatcaggtagctgtcgtgcggcaggatctgccccggcccgaagccgtactgggcgcaggcgctcttgaacttatcgatcacgtcggcggccagcggcgcggccttccattgacgctgatttttggtgaacagggcgaacgcgagccagtgttgcaccagttggtttatcgcgccgccgccgaccagcagccagacgaacagcagcgtggccaacagaatcggtttcatcccggcctggcgcacggcgctgatgtgggtggtcaatcccagcgccgccatcgccatcgccagcatccaggtgtcggcggtgatcaggtgctgcaccagcatggccggcagcaggttgaaggagttcagcccggcgacggcgataaacagcacggcgaaccacggaatggtaatcgcggatttttccgccttgcctgcgccgccgcggctgatgtagcccgacagcagcagcaggaacggcgccagcatcatcacgcggatcatcttggcgatcaccgccgcattttcggcgtcaggcccgatggcgtgcccggccgcaaccacctgagccacttcgtggatggtggagccggcatagatgccgaaggtttcctggctgaacggcagccactggaagtgttcgttcagctgatacagccacgggtaggcgaagatcgccagggtgccgaacaccaccacggtcgagaccgccaccgctactttactggagtcggccttcagcaccggctcggtggccatcaccgccgccgcgccgcaaatgctgctgccggcgccgatcagcatcgcggtctggctgtcgatgccgaacactttcttgccgagccagcagccagcaggaaggtggtg

SEQ ID NO: 54005 - DNA, 702 bp, Glycine max
  Peptide Sequence Number=SeqID_145690
atggggacaaatcaaaccagcaagaggttttaccaagtcaaggttaaaggcctagataccaccagcatcaaggaattagggcggttgatggaacctctccaaatgcaagccttccgcaagacttacggaaagatcttagatttgaccatagcagaggtatccatagaggccattgcgtcactcacccaatactacgaccagcctttgagatgcttcacgttcggagacttccaattggtaccaaccattgaagaatttgaggaaattctaggatgtcctctcgggggaagaaaaccatacctttcctccggggtgtctcccctctttgagcaaaattgcaactgtggtcaaggattcagcaagaggtttggaccgcataaaacagactcggaacggcatagcgggcctaccacggagcaagacacaaggcatccatgtccgctcctgagccatcgctcgtgtactgaaaagaggagaatagattgggaccagcttttggccgggataggaggtggaacaatcaattggttcccccgatggaaggaaggaaaagaaggagtccttttctcatgtggaggatacccaaacattccgctgataggagagaggggttgtattaactacaatcccgcgctcgctataagacaactagggtaccccatgaggggagccccggcggaagaaggcatgtctcctttcctt

SEQ ID NO: 54006 - DNA, 219 bp, Glycine max
  Peptide Sequence Number=SeqID_145691
atgtttaaagagaaattcccagcatgttctattgcagcaaagaggcatatagataaaacaacaacaatacttgatgtgcatggagtgaattgggttagctttagcaaagttgcacatgatcttgttatgcgtatgcaaaaaattgatggtgataactaccctgaggaaaaaggaggcaagctattcatgacaggggaaggtgaatttagtactaagtag

SEQ ID NO: 54007 - DNA, 888 bp, Glycine max
  Peptide Sequence Number=SeqID_145692
atggggacaaatcaaaacggcaaaaggttttatcaagtcaaggttaaaagtctagatgtcactagcctcaaggaattgggacgattgatgggacctctccaaaggcaagccttccgcaaagtgtacgggaaaattctagatttggccgcagcggaggtatttacggaagctgtcgtatccctcgcccaatactatgaccatccgttgaggtgtttcacgtttggggacttccaaatggtaccaactattgaagagtttgaggaaatattaggatgccctcttggggggagaaaaccgtatcttttttccggctttcttccttccttgagcaagattgcagctgtgattggagattcagcaaaagagttggattgcatgaaacaaactcgcaatggagtagtgggcctgccacagggatatttggaaggcaaagcaagggatatggcgagccaagagaaatggggcccgtttgcggatattttagctttgctgatttttggggttgtcctctttccgaacgttgatggtttggtagacttagccgccattgacgctttcctcgcatatcaccatagcaaggaaagtccagtggtggctatcttggcagatttgtttgacacctttgaccggaggtgtgagaaaaacagtgcacggattgtctgttgtttacccgctctctgtgtgtggttgatttcacacctattccgacaagacacgagacacccgtgtccgcttcaaagctatcgctcatgtgccgaaaaaggaagagtcgattgggaccaacatttggctgggatagggggcagcgcgatcaattgtttcctcgttggaaggaaggcaaggaatgagttatcttctcgtgtggggactaccctaatgttccattga

SEQ ID NO: 54008 - DNA, 311 bp, Glycine max
  Peptide Sequence Number=SeqID_145693
gttcaagatccctggatactgaaattaagatgacttcctcaaatggaaattttccagcatctatacatgttctcataggcaagaactatgatgattggtgtgctcagatgaaggaggcatgggatattcaagacaaatcctatgcaggggatagcaaactcaagaaggtgaagttgcagaccttgagaaggcagtatgaacttctacaaatgagtgatcaagaaagcattgacttgggaatcattgacaaggtattaagaaccttgacgccaagattcgatcatatagtggtggcaattgagcaaggctag

SEQ ID NO: 54009 - DNA, 384 bp, Glycine max
  Peptide Sequence Number=SeqID_145694
gaggtgttgcaaaagaaggacaaggaactcaggggcaataaaaatgggcccattggtggctatcgtaagtggttaaaagcccacgtgcaaggttttgattggcttccaagtttgagaaccgctaaaagagaggaagttgaggcaccggaggaagacgaagaggtgcaggcccttagggcaaaactcgagcaagcccaaacagttaaagaaaggttcaaatcagtagctctgaaaatccgaaaggagaataccgaactgagagatgtaaatgtggctatcaccaaagccttggaacgagaaaccaagagggcttgtagggaagaacacgaccggaacaaattccgaggggctttgtggggcagcaacagcgagcttaaactctga

SEQ ID NO: 54010 - DNA, 726 bp, Glycine max
  Peptide Sequence Number=SeqID_145695
atgaccttgctgggggggacgggcaccctacacatcctcgtcttcagaggactacacgtcctcacctttagaggacaacacatcgtcgccatcagagggctgcatgccctcaccttcagagaacaacacgtcctcgcgatccgagggatacatgccctcaccttcagaggactacacatcgtcaccatcagagggctgcacgccctcaccttcagaggactacacgtcctcgccattagaggactacacatcctcgccttcagaggactacacgtcctcgccatcagaggactgcacgccctcaccttcagaggactacacgtcctcgtcatcagaggactacacatcctcgcctttagaggactagacgtcctcaccttcagaggacaagacgtcttcaccatcagaggactagacgtcctcgcctttagaggactacacgtcctcaccatcccagggctgcacctcctcacctttagaggactacacgtcctcgccagaggggtgcacgccctcaccttcagagggttacatgcgctcgcatttacaggactacacgtcctcaccttcagagttctgcacgtccctacctttagagggctgcacgccctcgccttcaaagggcgacacgtcctcaacttcagagggatgcacgccttcgcctttagagggctacgtgtccttattttcagtgtgctccatattcgcaccttaggagaaatttaa

SEQ ID NO: 54011 - DNA, 329 bp, Glycine max
  Peptide Sequence Number=SeqID_145696
gatttacatgcgattctcctcaaatttcagccaacccgcatcaattagaccttgcaccttacgcttcaggcccctacaatgctcaatggaatgccccggggcttctccatgacaagcacacgttgcgttcgagtcgtattctcggagaaatggaggttgatgaacctcagctagcgttatggctaccattgaattatcaagtagatatgcgagcaatttacgctaaaggtgggatggcctttgtggataattgggcggtgggtaaggagaaggttggttattggctgagtaatgacattgttgggttggtgggaaacttggctgtatag

SEQ ID NO: 54012 - DNA, 135 bp, Glycine max
  Peptide Sequence Number=SeqID_145697
atggtggtcatcctgcccaaggaacacttagttgtctggttttgttcattgcataacaggccagacaactaccttaaggggattgttaatagtgctatcaagggtcttgatgatgctccactgtggcgtccctaa

SEQ ID NO: 54013 - DNA, 577 bp, Glycine max
  Peptide Sequence Number=SeqID_145698
atggctgctagtgaccacacaattctgcgtgatagagcatacattcctaccaaaagaaggctgctagagcattcatcacaagatgaattgttggcacaaaacaagcttctgtccaagcaactggaagcattgactgaaacattaagttgtctcatatgtggtggagcacatgagtctggctattatatttcccaagaagaagcaacacgtgaagtgaactatatggggaaccagccaagaccaaatttcaatgcaggtgggcattctggatttcaatatggccagcaatatcattcacagcagggacagtggagaaatcaccctcgaaatcaatttaataaagaccagggtggtccatctaacaggccacaacaacaagggcctagtctttatgatcgaacaacgaagctggaagagacttttactcagttcatgcaagtttcaaagtcaaatcaaaagggcacagagtcagccattaagaatctggaagtccaagtgggacagttggcaaaacaattggcagaccgtccgtctagcagctttggagctaatactgagaaaaatccaaatggggaat

SEQ ID NO: 54014 - DNA, 282 bp, Glycine max
  Peptide Sequence Number=SeqID_145699
atgtcgctgcatgttctttatctttatgcgttttctggatttcccccagggatttcccgtctgctgtatctctcgttacaatctttcacagaaatgaacgtcattcgaggctttagtcctcacgggcaggatcatcttgagctaccttctggggtagagacaaaacatgaacagcaaaaaccaatcaagggacggatgcaaatggggatggggtcacgaccgactgatcgtcgccccttctccgcgctaaacgagcagagaacgtcgctgcaaggcggcccc

SEQ ID NO: 54015 - DNA, 269 bp, Glycine max
  Peptide Sequence Number=SeqID_145700
gtttagacctgcgcggcctatccgactcaatggcattaaccgctccccctccatgattggcgagcggatcttcccgggagttattacgaccatttggttggcgataagggacggcaagaggtcttcatacgtcattgggagtggggtgaattctggaattggcttcgggggaaagttcctcattgtgttggaattgccggccgggcgagtcgtggttggggccggaacttggggggcctccctctggatgggtgccttaggctgcacgg

SEQ ID NO: 54016 - DNA, 499 bp, Glycine max
  Peptide Sequence Number=SeqID_145701
cgcgctgaacaccaatatcttcggtgagccaggctggcagggtaccggctggcgcgcagggcgcgatctgcagcgccatgatatcggcggtaaaacggggacaaccaacagctcgaaagacgcgtggttctccggttacggtcccggcgtggtgacctcggtctggatcggcttcgacgatcaccgccgcgatttagggcgtaccacggcatccggcgcgattaaagatcagatttccggctacgaaggcggcgcgaagagcgcgcaaccggcatgggacgcctacatgaagtccgttcttgaaggcgtgccggagcagccgctgacgccaccgccgggcgtggtgacggtcaatatcgaccgcagcacgggccagctcgccaacggcggtaacagtcgcgaagagtatttcattgagggcacgcagccaaccacacaggcggtgcacgaggtgggtacagagatcatcgataacggcgaaacgcacgagctgttctaa

SEQ ID NO: 54017 - DNA, 346 bp, Glycine max
  Peptide Sequence Number=SeqID_145702
atggactcaaacactgaagccaattacccctatatatgggtgttgatggaaagtgcaatgcaaatgaagcagccaagaatgctgctactattaattactgggtatgaggatgtccctgccaacaatgagaaggcacatactcaaaaagctgtggccaataacccggtttccgaagctattgatgccagtggctctgactttcagttttacaagagtggtgtcttcactggttcctgtggaactgagttggatcacggtgtcactgccgtggggtatggtgttagtgatgatgggactgaatattggttggttaagaactcgtggggaaccgagtggggtgaagaag

SEQ ID NO: 54018 - DNA, 546 bp, Glycine max
  Peptide Sequence Number=SeqID_145703
gaaattactccgaaaaagctttcctcgaagacatctaggagggacgtcacggctgaagggaccaatgccgcccccgagtttgatagccaccatttcaggagcactgagcaccagcagtgcttcgaggccatcaaaggatggtcattccacagagagagacgcgtccagctcagggatgatgagtacacggattttcaggaagagatagctcgccgacattggacatcgctggtcactcccatggctaagtttgacctagatatagtcctagagttttatgctaatgcttggcccacagaagagggagtgcaggacatgcggtcatgggtgaggggtgagtggattccctttgacgcaaatgccctgagccagttcctggatgacccgttagtgttggaggaaggccaggagtgcgagtttagtcagaggaggaacaggaccgatgggttcgatgaggaggccattgcccagcattatgcataccgggtcaggatttcgcccggaccactaacgggaggcgggtgcggatcatgcgcactagcatga

SEQ ID NO: 54019 - DNA, 938 bp, Glycine max
  Peptide Sequence Number=SeqID_145704
agccaataaccaagaaggcaactacatcatcttctgggtcacctactcagactgggtcatcaacccagaaaggaaagcgtgaagggtcattgacccagataactaccgttaaacctgagtcatcaactcaggaatccccaaaaccaacaacaacaaaacagaccgtggctgactatgtctggtcaatacaaactctcctggccttagaagacataggcctcaccagagtaccaaaattggccaaaaagacctgggcagaaatggcctcagaatcagacgatgattctgaaacaaatctgcaaaaacaaatccaaaaagctaaacaaaccaaaactgtctgtaaccaaaaaccaagccaacagttgacccaacaagaatcaacaccacaacccagcaatagctatatttccaaaaacaaattcttcaatgtcttgcaaatggaaccagaatactgggacaagaatcctttcaaggcaaccgccaaaggattccaacaattcagcaagctcttcaatagcaaggaatcaagaattccggcagatttaaaatatggaaaaaccgaaaacagcaaacagtacccaccattgcagagacatgcctttgtaaaatggtggtcacaattcgataccccaaaggctgctccagaacaagtcaagaactggtttcagagcaactctgagtttctcaagcctgctgatccagagacatctttgtttctgaatcaaaagtctcaacttgcagcgttcttagcaagctcaaaatctaaagagagtcttgctcagaatcttaaggaagttctccaactacttcaacaagaagaagaagaagaactccccaagaaagaagccgaatcatccgagaataatgatgaccaggaagatgatccattctaccaaaatgaagatgactgctttggtatatcgttagacgatgattag

SEQ ID NO: 54020 - DNA, 145 bp, Glycine max
  Peptide Sequence Number=SeqID_145705
ggaattggaaaggaggatcatggggcctccaagagtattgaatgatcttaagagtgcccttaggaagaggcacattccctcctattatgaaagggagcttatggacaagctccaaaggcatagacacagggagtatgagtgttga

SEQ ID NO: 54021 - DNA, 396 bp, Glycine max
  Peptide Sequence Number=SeqID_145706
atgggtgccaaatacctcgaagtggtcaaacgatggtcgcatcccaacaacggatggtccccggacaaaattagggtatacacccgcacctttcgtcaaccgggggcaaacgagcccgttgacgcgcagagactaacatcgtctcccgcaccttttgtcgtcctgacccgtgaggtgatatgcgggattacctcatggttacctgcacctttcatcaaaccgggggcaaacgagcccgttgacgcgaagagactgacatcgtcttctacactctttgccatccagggacatcaagtcaggtggcaggcggagataccttatggtcatcggcgcctttcgtcaatcgaggggaacgacttcgacggtatcaggatgatgttggccgttcggtgctga

SEQ ID NO: 54022 - DNA, 734 bp, Glycine max
  Peptide Sequence Number=SeqID_145707
aagcagagaaggatgtgagctcaccattgaagactgttgaggaggaaaaggcagctgaggttattgatccattgggagagttggtgaagaacttgttcgacatttaccaaaggcctgttgaggtgtcatgggatggtgctaaatttgggatcaataatgtcaaagatggcttcttcatcacacacgctgatgtgagcgagataatattaggagacaagtttattcatgattggagtgcgagcattggttatggagcattgtatgggtttcttgaacctcagtgtatccacaatgcaagcagtagacatcaagagtgtgaaaattacattggaaggtggttgaaggaagcaggaaaacaaatttacatagcaccttatttaaaccagcgacaatctagtggtttggttttgttctttgcgaaagaagtcggatgttgccatcaagggtgcagtaaacagtgcaatgaaatcagtcaccaaactgcagagggaaagccacctcagcatgggcctcagtggattgaagcaaagagtcatgttcaaacaggaaattacgagtgtggatactatgttatgcaatggatatggtgcatcgtaagtggtggattgaaggatgactggattcactggttttctgatcgatcagcgctaacagaagagaccatgaccacactccggcataaatgggcagcatattttatccaaatgaagaaatgcgaaccaagaaaaaattag

SEQ ID NO: 54023 - DNA, 276 bp, Glycine max
  Peptide Sequence Number=SeqID_145708
atgagattttttcagccagttgtgaagcattgctcaatggaagcatacttggtctgctttttccattggaaatctgaagaagaaaccatttacatgaaccagcctgaaggttttgagaacgggagcaaagataacagctcaatagtgagagtacctgaaattttgatgagcattcttgatcagatatggcagttcattaaaaagatctcgctgatcaaggagaagctggagataatgaagagctggttactcaacatgactgtgtatatatcctga

SEQ ID NO: 54024 - DNA, 303 bp, Glycine max
  Peptide Sequence Number=SeqID_145709
atgtctttcctgcgttatccccggattctgtggataaccgtattaccgcctttgagtgagctgataccgctcgccgcagccgaacgaccgagcgcagcgaaggacgaaagaagggtcctctgttatttccagacgcagcaacgacttcttcttccctttttgtgtgttgacgtgactaacgacgacatatgttgcaatgaagcccagaaagcccaggttgggggagctactggggcagatccacaactaacattcacccgttcctcttaccacgtcaataacctcgagaagggtatgccctaa

SEQ ID NO: 54025 - DNA, 699 bp, Glycine max
  Peptide Sequence Number=SeqID_145710
atgctttctcataagggtggacccttgggtactagtaccctctccttcagaggactgcacgtcgtcaccttcagaggactccacatcctcacctttagagggtcatgtaccttcaccttcagaggactacacgtcctcgcctccagaggactacatgtcctcgccttcaaaggactacacgtcctcgccatcagaggactccacgttctcatcttcagaggactgcacgtcctcaactttaaaggactgcacgtcctcgccttcagaggattgcacgtcctcgcctttagaggactgcacgtcctccccttcagagggctgcacgccctcgccttcagagggctgcacgtcctcgcctttagagggctgcacaccctcaccttcagagggctacacgccctcgcctttgtagggctacacgccctcaccttcagaggactacacgtcctcaccgtcggagggctacacgccctcgcctttagtggactacatgccctcgcctttagaggactacacgtcctcgccatcagaggactacacgtcctcgccttcagaggacttcacgttcttacctttagagggctacacaccctcacccttgagaggactacacgtcctcaccttcggagggctacacgccctcgccttcggaggactacatgtcccccttttcagagggctacacgccctcgcctttag

SEQ ID NO: 54026 - DNA, 622 bp, Glycine max
  Peptide Sequence Number=SeqID_145711
cttgggaggattgatggggacccggcgttgagaggaacgaggataagggctacgtgggagtacgtgagctcagttggaggtgggcaacaggggatggagaccttggggacgtcaggtggggtgctattgcccaaaaccaagcttgaccaatcccgacccaacccgggcatagtcattgtgaaacttgagatgaagctaggagggcttctggtaatcgattaccaagggatcgtgatggcggcgcaactaattcatgatcgagtggagatggagtgcctagagggagcttgggagaccctcgaaggcaatgcgaggtgccgattctggggcacgattcgattcacggctacttcattggtgcatccagatgaacccgtgcacacgtttctgcgtactgtggagtggatactacccacacctacaccataccgtctagtggagccagtccaagtgatcgaggtgacatcatccgaggaagactctgaagaggaccctgaggagctacctcccgagcctgctgtggatgctcttgactttctagagggtgatgaggacccactccctgaggtggattctcccgaggacgtcatgtcggcatctgaggcagactctacggaggata

SEQ ID NO: 54027 - DNA, 863 bp, Glycine max
  Peptide Sequence Number=SeqID_145712
tcatgacccttgcaagagcctaagtgaagaacttcgtgactattatgaaggaaggcataggtcagatcttagacctcactcccataggagagaaaaggaaagaaagcctcaagaggctaacatttacctcccatacttccatgggaaggacaatgtagagacttacttagattgggaaataagggtagagcaacaacttaaaaggaagtctattttaaaatcttattgccctcacagttatccaaagaaagaccaaggtcaaggcatcttaggggcagcaccttctaagcccaaagatgataagggggagacaatagaaaagcaaccccctaaggctagtatgcaagaaaagactagctctataaagtgctttaaatgtcttggaagaggacacattacttctcaatgccccaccaagaaaaccatgattatgaggggccaagacatttatagtagccaagatgaggctactacttcaccttcctctagtgaaagacaacctttaatggttaaggaggagtgtaaggaggtaagtgtctccttcaagaagttagctaagaaagaaagtcattttgcaataaagacaaacattaaagaaacttccctttgtaaaaagacacttgttagcactgccacaactcttgggcttgagattattcctcaactaaaggagttgttggatgagggtttggttcataagagcttaaatccttgtgctttgttggtgcccaaaataggtgttatgaggcaccaaatccctatgataggtggtatagtgaatgtgttcagtggtgcaatcctcttttgtaaaatcgcccatgcatccaacatcttcatgattcacatacatagggactcattag

SEQ ID NO: 54028 - DNA, 399 bp, Glycine max
  Peptide Sequence Number=SeqID_145713
atggtagcctggcccgggacccaaccttcttttcacatggaagatgaaggtcccatagcccaggtacctcagcatgtggaggatgagtcatctgaggccaccatcccagatccatttgttataagagaagagacagatgagaccctggtgagacaggtagttgctgccactcccgagagatcccttgaggccacttcagagcctcctgcaccagtggtggacctaccctcacctcagcatacagtagacccttccactcctatcttagagataccagaggacccgaccacaccagtcctggctatggacacttctcttccagctactctagtacttcatctgacagatgaggaggatgttcagacacaggacacccaggaccagtcacaggaattctaa

SEQ ID NO: 54029 - DNA, 303 bp, Glycine max
  Peptide Sequence Number=SeqID_145714
atggaagaagtggataaggagatcttagagaccttcaggaaagtagaggtgaacatagctctgctggatgccattaagcaaattccaagatttgccaagtttctaaaggagccgtgcacccacaaaaggaggcttaaaggcaatgaaaggattagcatgggcagaaatgtgtcaacattgataggtgtggtgattcaattggcaaatagaagcgttgctcaccccacaggtttcatagaggatgtgttggttcgagttggtgaacttatttttcctactgatttttatgttcttgatatgtaa

SEQ ID NO: 54030 - DNA, 264 bp, Glycine max
  Peptide Sequence Number=SeqID_145715
atggcaagagctggtgacaatggtggaatatatcatcaactggacgaatctcagtgcttatttctggacgcgtggactacacaaatgcaacgtttgttgaaccgtgaaacaaagaagaatgaaagctatgccagacgaatagccaacaagaaaaggaaggaagtggtacttcctccgtttgagactcttaaatgttttcccctagagaagggaatgatgcaaatcagaatgagagaaaagagagaacaagagaaggagaactaa

SEQ ID NO: 54031 - DNA, 433 bp, Glycine max
  Peptide Sequence Number=SeqID_145716
atggcgaagatcatgttgaagttcgcggttccactagatactattttaaacaccgttaacatttacggtgaagttagtaggtcatttgttgtgaggtggaaagacgtacttgaccgtttatggcatttcattgacaaggatggaaatttccataccgttgtctacaaccaagatttggacaaatcagctattatagcaaggtggacaacactaagagatttttatcacttgaccggagatcatcaagtgtcgttaactcattatggtgtatctcactccgcacaaagttacctgcagcaacctgacaaaggctggacttatttgcatttagaggacgttgcagaatgtcggcttgtgttcaatcactggagaaagatagttaaaattggagctggatggaaatacttttgtgaaaccctatccttcaaagctg

SEQ ID NO: 54032 - DNA, 231 bp, Glycine max
  Peptide Sequence Number=SeqID_145717
atgtggcggaaaccaaaaggaggtgttgttgcgcaatccatgatgacaaaagtgatgaacaaaaagctcaagagaatcaaagaacatccatctcaagaaaatctagaacaagtgaaagagttcaagaatcaagaagaattcaagactcaagaagaaagcctacaaacaagaatcaagattcaagatctcaagaatcaagatcaagattcaagactcaagattcaagaatga

SEQ ID NO: 54033 - DNA, 78 bp, Glycine max
  Peptide Sequence Number=SeqID_145718
atggaatcctctgaagattatgaaaatgaagagataaatctctgccttatggctaaaagttacgaaagtgatgaagag

SEQ ID NO: 54034 - DNA, 136 bp, Glycine max
  Peptide Sequence Number=SeqID_145719
atggctctgaggaagctttccacaaagagatctaggagggacaccgcggctgagggaccagtgccgctcccgagtttaacagtcatcgtttcaggagtgttgagcaccaacagcgtttcgaggccatcaaaggatg

SEQ ID NO: 54035 - DNA, 405 bp, Glycine max
  Peptide Sequence Number=SeqID_145720
atggcaagagctggtgacaatggtggtgtatatcatcaactggacgaatctcagcgcttatttctggacgcgtggactacacaaatgcaacgtttgttgaaccgtaacaaagaagagccctacagacgaatagtcaaatcttccttgtttactcttaaacctctatcccctagagaagtgcaaattgcaaagaagaatgaaagttatactaagcaagccaacaagaaaaggaaggaagtggtacttgaacctggtgatgatcctggacatttgagggcaaatgttttccaagaaggagggaatgatgagaatcctgaaattggccaaatacaagctaaaagcccaagtggagaaggacgaaggctcaagtggagaaggacaaagcccccgagtggagaaggatga

SEQ ID NO: 54036 - DNA, 264 bp, Glycine max
  Peptide Sequence Number=SeqID_145721
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgattcctgaacacaagggatggattgtccctgtgtggttcagaagttgtaaaggattttacaaagatagtggaaatctcaagtgggttgcttga

SEQ ID NO: 54037 - DNA, 570 bp, Glycine max
  Peptide Sequence Number=SeqID_145722
atggtgggagcaggtttgaaaaaggatcttagagtgtctagggttgtgccaggagggtctcttaatgccttcctttttcttctcatcggagttatttcacaaagacttgccatggtaaagaagaagggggaacaagcacacttggagagcgcagtcaacgtagttgtatgctgcgaatttggagatggaagtcttctttcgtttctcccgatggtgaaaggaccgaaacatgccactgaaagactctacctgtttgagacaaagacgggcgttaaccagaacgttagtcctcaggaggtaggatgggcagttcaggtcagatccaatgtaggatcgtacatggacggtagtggagtcggtggctctcactcgtgggatcctcattgggatccggggaagaggaccaccagctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggggtga

SEQ ID NO: 54038 - DNA, 237 bp, Glycine max
  Peptide Sequence Number=SeqID_145723
atggagctgatagagaacatgacggccagtgatcacgccatccttcatgatcgagcatacacgccaacaaagagaagccttttggaactcacagcccaagatgcaacactggctcaaaacaagttattggcccaacaaataaaggccatgacggagaccctcagcaagctccctcaacatttacaagcgggggatgccatatctgtgatggagcacatgaaacaaggcaatcaatag

SEQ ID NO: 54039 - DNA, 231 bp, Glycine max
  Peptide Sequence Number=SeqID_145724
atgacagccaccgctttaggagcgttgaacaccagcagcgcttcgaggccatcaagggatggtcatttctccgggagcgacgcgtccagctcagggacgacaaaggagggcgtgcgagatatgaggtcttgggtgaggggtcagtggatcccatttgatgcagatgctatcgtccagctcctgggatatcctttagtgctggaggagggtcaggagtgcgagtatggctag

SEQ ID NO: 54040 - DNA, 795 bp, Glycine max
  Peptide Sequence Number=SeqID_145725
atgaggacaagcggttgcatcagttacaatcccgttcttgctataagacaacttggctaccctatgagaggggcaccactagaggaagagctcgcacctattattgcacgaggtttcaataacaccaacgtggaggcgcttcagaaggtctgcaaggcatggaagatgctgcaaaagaaggacaaggaactcagaggcagtaacaatgggcccatcgacagctaccgtaggtggttgaaagcccacatgcaaggtttggattggctcccgagtttgagaaccacaaaatgggtggaagttgaagcaccgaaggaagacgaagaggtgcgggcccttagggcagaactcgagcaagccccaacagtcaaagaaagcgagcttaagctccggagagaggaaagggaccaatcacgagtagacagtttgatcttgaaggatgagctgaaggtttgcctaaggtccaagagaagcttgtctcagcatttatgcgagacacagaccaacatgttagccatcatcagcaagtaccaagaagaattaaatctagccacggcccacgaacacaaagtggcggacgagtatgcccgagtgtacgtggaaaaacaggctataggaagggtgtttgactcgttacatcaagaggcgataatgtcgatggaccgatttgctcttactttgaacgggagtcaagaacttccccgattgctggccaaggccaaagcaatggcggaaacctactccgcccctgaggagatccacggacttctcagctattgtcagcatatgatagactaa

SEQ ID NO: 54041 - DNA, 174 bp, Glycine max
  Peptide Sequence Number=SeqID_145726
atggagtctcaaaacttccttgaaaaaagagttttgagatgtgggaagcatcatccaccttgtggcatgatagagtctacacctctttgggttctaggaagcctaaggacaaagtccatactaatgtctacccaaggtgcagaggggatgggtaagggtgtgtatagcccatga

SEQ ID NO: 54042 - DNA, 402 bp, Glycine max
  Peptide Sequence Number=SeqID_145727
atgagaagatccacaagggatgtaccctccacaagcgacctgcggtccttgagatttcttttcaaccatgtaaaagcctttacaagaaaagatccacaagggatgtaccctcccttcttctctttgaacaacctagtggatgtaccctccactagaactgatccacatgagatgtaccctctacttgtaccacgaaggatggaaaggggagaatcaaaagaattatcagactgtgtcgttttgaattctttgacaacggagaagggagacacaaaagaattcaggcggttagtccttcattcttttggaaaagggagaagagagacacaaaaagaattcaggtggttagtccttggcgaattctttttggcaaagggagaagagaatgaaaaagatgaatag

SEQ ID NO: 54043 - DNA, 330 bp, Glycine max
  Peptide Sequence Number=SeqID_145728
atgtatcaatatccttttgaaggtcatcacactgatatgtctgcaagcgaacattcgttcggtggtgttgcggaaacacatcctcattttttatggccgactatgatcccttcacagcaacatgatgccccaatggcaacacctaacgccccattagcttcacaatggaatgtaccccgagcaatacatgatatgggtgacttattaggtgttgatttgcatcacgagttttctgctgaggttgagcaagtagaagcggggagacatcacgcagaagcaatcctgatcgtcaagcgcgaagataggctcgaccatgtggcacatcctcac

SEQ ID NO: 54044 - DNA, 363 bp, Glycine max
  Peptide Sequence Number=SeqID_145729
atggccagaacacgaggtttagtcgtgctctttctaggagttgctggcgatgttctcgagaggcgtaggcctactgcctcagcccgtagactacgcgttcatcagatgactacggaggatgagggtcttggtggaccacgtgacccgtcaggtcacatcattgcgagggtacttgacatgctgggagctggtcagtgctggatctatgagcacttccctgttagtgtgcatcagtgcgtgactgaatacatacctgaggagacgtccccacgtgcttcccggtggttgacgtcgaaggcgcacatggggcatcacaggagcaccctacagggcacgtgtagatggtttgactggcgatcctag

SEQ ID NO: 54045 - DNA, 402 bp, Glycine max
  Peptide Sequence Number=SeqID_145730
atggacctttgggtactagtaccctcacctttagatgactacacgtcatcgcctttagagaactatacgtccttgccatcagagggctgcacgccttcaccttcagaggactacatgtcctcgccttcaaagggctgcatgccctcaccttcagaggactacctgtcctcgccttcaaagggctacacgccctcatcttcaaagggctacatgccctcacctttagaggactacacgctctcaccttcaaagggctacacgccctcaccttcaaagggctacacgccctcaccttcagaggactacaccccctcaccttcaaagggctacacgccctcaccttcaaagggctacacgcccttatcttcaaagggccacacaccctcaccttcagaggactag

SEQ ID NO: 54046 - DNA, 1071 bp, Glycine max
  Peptide Sequence Number=SeqID_145731
atggctcatggttcaccctctgtaccatcatctccgcaccagggacaacctgaattcaacatccaacccatacaaataattcctggtcaagcccctgttcctgaaaaactggttcccagaagacaacagggagtgaagattgctgaaaaccctagccttgcagcaagtcctagggaagtagacacggagatggacaagaaaatccgcagtattgtgagtagcattttgaatgacgcctctgttcctgatgctgagaaagatgttccaacatcctccaacccagatgttgctgtccctgaagctgatgaagatgtccaacatcttccacgcccgaaggaatcatcagaggaagaagatcaagccacagaggagacccctgcaccacgggcaccagaacctgctccaggtgacctcattgacctggaagaagtagaatctgatgaggaacccattgccaacaggttggcacctggcattgcagaaagactacaaaaccgaaagggaaaaacccccattaagaggtctggacgaatcaagactatggcacagaagaagagtactccaatcactcctaccacatccagacggagcaaagttgcaatcccttccaagaagaggaaagaaatttcctcatctgactctgatgatgatgtcgaactagatgtctcgacatcaaagaaggccaagaaatcagggaaaaaggtgcctggaaatgttcctgatgctccattggacaacatttctttccactccattggcaatgttgaaaagtggaaatatgtgtatcaacgcagacttgcggttgaaagagaactgggaagagatgccttggattgcaaggagaccatggacctcatcaaggctgctggactactgaagacagtcaccaagttgggagactgttatgaaggcctagtcagggaattcattgtcaacattccctctgacataacaaacagaaaaagtgatgattatcagaaagtatttgtcagaggaaagtgtgttagattctcccctgctgtgatcaacaaatacctggacagaccaacacatggagtgatggatattgct

SEQ ID NO: 54047 - DNA, 610 bp, Glycine max
  Peptide Sequence Number=SeqID_145732
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccttatcagtgtataagagttgccaatcctccagcagagcatcctgaaagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgacgctgcgccttatcggtaactatcgtcttgagtccaacccggtaagacacgacttatcgccactggcagcagccactg

SEQ ID NO: 54048 - DNA, 468 bp, Glycine max
  Peptide Sequence Number=SeqID_145733
atggaagagctttttaaaaggtggaatgaatatcttaacagcacacgatcaagggtcagccaaccaccattgatcaattgtgatttttgtggaggagagcattacaatgacaattttcatctctactccatgaatgactctaggtgggaacaagagttaagtccttacaatcaatatgaagaagaaaaaactcctaatcttgaaagtgtgtttgaggaattcatggcataccatgctagctcaaaagccaatcaaaattcaatgaaaaatcatgaaattcattttggcaagagctactcaatagaaaactttcaagggggaccaaagttacaaccttactatcaaaatgaagcagaaagaggttccaatttggataatttgttgatgcaattcaaggaaacaactaaatcaactcaacaagcactccaaagtgtaaaatccaagttagtgagctggcagaagaagtga

SEQ ID NO: 54049 - DNA, 948 bp, Glycine max
  Peptide Sequence Number=SeqID_145734
atggccaagtttgatccagaaatagtcctcgaattttatgccaatgcttggccaacagaggagggcgtgcgtgatatgaggtcctgggtgaggggtcagtggatcccgtttgatgcagatgctatcggccagctcctgggatatcctttagtgttggaagagggccaggagtgtgagtatggccagaggaggaaccggtccgatgggttcgatgaggaggccatcgcccagctgctatgtataccggggcaagattttgcccggactgctgcctggagatgggtgtggatcatgcgcaccaacatgaccaccctgactcagatatggatgactttgttgctcagcaacatcctgcccaagtgtcaactggtgtacgccatcctgacgcggatgagcatccatgtggctcagttaatcgctgatgccatctatgtttttgcaggtatggcgcctaccaggcaccctctggatccagataagtccaatagggccctgggatttcccgccttgatcacaagactctgccagtcgttcggcgtccccgtcacacctagcaaggtgattcggccgcccatcacccgagcttttattgagaagtactgcacgcagagacaggtccagggtgattcaccacaggctgcagatgcgccgccacgtcatcaggctggtccagccggatcatttgatacagagcagtatttgcagcatttggttccccagcaggcggccaaccaccgggcacatagccagggctttacttcttttccgcgccctactctggaccagttcagggcagaggtcgcgtggcctggagattggcccgaggcccgggcaggagaggcaccagcggaggcaccagcagaggctcccgacgaggcagatgaggcccgcgaggacgaagagatgaccgatttacttgatttcttaggagggggcggtgccacatga

SEQ ID NO: 54050 - DNA, 421 bp, Glycine max
  misc_feature (41)..(41): n is a, c, g, or t
  Peptide Sequence Number=SeqID_145735
gacgatgggtgaccaagaggagatacaggaacagatgaaanccgacatgtcggctatgaaagagcaaatggcttccatgatggatgccatactaggaatgatacaactaatggagaataacgtggccactgcagccgctgttagttcggctgctgaagcagacccaactctcccagctaccgcgcaccatcctttcccaaacgtggtaggacgagaaagaagcacactggggcacatcagcaacccccatctgggatacaaccgagtggcttacccttatggattaccacctaattacacgccaccagtcatgcgtgatgacacggagtatgcccaaggagacatcgatttctaccccccggtccccgtcgaggggccggcacccaacacactacctcaacccaacctcacgggagtgtag

SEQ ID NO: 54051 - DNA, 454 bp, Glycine max
  Peptide Sequence Number=SeqID_145736
gtatatgataaattcagttataacaatcttgtattccaatggaagagtatatgaagagattgatggaaagtatgttgcgttgcaaatttgtgatgacgaagatgttgaaactatgatcgaaagttttcaacaacaagatcaaatgtcaattcttgaattgtacatagaaaaggatgtggttggtggttatatgtttcattgtgtaaattctcttacatcatgtgaaaataatttatctaataatgaggcggaaccgccaagaattataagcaatttacatggtgatgaagatgatgattatcttgtgtctaactcatacgttgaagaatctttagacgaagatgatggtgttgacggtatatctaatatagacgatgaagtcaccaacatgattcaaccagtaagaattgttcacccaacagaaggtgtagaaggaattcaaaatccattctag

SEQ ID NO: 54052 - DNA, 810 bp, Glycine max
  misc_feature (731)..(731): n is a, c, g, or t
  Peptide Sequence Number=SeqID_145737
atggaagggttagtggacctagcagcgattgacactttcctcgcctttcatcatggcaaggaaagcccggtcgtcgccattttggccatgcccgtctatccgctacaaggtcaccgctcgtgcatcaaaaaaggaaaggcgaattgggacgaactcttggctagcatggaggggcgtctgttaattggttccctcgctagaaggaaggaaggatcaggattgtatcttcatgcgaaggatgtccaaatgttccctggatgggaacatgggtcccggacacaaggattggattggctcccaaatctaaagactgtgagagacaatgaggttaaagcttcggaagaaagtgatgaggtgcaagcgctaaaggcaaagcttgaaagagcccgggaatcatcacgggtcaaaggcatgatcttgaaggacgagctaaaggcttaccttaggtcgaaaagaaatttgtcccaacagttaagcgagactgaagggaatatgtgggccgtcatcgatgagtgcaaagagaagctaaatctagcggcgactcacgagcaaaggctagaggatgagtacgccaagatatcagcagaaagcgaagcaagggagagggtaattgattcatggcaccaagaggcaacaatgtggatggaccgatttgctcttactttgaacaggagtcaagaacttccccgattgctagccaaggccaaagcaatggcggacacctactccgnccccaagaagatccacggacttctcagctattgtcaacatatgatagacttaatggaccatatgattagaaaccgctag

SEQ ID NO: 54053 - DNA, 396 bp, Glycine max
  Peptide Sequence Number=SeqID_145738
atgtcctggccttcagaagggctacatgccctcgccttcaaaggactacacgtcctcaccttcagaggactagacatcctcgccttcaaaggactagatgtccttgccttcaaaggactacacgtcctcacctttagagggctacacgtcctcaccttcagagggctacacaccctaaccgtcagagggctacacgccctcgccttcatagggctacacgccctcgccttcataggactacacgtcctcgccttcagaggactacacaacctcaccttcagagggctgcacgtcctcgctttcaaagggctccacatctgcgccttcagagaactcaagggatcgtgccccctacgaggagtcccttggacccggagaagtccaacagggccctag

SEQ ID NO: 54054 - DNA, 171 bp, Glycine max
  Peptide Sequence Number=SeqID_145739
atggaagtggatctttctcaacaaccacacaggtgggggactgtgttaggtttgaaggataatgatgagaaaaagaataaacaaggagttgaaaaagaaaacaagaaacatgatgaagtggtgactagtgaaaaagtggtaagtgaagaagagaagaagaaatcaaattga

SEQ ID NO: 54055 - DNA, 309 bp, Glycine max
  Peptide Sequence Number=SeqID_145740
atggcgcaatgtcggctgaaaaatatcagtcgtgggttttcaacggccgatgtcgtctattacttatcttccttcaccggaagtggcgtctacccagacttatcttcctttaccggaagtggcgtctaccccgacttatcttccttcaccggaagtggcgtctaccctgacttatcttccttcaccggaagtggcgtcatccaaatcttcgtagcctgtaacaaacgatccgctcctactcaggttcacatcaatttttttcgattagtattggtgaatcctacatgtgttttttccgaggttggataa

SEQ ID NO: 54056 - DNA, 1606 bp, Glycine max
  Peptide Sequence Number=SeqID_145741
atgtccaacttcaccaaggacaacatcggcaagccgatggcgaccctgttcgtggagtataaggacagcggcaagaaagacgccaacggccgcgcggtgctggtgaaacaggaagaagtgatcaacgtggcgaacattcagtcgcgtctgggcaacagcttccgcatcaccggtatcggcaacccgaacgaagcgcgtcagctttcgctgctgctgcgtgcgggcgcgctgatcgcgccgattcagatcgtcgaagagcgcaccatcggtccaaccctgggtcagcagaacatcacccagggtctggaagcctgtctgtggggcctggtggcgtccatcgtcttcatggtggtctggtaccgtaagttcggcgtgatcgccaccacggcgctggtcgccaacctggtgctgatcgtcggcgtgatgtccctgttgccgggggcgacgctgaccatgccgggcattgccgggatcgtgttgacgctggcggtggcggtcgacgccaacgtactgattaacgaacgtatcaaggaggagctgaagaacggccggtccgttcagcaggcgatccatgagggctataaaggcgcgttctccagtatcgtcgacgccaacatcaccaccctgatcaccgcggtcatcctgtacgcagtgggcaccggttcgatcaaaggctttgcgatcaccaccgctatcggtgtggcgacgtccatgttcaccgcgattgattatactgttgagcaactcaactacggccgtaaagtctacgactttatgcgctgggactatttggccttcggcatctcgttgctgctgttggtcgcgtcgatcgccaccatgtcggtgcgcgggtttaactggggtctggatttcaccggcggtacggtgattgaaatcaacctggagaaaccggctaatctcgacctgatgcgcgatacgctggagaaggccgggttccaggatccgatcatccagaacttcggcagcagccgcgacgtgatggtgcgcatgccaccggcgaccggcaccgcaggccaggaactgggcaacaaggtgatcggcgtgatcaacgactcggtggataaaaatgccaccgtgaagcgcatcgagttcgtcggcccgagcgtgggcagcgaactggcgcaaaccggcggcatggcgctgctggtggcgttgatctgtatcctgatctacgtcggtttccgcttcgaatggcgcctggcgctgggggcggttatcgcgctggcgcacgacgtgatcatcacgctgggcgtgctgtcgctgttccacatcgagattgacctgaccatcgtcgcgtccctgatgtcggttatcggctactcgctgaacgacagcatcgtggtttccgaccgtattcgtgagaacttccgcaagatccgccgcgacgctgagccgtacgctgatgacttccgggaccaccctgatggtggtgctgatgctgtacatcttcggtggcgcgatgctgcaaggcttctcgctggcgatgctgatcggcgtgtcgatcggtaccgtctcctcgatctacgtcgcgtccgcgctggcgttgaagctggggatgaaacgcgaacacatgttgcagcaaaaa

SEQ ID NO: 54057 - DNA, 291 bp, Glycine max
  Peptide Sequence Number=SeqID_145742
atgtggtcgctcaagctacctcacatgaccttggacctcctgttcgtcatggacaggcctgtcacatgcaacattctagatcagggtgttgagcctcaatataacctgttgcatgttgatggatgggctgttggacaggagggtgaagccccactgcctaggtcattgttgacactcggcttgcatgaatctgatgccgaagtagaagtcactactcttatactcggaccaccgggttcggagaaggaagcaatcgaggaggcaaagctggatttgcatttgaaaatctag

SEQ ID NO: 54058 - DNA, 490 bp, Glycine max
  Peptide Sequence Number=SeqID_145743
gagacgacgttaatctctgcgtgctatcaggcttttcgtatgacagatagcaaaaaggtttacacggataaccactcgggtatttccgcccgtcagtgtgactcaaaagtcagtatgacagatattgtgagcacggaagatgacgcttttcgtgttacagatagcaaaaaagtgtttatacggagaaccactcgggtatttccgtccgtcagcgtgactcaaaaggcgcacgagacatcgttagtctctgcgtgctatcaagcttttcgtcttacagatagcaaaaaggtttatacggataaccactcgggtatttccgcccgacagtgtgactcaaaagtcagtatgacagatcttgtgagcacggaagatgacgcttttcgtcttacagatagcaaaaaggtttatacggataaccactcgggtatctccgcccgtcagcgtgactcaaaagtcagtatgacagagcttgtgagcgctggaagattac

SEQ ID NO: 54059 - DNA, 375 bp, Glycine max
  Peptide Sequence Number=SeqID_145744
atggtgggttacacaccttcaagtttaacagatttggtcttcgtcagtgaaaggatcaaggtgggtccgaaaagaggcaagtttgatcatcctactaggacgactgagaaaactggggcaaataaagagggtgaggatgagggagaaacccatgctgtgactgccattcctgtacggccaaatttcccaccaacccaacaatatctttactcagccaataacaaactttctccttacccaccacccaccataaccccaaccaaggttcatcaacctccatttttccgaggatacgactcgaacgcaacgtgtgcttatcagtggagccctggggcatccattgagcattgtatgaccccgaagcataaagtgtga

SEQ ID NO: 54060 - DNA, 285 bp, Glycine max
  Peptide Sequence Number=SeqID_145745
atggaggttgatgaaccttggttggggttatggctaccattgaattatcaagtagatatgggatcaagtttagcatatgacaacggaatttggggctttgtggttgatttagggatggcctttgtggataactgggtggtgggtaaggagaaagtttgttattggctgagtaaagatattgttgggttggtgggaaatttggccgtacaggaatggcagtcacagcatgggtttctccctcatcctcaccctctttatttgccccagttttctcagtcgtcctag

SEQ ID NO: 54061 - DNA, 234 bp, Glycine max
  Peptide Sequence Number=SeqID_145746
atggctggagagccaccagcaacaacaaacatgaaccatatggaagaagaagcagaagctaaagctcagcaagagcctgcgcaccaatcgagtccttttaagtctcttataattcagaagatggatgtcatgcttcacctccatcaagaacactcagctaatgttcataataccttagaaaatatcacaactcatctggagaacatagaaactaggctaacccttagtaactga

SEQ ID NO: 54062 - DNA, 672 bp, Glycine max
  Peptide Sequence Number=SeqID_145747
atggaacccctccaaacgcaagccttccgcaagacttacggaaagatcttagagttggccatagcagaggtgtccatagaagccattgcatcactcacccaatactacgaccagcctttgagatgcttcacatgcggagacttccaattagtaccaaccattgaagaatttgaagaaattctaggatgtcctctcgggagaagaaaaccatacctttcctccggatgtctcccctctttgagcagagttgcaactgtgatcaaggattcagcaagaggtttggaccgcataaaacagactcggaacggcatagcgggcctaccacagaagtacctagaagacaaggcaaggggtatggccaataaagggaactgggtcccgtttatggatgtgttagctttgctaatttttggggtcgtcctctttccaaacgtggatggtttgatagacctagcagcaatcgacgctttccttgcctaccaccatagcaaggaaagtccggtggtagctgtcttggcagatctatttgacacatttgatcgaaggtgcaagaagagtagcgcacggatcatctgttgcttacccgccctctgtgtttggttggtttcacacttgttccaacaagacacaagacatccatgtccgctcctgaagccatcgctcgtgtactga

SEQ ID NO: 54063 - DNA, 264 bp, Glycine max
  Peptide Sequence Number=SeqID_145748
atgggggtgcaaatagcacccaggcccacttgggccctccagaaggctgttgcttctggaggaagcaacttggctcgcctgggcgagctgggcggcaagcatctcccctattttgctataaataggggaggaagtgaagaagaaaaggccgaggcgcttccgaaacgtttccgtaacgttttccatgaagaatttcgcaaaggtttcaaccgttcttcgacgtacttcattcgttcttcatcgttcttcgatcttcaacggtaa

SEQ ID NO: 54064 - DNA, 258 bp, Glycine max
  Peptide Sequence Number=SeqID_145749
atgaggagatacatgaagaaaaatgaagaaacacatggaagagaagcttcaatgaggttcttcaatggtgagtttccaccatggagatgcagcggaaggcaaaggagaagaggagaggggaggcaccatccattagggaataagccatggaagaaggagcttcaccaccaagaatgtgccttgggtaagaagcttgaagatgatgctttaatggaggaaaagaaagagagaagggggagcacaaaattgaaggaataa

SEQ ID NO: 54065 - DNA, 72 bp, Glycine max
  Peptide Sequence Number=SeqID_145750
atggtgtttgcagaagaaatggtggagtcaggtagtggttggcgtagagggaagagaatgcattctttgtaa

SEQ ID NO: 54066 - DNA, 142 bp, Glycine max
  Peptide Sequence Number=SeqID_145751
gtctttgggagtcatggatgaagatgtgtgggaggtccttagagccggtccaaagtattgtttgatagtgacattgactccagcagcacacacacaaccagggtgttctggtcgcccaatggcagcagttagtacaccctaa

SEQ ID NO: 54067 - DNA, 84 bp, Glycine max
  Peptide Sequence Number=SeqID_145752
atgggtgcaactgatatcatcattgataaacagagattgatacaaaaatcattgctctatgctagtcgttctctcaacaattaa

SEQ ID NO: 54068 - DNA, 159 bp, Glycine max
  Peptide Sequence Number=SeqID_145753
ggtaggtctcgttctgttgaaagtgttcgtagcgctgctggtttagttccccactcggattgtcggggggcacatttggagagagaatcaatgttcagtagtacgcctggtgaaccgggttctaccacttcaggtcccaatctttggtatgtcccttag

SEQ ID NO: 54069 - DNA, 720 bp, Glycine max
  Peptide Sequence Number=SeqID_145754
gattcctttgaggagcaggccacacagggatcctccgtcccccatggacgtcaggatgttctcgccgctgctattggacgtccagagcaccctggacgtgtccgtgctgttggagccggtgtcaccatcaagcaatactttggatcgactccacggacgtcccgaagcacttcctccctgcctcctgacgaattgcagcagctgacccagcaaatcagggaccatttagaggagtccatcacagagaaagtgacgaggcaggtcatggcatccttcagccacatgcagtcccagcttcagttgcagatgcaatctcagggacttgcagtgcctcctgagcctctggttggtccctctggtcctcgagtgagcacaaaggggagttgtgttgatccctcagaaaacgatcctgagaccggtgactctgacaggtggagcttgtacatagaagcaaatcctgcccgcctagttgccatggggagagtttatgagggatccactgttgttcataacactcctttgttgcctggccaagtaaaggtgagtatggaggaggttagagatgcagatgctccagttcctgtacccactgatgaggtttccttagtggggcaggcacttcacacttgcttggccgacacatctggtcaagtctttatcacagcaggtagttgtgtctccggcaaaaccacctccaaagcccgatccgaaggtcgatga

SEQ ID NO: 54070 - DNA, 510 bp, Glycine max
  Peptide Sequence Number=SeqID_145755
atgacccaagagctggtagcccgcggagacaccttacggttatccgcacctcgtcattcagtcaccccaagtgtgattgacgagcagaggccaatatggtcatctgcgccctttctggagatgtcagcattttccgatggagacttttcaagtctcacaaattatctagaactacaggcggcgggcccgatgatacgcggagataccttacggttatccgcacccttgtgtcatccagaggcggcgggcccgatgatacgcggagataccttacggttatccgcacccttttgtcatccagaggcggcgggcccgatgacaagcagagacaaaatttggtcattctgcacccttgtgtcatccagaggcggcgggcccgatgatacgcggagataccttacggttatccgcacccttttgtcatccagaggcggcgggcccgatgacaagcagagacaaaatttggtcattctgcacccttgtgtcatccagaggcggcgggcccgatga

SEQ ID NO: 54071 - DNA, 213 bp, Glycine max
  Peptide Sequence Number=SeqID_145756
atgataaaagcctcgagggtccgtcccatccctgaaaatgctatgaggtacgacctttgtacttcatggtatactcatggattggcaagttcttatttggaagctgcacttcttaccgctgcagtctccactcctgcttatagtttagcacactctttgttgttactgtggggtctgaagcacagggagattttacccgttggtgtcaattag

SEQ ID NO: 54072 - DNA, 190 bp, Glycine max
  Peptide Sequence Number=SeqID_145757
atgggggtgcaaatagcacccaggcccacttgggccctccagaagattcctccagaaggcggggaggaaagcaagaaggaaatggtccagccccttaggcacttcatccttatatgtcccaatggagaaaggggaatggtagtgaggttcaacttggaaagtaatcttgtgctacaacaattgcaacaag

SEQ ID NO: 54073 - DNA, 423 bp, Glycine max
  Peptide Sequence Number=SeqID_145758
atgggaatggaggatgcaatggaggagaaattgatgctgagattgatgctgtccagatttgcccaaccagtatggactcccttatttggaaggttgatcctagtggagcctattccacaaaattgccttctgttggagaattttcagaaacaattgcctactaaggctaacttgagaaagagacacatcactttgccttcgtataggtgcccgttatgtgatagtgaagaggaagatattggccacatcatgttctcatgcagaatgactaggaatttatggtgggaggctttgagatgggtcaatagagtgggccctttccccattgaacataaaaatcattttatgcaattctctcattggaatcgcaaaagctttatagacaatagatgggtgataaaaatgctattaagtgttaactga

SEQ ID NO: 54074 - DNA, 341 bp, Glycine max
  Peptide Sequence Number=SeqID_145759
gcaaagctaccatctcttctttctaccagtttccagatgaatcgttgagtgaggcacttgagagattcagagctgggggtaagatcaaaatgaagacccctgatgaagcaatggacttaattgaaagcttggctgctagtgacgttgccattttgagagaccgagcccatattcctaccatgaagagatgtacaatttgtggtggagctcatgaatctggagaacaaccaacagtatcaacagcagagacagtggcaaatcaccctggtaaccaattcaacagagaccagggtggttcatctacaaggccacaactgcagatgccaagtctctatgactga

SEQ ID NO: 54075 - DNA, 237 bp, Glycine max
  Peptide Sequence Number=SeqID_145760
atggagcttatagaaaacatggcagccaatgatcacgccatcctttgtgatcgagcgtacatgccaacaaagagataccttctagaactcatagcccaagaagcaactttggcccagaacaagctattatctcagcagatagaggccctaacggagaccctttgcaagctttcgcaacaactacaagtgggggatgccacatctacggaagagcacatgagccagggcaatgcatag

SEQ ID NO: 54076 - DNA, 594 bp, Glycine max
  Peptide Sequence Number=SeqID_145761
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccggctttgagcactctcagattgaactgaaatcagaacaaaaagcaggatccaattatttggttaagaagcagccaaagaagccattggcacgtgcctcacaagaacctgttggctctgatttctcctcaggggcaactcttgctactattgcagatgtacagccaacttcccatctgatgcaaggtggtagatgtgagaggtctggcaatcttgatgtcgggaaacctgtcgtgccagctgcattaatgaatcggccaacgcgcggggagaggcggtttgcgtattgggcgctcttccgcttcctcgctcactga

SEQ ID NO: 54077 - DNA, 345 bp, Glycine max
  Peptide Sequence Number=SeqID_145762
atgatgaatgtgttgagtggtgcaaccctcttttataaaatcactcatgtgtccaacatcttcaagattcatgtagatagggacttattagcattcaacattgtcgcaacctacccttcggcgggagggcaacgcgtgactcgcgggatgcgtgttccacgaaaggaatacgcgcggagtcgccaccaacgtttatttgaggaaaacgtcggaaaaaccggaaaagacgcgatctacaaactttttagtgaaaggttcgggagttgtatttacgcacggggaagggtgtttccctttgctcctacgtattcctccatttgggatgaggaaatcagacctacgtag

SEQ ID NO: 54078 - DNA, 432 bp, Glycine max
  Peptide Sequence Number=SeqID_145763
atggcttttaggaaaagaaaggcaccatctacacccacccaagttagatttgacagatcaagattcacttcccaagaggcttgggaaagatacacaaacattattgtgcctaggaagcttttgccagagaggaacgtggtggtctactatacagagttcgatgagttcaaggaggaactcaaaagacgccactgggacaaggagttgactgactttggggatggcaacattgatgtttccattgtgaaggaattcaacgccaacctctatgaccccgaggacaaatcacctaagcaagtgagggtgagaggtcatctgattaaatttgatgaggatacgcttaatactttcttgaagacccctgttattgtggaagagggggaatcactctgtgcttattctagatttgcactcctgaggcctgatccttag

SEQ ID NO: 54079 - DNA, 234 bp, Glycine max
  Peptide Sequence Number=SeqID_145764
atgaaacataaagacaaagtgatgatcttcttcatcaatggattcctttgcgtcttggaagatgaatggcagcggagtggagaaaggaagagagagaggagacgccacttcaaggagaagatgagtctagaagaagctcaccaccataggaggccatggataagagcttggaggaagaatgagatgaatgaagagagagggagagaagagcacgaaattttgtgctctaaatga

SEQ ID NO: 54080 - DNA, 228 bp, Glycine max
  Peptide Sequence Number=SeqID_145765
gtgcagcccctaaaactccatgggcttggtccttccttggataagagtgagagccataagattttgaagaagcctttagagcttgtccataagctccctttcatagtaggagggaatgtgcctctttctaaaggcactcttaggatcattctaatactctactggaggatccccatgaatccttcgttccctaacaagggaagtccacaaatagagggcataccctag

SEQ ID NO: 54081 - DNA, 450 bp, Glycine max
  Peptide Sequence Number=SeqID_145766
atggaggcccgaaacacatacctttcacatgagatgtggagagtgtacgattactcttcaagatgtctcagtattattagagagatgtgcagcgccaccgattacaaaataaaatcaatcggaggtatgtgcatcttaatccaaatgtgggcatggaaacgatgcacgactttggctccaaagaggactcctcccgtgatccaaaataagccactcggacacaggtggttgcgacgtggaaatcagcatattgggaatgatgatctgattgtatttcgtcgcaagttggatatcatgaaacgacatgagtttctgtgggagtcttacacagcaactgttatgtcgtcgttgcctctgatatgtttggttggtagcgtagcatggtgcgcggtggtgccactaatttgtttccatgttgttgagtggcaccaacccgatagagtgttgtga

SEQ ID NO: 54082 - DNA, 255 bp, Glycine max
  Peptide Sequence Number=SeqID_145767
atgaggggcatcgtgcatgagcctcagggtgaacccttgggtactagtaccctcaccttcagaggactaaacgtcctcgccttcacaggactacacgtcctcgccatcagaggactacacgtcctcaccttcagaggactacatgtcctcaccttcgtagggctacacgtcctcaccttagaggactacacatcctcaccttcagagggcttcatgccctcgccatcagaggactgcatgtcctcaccttcgtag

SEQ ID NO: 54083 - DNA, 327 bp, Glycine max
  Peptide Sequence Number=SeqID_145768
atgtggatggatcggtttgctcttaccttgaacgggagtcaagaacttccccgattgttagccaaggccaaggcgatgacagacacctactccgcccccgaagagattcatgggcttctcagctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaaacagctcatggagaagaacgcggccactgccgccgct

SEQ ID NO: 54084 - DNA, 189 bp, Glycine max
  Peptide Sequence Number=SeqID_145769
atgacgacgtttgtctctgcgtgtcaacgggcccacttgcctctggttgagaaaggtgtggataaccataaggtgcggataaccataaggtacccccgcatgtcatcggactcaccgtctctgaatgacaaaggtgcggataaccataaggtaaccccgcatgtcatcgaactcgccgtctctagatga

SEQ ID NO: 54085 - DNA, 567 bp, Glycine max
  Peptide Sequence Number=SeqID_145770
gtggattgcgacgaagaagaccgtgaagagcattcgcacgccgtcgtacaggggagcgcctggaccgactccggattccggatgtctattggatcccgtatggggagcatcgggaggtccgggacttccacgtcagatcatgctattccgtttggttacacgcagaccattcctgctcctcctgtcgattcatgggtctcgtatgatgatatacacgacaggtggatgcactacgaggatcatatcgtacctgcaggtgaggtatgcgttgtgccaggggcgtgttcccgtgactacatcgattggttcttccgcatctcccatcctttcatgacaccaggccacgcattagatcctctgcctcatggtcacgccccgcagccccgagtcgtccctcaggccccgcagacggatatctctcgcgtgccggagccaggagcatcgtcgacatctgcggaggagcccagacatgcagtggaagaatgcctcagattggtcaggagtgtcacacaggaccatctagtatacgttaggtgtagacgcaggcggcacactgatcaggcttag

SEQ ID NO: 54086 - DNA, 915 bp, Glycine max
  Peptide Sequence Number=SeqID_145771
atgccgcacttgctggtcgccggtaccaccggttccggtaagtcggtcggggtcaacgccatgatcctgagcatcctgtataaagccacgccgaaagaagtgcgctttatcataatcgacccgaaaatgctggagctgtcggtttacgaaggcattcctcacctgttgaccgatgtggtcaccgacatgaaagacgccgccaacgcgctgcggtggtgcgtgggggaaatggaacgccgctacaagctgatgtctgccctgggcgtgcgtaacctggccggctacaacgagcgcgtcgatcaggccgaggcgatggggcgtccgatcccggatccgttctggaagccgaccgacagcatggacatcacgccgccggtgttggagaaagagccgtacatcgtggtgatggtcgacgaattcgccgatctgatcatgacggtcggcaagaaggtcgaagagttgatcgctcgcctggcgcagaaagcgcgtgcggcgggtatccatctggtgctggcgacccagcgtccgtcggtggatgtgatcacgggtcttatcaaggccaacatcccgacgcgtatcgcctttaccgtgtcgagcaagatcgactcccgcaccatcctcgatcaggggggcgccgagtccttgctgggtatgggcgacatgctctatctggcgccgaactcctcgattccggtgcgcgtgcatggcgcattcgtgcgcgatcaggaagtgcacgcggtggtcaaggattggaaagcgcgcgagcggccccaatataaagagggcattctcagcggcggcgaagacggcgagggcggtgccggcggtggtatggacggcgacgaagagctggatccgctgtttgaccaggcggtggatttcgtggtggataaacgccgcgcctccatctccggc

SEQ ID NO: 54087 - DNA, 465 bp, Glycine max
  Peptide Sequence Number=SeqID_145772
atgacgttgctacttagcaacattccacccgacgaccacaatgccgatctccctcctgtggaagtatcagttggtctgtgccatcgtgacataggtaaggattgcacccacaaggcacccagtggacctggagaagtccaacaggaccctggggtttccagctttggtttcgggcctctttcattcctacagggtgcccgtccccctaacaagggatcgtgcccacaagacacccaacggacccggaggagcccaacagggcccaggggtttccagctctggttacaagcctctgtcagtcctacagggtgcccgttccccccaacaagggatcgtgcccgcaagacacccagtggacccgaagaaatccaacagggtcttcgagttgccaactctaattatgggcctctgtcagttctacggagtgcctatcgcccccagcaaggtcatcaggccccctactaa

SEQ ID NO: 54088 - DNA, 231 bp, Glycine max
  Peptide Sequence Number=SeqID_145773
atggctgccaagtacctcgaagtggtcaaacgaggtcgcatcccaacaatggatggtccccagatgaaactaggggcgcagaatttgtctctgcgcgtttatcactcatcgagcgtgcggatgaccgcatgtcatcgggcccgccgcctctggatgacaaaaggcgcagagacgacgtcagtctctgcgtgctatcatgctttgagtcttagagatagcaaagaaagttaa

SEQ ID NO: 54089 - DNA, 438 bp, Glycine max
  Peptide Sequence Number=SeqID_145774
atgtcagccagtgatcatgccattctacgagacagaacccatcaacccacgaagaaaagcttgatagagctatcatcacatgatgcgttattggcacagaacaagttgctttctaagcaacttgagattttaacagaaacactcgataagctgccaactaagttgtctttgggtcaacctacgcattcttctattttgcagaaaacactcaagaaattcattatatgggaaatcaacaacgacaaaggtatactcaaggaggattttcaggcttccagcaggctccctataatcaacgaggacagtggaggacacaccctggtaaccagttcaacaaagactaaagtgggccttaaaacaggccaatccaacaaggacctaacatattcgaaaggactactaagctggaggagacctagactcagtttatgcaggtaa

SEQ ID NO: 54090 - DNA, 401 bp, Glycine max
  Peptide Sequence Number=SeqID_145775
atggaggccccgaccaatgctctcaacctctctaatcgaaggcctcaacttcaccctatatgcttccgggcaatagagggacagattgcttttacgggtggtgtgccaagattgggtcgcactccttccatcgtcttgcccgggatgagtcctttcatacttgaggcaagccataaggatatgagcttgtggactattacttcgagccggccatgtttctccatgttaggcggcgagggactgcagcacctgggcgtctccttcctttttcctaacgtacgccaggcggttgctggggctcttcctctagttgttcccggattcaatcctttctccggcgaagacgagatccgcaaagttagctggcatgtagcctatcagcttttcatagtagaacatgg

SEQ ID NO: 54091 - DNA, 373 bp, Glycine max
  Peptide Sequence Number=SeqID_145776
gagatggccccgagaaagcttccatcaaagaggtccaggaaggacaccacaggagaaggctccagcgctgccccacaggctgacacagacttcgacaggcatcgattccggagcacttaacattagcagcgcttcggaaccatcaagggatagtcattccttagagagaggccgcaggtgctgggcgccacttgtgccacccatggctaaattcgacccggagatagttgatgagaagatgagtctagatgaagctcaccaccataagaggccatggataagagcttggaggaagaaggagatgaatgaagggagaggaagagaagaggacgaaattttgtgctctaaaagagctctaaaatctgaagtttaa

SEQ ID NO: 54092 - DNA, 492 bp, Glycine max
  Peptide Sequence Number=SeqID_145777
atggttaaggaggagtgtaaggaggtaagtgtctcctccaagaggttagctaagaaggaaagacattttgaaataaagataaatattaaagaaatttcccctcttagacaacctccacattttctcctttgtaaaaagacaattgttagcattgccacacctcttgggcttgagtttattcctcaagtaaaggagttgttggataagggtttgcttcgcaagagcataaatccttgtgcgttgttggtgctcaaaataggtattattaggcaccaaattcctaaaataggtggtatgatgaatgttttgagcggtgcaaccctcttttgtaaaatcacttgtgcacctaacatctttcatgactgtgtgtacatagggaccattagtgataaaggggttcccatgaaccgtaagagaataaaggtcatcctaagtggcccactcccccaagtgttcagggaaggagcccagagtatgaaggggatcctctag

SEQ ID NO: 54093 - DNA, 417 bp, Glycine max
  Peptide Sequence Number=SeqID_145778
atgacgctaaccggcgtcgcttcccaagccactgccaaagagcagccgctaaaaacttccaatggacacagcaaacccgtcgcaaagaaagcaggcagcaggcgtctggtgatgcttgaccccggtcatggcggcatcgatacgggggcaattggccacaacggttcgaaagaaaaacacgtcgtgctggccattgctaaaaatgttcgcagcattttacgcagcaacggcatcgatgcccgtctgacgcgtagcggcgatacctttattccgctgtacgatcgcgttgagatcgcccaccagcacggcgccgatctgtttatgtcgattcacgccgacggctttaccaacccgagtgcggccggcgcctccgtctttgcgctctccaaccgcggcgccagtagcgccatgggctaa

SEQ ID NO: 54094 - DNA, 288 bp, Glycine max
  misc_feature (5)..(5): n is a, c, g, or t
  misc_feature (42)..(42): n is a, c, g, or t
  Peptide Sequence Number=SeqID_145779
ggggncggagcctatggaaaaacgccagcaacgcggcctttntacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccagcttgaagaggatgtcggatacattcgtcagagtttcgatcttccaccaccacgtccgtcttcttag

SEQ ID NO: 54095 - DNA, 282 bp, Glycine max
  Peptide Sequence Number=SeqID_145780
ggatcgcacccacaagacacccagtggacccggaaaagtccaacagggccctagggtttccagctctggttacgggcctctatcagtcctacagggtgcccgggctcagctagttatcgagctttctcaacgaagttcctgggccacccccgatattggcaggcagggccgaactgtgcgagcacaccagcagcattgggatggccggtatgcgggcacactagactactatgccatccacctggggcaagatttcacccgtgccagctcatccataaaaag

SEQ ID NO: 54096 - DNA, 261 bp, Glycine max
  Peptide Sequence Number=SeqID_145781
atggctccgaaaaagctttctgcgaagaaatctaggagggacaccgcagctgaagggaccagcgccgctcccaagtttgatagccaccgtttcaggagcaccgaacatcagcagcgttttgaggccatcaaaggatggtcgttccaccgagaaagacgcgttcagctcagggacaatgagtacaccgactttcaggaagagatagctcgccggcgctggacgtcgctggtcactctcatggtgaagttgacccagatataa

SEQ ID NO: 54097 - DNA, 141 bp, Glycine max
  Peptide Sequence Number=SeqID_145782
atgggggtgagcttagctattatagggggtgtgtatctaagttctagcttctcatctcaaggaggtcttctcaaggaagttttctcaaagaagcttctcaaggaagttttctcaagaaagcttctcaaggaagctacctag

SEQ ID NO: 54098 - DNA, 99 bp, Glycine max
  Peptide Sequence Number=SeqID_145783
atgggtcccaagtacctcgaagcggtcaagcaaaggttgcatgtcatcaaacaatggtcccggacgaaattaggaggaaaatgcaaggatcatacatga

SEQ ID NO: 54099 - DNA, 238 bp, Glycine max
  Peptide Sequence Number=SeqID_145784
gcttatggaggagaaaatggtagggatcgaagtacaaaaaaatgagcatgatgggaagttcacaagggactcagtggccacagcattgagaccagtgatgttggaagaggaaggaaaaacgtctaaaagtcaagcaaaggagatgagtaagatatttggggacaaagatctgcaccaaaattatgtagatgagtttgttgataatttggaaatccataggcctacgattaaggactag

SEQ ID NO: 54100 - DNA, 435 bp, Glycine max
  Peptide Sequence Number=SeqID_145785
atgtgtcctccaccttcgagtttggagcgatgcgtagtgattgctttgtgctattctccattctcaatcttttttcgaagccccatgaattgcgttttcgttcatgtgtcctccaccttcgagtttggagctatgcttagtgattgcttagtgcaattctccattctcaccctttttcggagccccataaattgcgttttcgttcatgtgtcctccaccttcgagtttggagctatgcgtagtgattgcttagtgcaattgtcaattctcgccctttttcggagccccatgaattgcgttttcgatcatgtgtcctccaccttcgagtttggagccatgcgtagtgattgcttagtgcaattctccattctcaccctttttggaagccccatgaattgcgttttcattcatgtgtcctccacccacgagttttga

SEQ ID NO: 54101 - DNA, 447 bp, Glycine max
  Peptide Sequence Number=SeqID_145786
atgtttcgtcgtccagaaaatgcaggaggccgcgtgatgggtgcccaaccgcttctgaaagtcgaaaacctcgtcaagcatttccatgtcaagctcggagccttcggcgagcgttcggcgacggtctatgcgctcgacaatgttaatcttgacatcatggaaggcgagacgctgtcgctcgtcggcgaatccggctgcggcaagtcgacgacgggcttcaccatcctcaacctttacaaggctacatccggcagggtggtatacaagggccaggatattgcgacgctcgatgaaaagcagatgcgccccttccggcgcgacctgcagatcgtcttccaggacccgtattcgacgctcaatccgcgcatgacgatcggcgaagcgatcggcgagccgatcctgttccacaagctcgccaccaaggcggagctgaagggcaaggtcgat

SEQ ID NO: 54102 - DNA, 405 bp, Glycine max
  Peptide Sequence Number=SeqID_145787
atggttaaggatgagtgtaaggagatacgtgtctcctccaagaggttagctaagaaagaaagtcattttgcaataaagacaaacattaaagaaacttttcttcttagacaacctccacatcttttcctttgtaaaacgatactagttagcactgccacacctcttgagattgaggttattcctcacgtaaaggagttgttggatgagggtttggttcataagagcttaaatccatgtgctttgttggtgtccaaaataggtattattaggcaccaaatccctaagatacgtggtatgatgaatgtgtttagtggtgcaaccctcttttgtaaaatcacccaagcacccaacatcttcatgattcgcgtacatagggactctttagcgatcaaagggttcccatga

SEQ ID NO: 54103 - DNA, 279 bp, Glycine max
  Peptide Sequence Number=SeqID_145788
atggagagaagccataacttcaataatgggaagagatcccaagaagtttctcctacacttaaatgctacaagtgtaatcaacccggtcacataaaggaaaattgtccctcaaatgagtcatggcccaagaagaatgagaagaaaagctataaagaaagaggatccaagaaggcgtatattgcttgggataacaatgactcatccgatggttcggagaaggagatcaaccttctatccaaggactatgaaagtgataagaacatctctcaagaagattaa

SEQ ID NO: 54104 - DNA, 159 bp, Glycine max
  Peptide Sequence Number=SeqID_145789
atgactctaagacaacatggattaagcctaggatcttcttcatcaatggaatcctttgcttcttggaagatgaatgacagcagaatggagaaaggaagagagagagaggagacgccacttcaaggagaagatgagtctagaagaagctcaccaccatag

SEQ ID NO: 54105 - DNA, 387 bp, Glycine max
  Peptide Sequence Number=SeqID_145790
atgaccaacttgtctctgcttgccacggacacgactgtgtctgaatggcaaaggggtgcggataaccgtaagaatgaccaaacttggtctctgcgttgccaacggacacgactgtgtctgaatggcaaaggggtgcggataaccgtaagaatgaccaaacttggtctctgcgtgccaacggacacgactgtgtctgaatggcaaaggggtgcggataaccgtaaggtatctccgcgtatcataatgaccaaacttggtctctgcgtgccatcggacacgactgtgtctgaatggcaaaggggtgcggataaccgtaaggtatctccgcgtatcatgtgtgcagatgaccaacttgtctctgcgtgccacggacacgactgtgtctga

SEQ ID NO: 54106 - DNA, 552 bp, Glycine max
  Peptide Sequence Number=SeqID_145791
atgactagaacacgaggtttaggtcgtgccataggtagacttgtagacagagatagacatgatgaccatgatgcagctgatgttcccgagaggcgtaggcctactgcctcagcccgtaggcaacaggttcatcagatgactgctgatgcacgtgatatggctgaggacgttgttgacatgactgacgatgtccctgatctggttgaggaggcacctgagatgtgtgcggacgtacagggtgctgatggtgctgaggggtcagatgctgatgatgatactaagggattccctggtgggccacgtgacccatcagtactggcatcatttgtggaccatgttgcacatgctatttggagtggacaggaacgtcctgatttgaagttggtgtcacatgggaggaaggtgacattgattgggaggattaagtccactgatcgattatttagttgttactggcgatcctggactaatatccgcatttgtggagaggtggcacggcgagaccagcaccttccacctttcggtaggagagttgacgatcacattggatga

SEQ ID NO: 54107 - DNA, 112 bp, Glycine max
  Peptide Sequence Number=SeqID_145792
tcgatgcgcttccgaaacgtttctgtaacgttttccgtgaggaatttcgcaaaggtttcaaccgttcttcgacgttcttcattcgtctttcatcgttctcgatcttcaatgg

SEQ ID NO: 54108 - DNA, 150 bp, Glycine max
  Peptide Sequence Number=SeqID_145793
atggcgactaaccatcaatgctttggcaccggacgttcccaaactggaatgtgtattatcgatataggggatctcaattcgagaagatccatcgacttagacgaagagaaagaaaggaagatctgtttgggaagtaagaagttcccttga

SEQ ID NO: 54109 - DNA, 138 bp, Glycine max
  Peptide Sequence Number=SeqID_145794
gcgtctggctgccctgcgctagcagtagcgcctgcagcaggggcgccagtggagcctgacccttgggcgctaccaaaggcgtccgtgtcaggggcgctacccattgtgccacgtgtcaggggcgccagtggagcctga

SEQ ID NO: 54110 - DNA, 213 bp, Glycine max
  Peptide Sequence Number=SeqID_145795
atggacgtgtggggtgctaataccttccccgtgcgtaaatacaactcccgaacctttcacttaaaagttcgtagatcgcgtcttttccggtttttccgacgttttcctcaaataaacgttggtggcgactccgcgcgtattcctttcgtggaacacgcatcccgcgagtcacgcgtcgccctcccgccgaaggtgtcctggtattttgtttag

SEQ ID NO: 54111 - DNA, 606 bp, Glycine max
  Peptide Sequence Number=SeqID_145796
atgaaagtaatcatcgcattttccgtgattctctccaatctgctttacagccagatcaaggttcctgatgattataaaaaaattcctgatattctcgatacggtagaatacctttacccgttcattgttcctgataaagactatgcttactggcgcgttctgagcaatgatatggactatgaaaaatcagtactctatgaaagccaggctcctgactttatgaccatcaatgaacctgttcctgaaaaaggttttttccagaaatgtattgggaacaactgcttttcatatattcttgcgtgcaaaaacgaaaggtctgtttatttttccaatgaacagcaactgagagattttctcggaacagtagacaatcttccggaggctattttactggcaaaaacgtatgggtattctgtggatacaagtaaccgatttaccggatcatataaaattgaagaccgccatatttcaatgtaccttatgcaatcaaagggttgtccggctgtgaaagaatctttttgggttaaaatcaatagaaaaaccggaaaactggaggcaaaaagcaatggagtatacacgaaggatgaaaactgtacttctttgtaa

SEQ ID NO: 54112 - DNA, 264 bp, Glycine max
  Peptide Sequence Number=SeqID_145797
atggagaattgcactaagcaatcactacgcatggctccaaacttgaaggtggaggactacagaacgaaaacgcaattcatggggctccgaaaaagctccaaactcggaggtggaggacacatgaacgaaaacgcaattcatggggctccaaaaaaggttgagaatggagaattgcacttagcaatcactacgcatagctccaaactcgaaggtggaggacacatgcaacgaaaacgcaattcatggggctccgaaaaaggttga

SEQ ID NO: 54113 - DNA, 228 bp, Glycine max
  Peptide Sequence Number=SeqID_145798
gcttgtagtgagcttcaaaacaaggaaagggaaacaccccccccgctcaaaagggctatcaaaggaattaattcaaggacgcatcaacaagaatcaagccaaggctattgtgcaagcaatcaatggggcaaaacacaccaaatgattatgatgatggatggctcaaattctcacaaaggtaaactcatcactttcaaattgagctttcaaaactatcatgacatgtag

SEQ ID NO: 54114 - DNA, 720 bp, Glycine max
  Peptide Sequence Number=SeqID_145799
atgggacctctccaaatgcaagctttccgtaaggcatacggaaagatcttagatttgaccatagcagagatattcacagaagccattgcatcactcgcccaatactatgaccagcccttgagatgcttcacgtttggagacttccaattagtaccgaccgttgaagaatttgaggagattctaggatgtcctcttgggggaaggaaactgtatcttttcttcgggttccttccctccttgagcaaaattgcaattgtgatcagggattcggcgagaggattggaccgtgtgaagcaaactcgaaacggcatagtgggcctagcacgaaagtacttagaaggcaaggcgagggatatggcgaatcaagatgagtgggtcccgttcatggatgtattagcattgttagtctttggggttgtcctctttccaaccgtggatggtttggtggacctagccgcaattgatgttttccttgcatatcaccatagcaaagaaagctcggtggtagctgtcttggcagacttatttgacacatttgaccgaaggtgcgaaaaaagtagtgcacagatcatctgttgtttacccgctctttgtgtatggttggtttcgcacttattccaacaagacataaggcatccatgttcgctccgaagccatcgctcgtgtgtcgaaaaagagaagagtagattgggaccaacacttggctgggataggaggtag

SEQ ID NO: 54115 - DNA, 351 bp, Glycine max
  Peptide Sequence Number=SeqID_145800
atggctaaagtaatcgcttgcatgaaggaggaaattgaaggaataaaaggaaaagaggagaaagagaagattgagggagagagtaacgaagaaaatgctgcattaggttctcctgaggacgacgacacggctcgcgagctccgagcctcacctttccggcgacggagttggcgagattccggcgaagcgataagagagaaagttgaaactgcgcttttaagagagagaagtttcgttttggttttggagaaggaagaacacgaagaaggaatagcgaggcacatgggaaaggcaataggggaattaagtgaaattaaatggggagttagaaatccgacaatcaaggagtaa

SEQ ID NO: 54116 - DNA, 1008 bp, Glycine max
  Peptide Sequence Number=SeqID_145801
atggaccctggacaccatgaagttcgttatgatcatgaagacaaccacagggtcttcttggttgatggggttgatgcccttgaagtccttgtccgtgaagttaatgttgatgtcccggatgacgtggtcgctcatgccgttgtggctgtggtctttgtctgcctcgatcttccactcttcttctatttgcttcctggttcttgtgctgctcctcttgatgtcctcctgtatttggttatgtctgaccctgaccttggaagtttcgtcttgggtagccggatgggtacatccaggttgaatacttcctcgagaatcgtggctggcgcttgtttggcttatgcctcttatccgacttatgtaagtcggccttggtgtttgctttgcgcttatcgagcttctgtctggcttgatagacttcattttggaatatggatatttcttctatcaagatgtaacccttggcttgctcgcgcaactcgtccatactaccaagtggagcatggaatgcaacactaccttggggttaagattttggatctggacagctatgcgcccaaatctgtgcatgaactttctaagggaatcatcgtttgcttgttgcagactgataaaggtggtcgaggtcatgcagtgagacttgctggtggcatactgcgcactaaattgttcaacgagggtgttgaagttgtctatggaccttggttcgcctatgtgaggaaggcatctagatgctcatttggatctgttgtcccgttgtacccctcgaggttgagtggtttccaccccaagggcatgccagcctccataatgcatgttgcctgtgtgtcggaggtgttgttccccttaggtgcgttcaagcaaggtgtgggcaaattgctcgtctccttagggatgtctaacatgagcctccagctgagtgtctgtgtctgtcataactaccagatgaggatgggagtctttgagaagggtctcgtgtttgaggctagatcgactgctaaccatggatga

SEQ ID NO: 54117 - DNA, 294 bp, Glycine max
  Peptide Sequence Number=SeqID_145802
atgtaccctctcttgttcttagttacaacaacccaagtagatgtaccctctacttgtaccacaaaggatgtaccctccaatgtgttaagacaaacttctcaggcgggaaagggaagaatcaaaagaattctcagactgtgtcttattgaattctttgaaaagggagaagggagacacaaaagaattcaggcggttagtcctttgttcttttggaaaagggagaagagagacacaaaaagaattcaggcgattagtccttgtcgaattctttttggaaaagggagaagagaatga

SEQ ID NO: 54118 - DNA, 558 bp, Glycine max
  Peptide Sequence Number=SeqID_145803
atgacattgctgcttagcaacattctccccaacgaccataactcggacctccgcctgtcgaagtggattatgcctccgagacacccagtggacccggagaagtccaacagggccctggggtttcctactctgattacaggcctctgtcagttctatggagtgtcggtcacccctaccaagctcatccagcctcctatcaatagggctttcattgagaagtactgcatgcctaagcaggtgcagggtcagcagccagctgcagatgcgcctctaccgcctctagaggaggtaccatctctgaggtccatctccgatcacctgcggaggatagaactccagatgcacaacggagttaggaccccagtcctttcccttggcctaccaccgaacagttcggggccacggtggcctagcttggggacaagaccgattttgagacgcgagaaggacccatgggggcccctgggggtgaggaaggagctcaggaggataacgacatggctaacgtgttggacttcttcacttgatgaggcagagttgcacgatcgggaccgctga

SEQ ID NO: 54119 - DNA, 699 bp, Glycine max
  Peptide Sequence Number=SeqID_145804
atgctgagcttagcgcaattcattgcggcatcaacaaggcttagcgagccatgcttgctaagcacatatggcatccaggaagagaaagagcatgacttcaagacccacaactcatatgataccaggcatttccaatctctggaagcttggaacagatatatggacaacattctcggccgaaacatcatttcggagagaaatgttaaaatttatcatattgagttcgacaagtttaaagtggagttggagaggcgtaatctccataaatgcctcaccaacctccaagatggaagcatagacatggctgtggtgaaggaattttatgctaatctatacagcccagaggaaccagcccctaaacaagctagagtaagaggacatctgattaagatcgatgcagacaacctgaatgaatttcttcagactctagtggtgttagaagagttgaggataaaccaccaggagattgaagccagactttgtattccctgcaagaggtttgttttgaatgttgagggccagccatggaaacttctcagaaaagatctgacgacactggcccagacatggagtgtattctcttactccaacctagctcccacatcccacacctcagatttgaacatggacaaagctacgttggtctatggcttggtgtgtaacatggacatgaacatcggagcccttatctcaggttag

SEQ ID NO: 54120 - DNA, 282 bp, Glycine max
  Peptide Sequence Number=SeqID_145805
atggggattggatcgacttttggtcgtcctcttgttcttggttacctagaggcttctattcttgatgaaaaagaatttctcctattgaaggttatttctacctttccggagttatcttgcttaatatgctctatggttggagcgggtcggggaatagacggtgttgccttatccataacccatctttcgggaagagttacttcatcccattttatttttctcgggagagaaacgttagcctttgtcatatcagtgataaacaaagttgtttctcctttttga

SEQ ID NO: 54121 - DNA, 1335 bp, Glycine max
  Peptide Sequence Number=SeqID_145806
atgggctcaaaatctaccctaaggctaatgagaaccctagggccttcccttggatctttggcccaatctacttggagtcttctatccaatgcccttgcgggatggcttccaagaagagaaagtcttctgcttcttcctctacctaatcaagatttgacagatctaggtttcattctcaagaagcttgggagagagaggaatgtggtagtatattacactgagtttgatgagttcaaggaggaactcgagagaaggaaatgggatgaagaattgactaattttgctgaaggcggcattgatgttgccatattgaaggaattttatgccaatctctatgacctagaggataaatcacccaagcttgatcctcaggagttggctactaagttatgtatcccaaggaggagattcgagctaaacgctgatggtcagcctttgaagatccttagaaagaacatgaccacactcgctcagacttggagtgttctttcttactccaacttggttcctacctcacacacttctgacatcacacttgatagggccaagttgatttatgagatgataatgaagatggataggaatctgggctacctcatctcccaccagatctctattattgcccagaatgactcctctaggcttggattcctagccttaatcacaactttatgtaaagctagaggagtcacatctgattccaggactcttaagagccttagccccaccatttacttggcgtacattaagaagaactgttggaatctggatgatccaatagtaacattcagagggcctaagaagaccaggggcaagagattagaggcccctactacttcagcagcaccagagacagccgcaccttcttcatccactcctccagcaccttcttcttctactccatctactcagataccacttccagctcattcatcttttggaccctcaaattttttgtttacttcagagatgcttcattctatgctccagagcttacacagagggcatgtcattatcatgcagagtctccagagctcaggcctgccatttatcatgagcacagatgagttcctgactcagataccagcaaaggaggatgagcctactcctcctgagccctttgaatttgtttctgactcagtggtggctcaagaagaagtaccttcaccagagcctattccagagccatctcctacacctgttcctgaggacaccatgctagctgaggatacccagccatctgaaccagtattggagcatgagcaactcaccattcaggattcatcagcaactccaattctggatctgaatgaagatcaaccacaggaggattag

SEQ ID NO: 54122 - DNA, 144 bp, Glycine max
  Peptide Sequence Number=SeqID_145807
atggatatcaacccagcctacagctaccttttaggccaacctcggattcactcggtcggggtagtcccttcaatgctccaccaaaggttgaagttcatggtagaggggcagttaatcatcatctcaggggaggaagacattctg

SEQ ID NO: 54123 - DNA, 339 bp, Glycine max
  Peptide Sequence Number=SeqID_145808
atggcgagaatagctaagaaatgggatagtcggaataccaaggaggcatttggaggaaaagacgaaggcgttggcagatcaagatgcaaaaagagtggtgcaaggattgtttgttgcacactagctctttatgtgtggctagtctcgcacctctttcgtcatgaaaatagacccgtctatcccctacaaggtcatcgcttgtgtgccgagaaagggaaggaaaattgggagcaactcttcgctagtatggtaggggcatctattaattggttcccccgatggaaagaaggaagagccggggttttgtctcatgtgagggattctcgaatgtacccttga

SEQ ID NO: 54124 - DNA, 87 bp, Glycine max
  Peptide Sequence Number=SeqID_145809
atgaaaatactagcccttttggctgaagtgacagttctcgaagagcaaattgttaggcttgaagagcagggtgtgcatttcagatag

SEQ ID NO: 54125 - DNA, 507 bp, Glycine max
  Peptide Sequence Number=SeqID_145810
atgtctgtttggcaatcactccaagttgtgtctgaaatcatgttcttattacttgatcttcaattatactgtggcagcattcaagattacatgtttgaggagagtgtttgcctgctacttcgagcctcatggttcacacctttatctgttgaagaacatgtggctcatgaagatgtatatgaagacctagaagattattatcagtacgaggatgatgatgatatggatgaagcttactatggtggttcgtccaatcttcgcgttattggcaaccgtagatggggagataatggttatgtcagggctggacgtcaagaagctcggccagtccatcgtctgaacttccaggattcaggagcaagttcttcttcgcgcgagccgaagaagaaagaggttgggaaaattatcacaggcagaagggcaaagagggcacagaaaagggaagcggctgacaaggcggccgaagcaaagcatctgcagcatttaataaggttgggtaggaagtga

SEQ ID NO: 54126 - DNA, 351 bp, Glycine max
  Peptide Sequence Number=SeqID_145811
atgggtcatgtgtgtgaaattctctcgccggaaaagggccctgtgtgggattgttacggtgctgtgttcaatgttgagttggatacacacgtgaactacgtgacagtcatcagaaagccaaacaaatgcaaatcgagccaaactaaacaaaaacaggttcatcgaagaagaagaagtgtggaagcaaagctttccaagtttattttgatgatgccaaagactcaagtcaagaatcaagagtcaaacaagtttcaagaatcaaagagtcgttcaatcaagaatcaagattcaagtgaagattcaagagaagactcaagatatgcaagaacttcaagaaaaacatcaagataa

SEQ ID NO: 54127 - DNA, 474 bp, Glycine max
  Peptide Sequence Number=SeqID_145812
gagctacattatgatgatgcaatcctccctaggaagggactagttaccagagccatgagcaagaggctccaagaggattgggctagagctattgaagaaggccctaagccgcgcgctaagcgcaagatcagtgtgctaagcgcaacaagtgccttcagccaggctaagctcgagactggtgctaagcccaatttcacttactcgtggagtcttacacgagggatctgcggacgaagcttggatattcagcctgacgagggatcgagggacttagaggcaacaacaattccagaggaagaacctcaatcttctgaggcatgttctagttttgctattgcagaacattctcatttagatcctactgaagactacatcatggctgaagagcctagaagagttactctggaatattattcaagttctaatgtgccacaatttttcaccagcattgcacaaccagaagttcaagcataa

SEQ ID NO: 54128 - DNA, 324 bp, Glycine max
  Peptide Sequence Number=SeqID_145813
atgtgttttacatccaagatccgtgtgattcaagattgtcagtggttctacaaggtcatgggaacaccgccaaggtccccttcatcttcagatggtcattcaaaggctacgtctaggaagagtagacaatccacacggctaagaagatgcatcaaaatctataaggacctagtatgggatgacatttgggccaaatttgatatcccagaagcactaactggcaagaagaaggtcacgtcgacggtggccactagatggaggcaattccaatcttccctgaccacaaaatttgtgtatgctgacactaagggtgaagataaatag

SEQ ID NO: 54129 - DNA, 177 bp, Glycine max
  Peptide Sequence Number=SeqID_145814
atgtcacggaacttcacgaattgcctaatgatgggtgccaagtacctcgaagtggtcaaacgagggtcgcatcccaacaacggatggtccccggacgaaattaggtggagggaatcgttaaggtgttggaccttgaaacgatctcaagtgatgtttgataaaaagaagaggttatga

SEQ ID NO: 54130 - DNA, 207 bp, Glycine max
  Peptide Sequence Number=SeqID_145815
atgcatgatgcgatcaaggaacatgctagaagatatcatcctcttaggatatacattgtggcgatagggactatcagtgacaatgaatcactaaaagaggaaaatctagatgaggcttcaatgttatcaagcgagtcggagacccaacatgaccacagatcgacctgcactccttatggctcacatagacccgggtatatggcctaa

SEQ ID NO: 54131 - DNA, 651 bp, Glycine max
  Peptide Sequence Number=SeqID_145816
atggtggaaccatcaaagaagcgcaaaggttcttcgagtagaagccaacgacactccgaggctcaggatactccaattccttcctccatttcctcatcctcattgttctcatcagaagaacaacatatacggtacacaaaactcttctcctctcattctatcattgaccctaaattcatagatatggatttcttttctgatgagagtttcgaatgcattcaagcatttcagaactcaaatctcattccctttatgtctttaaaactgcctgtgtattctaaattggtctatgggataaagatggtcattgaccaatccctcttctatgatttgacccaattgtctagcgaaggtgtaccatttgaagttactttgttccttcaacattttaacattcctcttgattctgaaccatatgttcctatcaagagatctttcttgatcggtgctgctatggttgtgtcctttggttaccacaaagagtgtgatggctcttgggtaaaaaagggtgctcaaccaaatgatgatgaagaacacttaccggttgaaagggactcttctctccttcagaatattttggacaggtttgatggacttcaaacctatgttggtgaaaggtttgactccttggaacgtcaagtggacacatga

SEQ ID NO: 54132 - DNA, 309 bp, Glycine max
  Peptide Sequence Number=SeqID_145817
atgcatattgtgactgttgttcctacatggccaaatttcccactagcccctttaaatcccatgtaccaatatcctccccaacaatatcaatactcagccaatatcagtccttcccattactcaccacccttccaaccaagaatgcccaattatccacaaaggtcacctctaaatcggccacaaaatccacctgctgcacatccaagaccaaacaccgcccctaataccagtcaaaacaccaaccaaggaaggaactttccagaaaaagaagcttgtagaattcaccccaattccaatgccatatgctga

SEQ ID NO: 54133 - DNA, 198 bp, Glycine max
  Peptide Sequence Number=SeqID_145818
atgacagcaaacattgaagctccttactactgcatcttcaacactaggtcaaaaatgagcattcctagcatagtaagctacgataatataacaacaacaacaacaacgccttatcccactaggtggggttggctacatggatcaacttctgccataatgttctatcaagtacccatagtaagctacgataataattaa

SEQ ID NO: 54134 - DNA, 606 bp, Glycine max
  Peptide Sequence Number=SeqID_145819
atggcaggagagcagaaagaggagtttgaacctgaagcggtgctggctgtgaggagggtacagaaacagggtgaagaggtgaaacaattacttatccattggaaggggaagacagtagaggaagctacttgggaggactatgtcatgttcaaaagtcaatttcctcaattcaaccttgaggacaaggttgcagctgaagaggggagtattgatagaaacaatgataataattcatcattaccaggacagttaattcatcatacctctagtggtcctagagtttggaaagtatactctagaaggggcagcgatgtaacaggagaggtcgtggaagttggtcaaggtgtccgaaagttcaaacctggagacaaagttgtagcccttgttaacccctttagtggtggaggactcgccaagtttgttgttgctaagaaaaacattttgatcaatgctgcattaggtggtgtaggtcactatgcactccaattggcaaagctaggaaacactcatgtgacagcaacatgtggagctcacaacattgtattggtgaaaagtttaggggctgatgaggtaattgacaacaagacccagatggtgcagctttga

SEQ ID NO: 54135 - DNA, 144 bp, Glycine max
  Peptide Sequence Number=SeqID_145820
atggctaccaccaccagtatgtttacgtttacgcttcctacaatctccaccaaattaggctccctgctagagtctcaattctatgatttccaaacttccattgctccaactgccctttcaaaggttatatgttcagggttataa

SEQ ID NO: 54136 - DNA, 228 bp, Glycine max
  Peptide Sequence Number=SeqID_145821
atgatgacaaaggagatgacaaaaagctcaaagatcaatcaaagaacaactcaaaacaattcaagagtacaagataagaatcaagaagaattcaagactcaagaagaaagtttagagtcaagaatcaagattcaaggttcaagattcaaggttcaagatcaagattcaagaatcaagggaaggcttaatcaagataagtataaaaagtttttcccaaaaactgagtag

SEQ ID NO: 54137 - DNA, 327 bp, Glycine max
  Peptide Sequence Number=SeqID_145822
atgccttccaaggttattttgatgatgccaaagaatcaagagttaagcaaagtttcaagcaaagattcaagaatcaagtttcaagtttcaagattcaagattcaggaatcaagtttcaagaatcaagaatcaagaatcaagagtaatcaagatcaagattcaagaatcaagagaagactcaatcaagataaagggtacatctacttgggtttgactgagaacaacagagggtacatctcttgtggatcagttctagtggagggtacatctactagggtttcaaagagaacaagggagggtacatcccttgtggatctttgcttgtaa

SEQ ID NO: 54138 - DNA, 234 bp, Glycine max
  Peptide Sequence Number=SeqID_145823
atggatggaaagcaatgcactccatcgggcaacgttgaggatgggttgcttggtgttgtcaaggcaatcgatgatggcagggaggagggcattgaagtggagcttgaagtgttcactggcgaggacgacgatggaggcaacaacttagattgtgccctaggagacgcagaagttgttgttcttgaggagatccatacgcgtgtcaataagcgaggtgaccttggaagaggatag

SEQ ID NO: 54139 - DNA, 129 bp, Glycine max
  Peptide Sequence Number=SeqID_145824
atgagtaagataggaaggtttggaggtttgggaatggaggaacgtcgcaagggagaagaggttgagcaggggtttctgaaaaacgtgatatttatagaccaggacgcattgccatctgttctagtgtaa

SEQ ID NO: 54140 - DNA, 1026 bp, Glycine max
  Peptide Sequence Number=SeqID_145825
atggcagaatcgtcaaagaaacgtaagggttcatccgcctccgcttcggcttcaagagctcatcgttccggagccactagcgcatccacaacaccaattccaccctccttatcctcttccacattgttttttttcgaagaacagcagaaatggtactcaaatcttttctcatctcgttctattatcgaccctaagttcattgatatggaattcttttctgctgaaacctttgattgcattcaagcatttcaaaatttaggtctcatacctttcatgtcattacaattgcctgtttatcctgaattggttaaagacttttattgtaatcttgaaattcaggacaacactttgatttctgaggtttttgggataaaaatggtcattgaccaatcccttttccatgacttaaaccaattgtccagtgacggtgtaccatttgaaggtacactaaatgacgattggaaatttgatttctctgcacatgatgcccgccagttggtttgcaccaaccatgcggatatgaccggacgcctccttgccggttcattggcttttgaaagccgcatccttcattatcttattgtgcggattttacttccacgatcttccaaccttgcccaggtttctaaggaagatcttgttatcatgtgggcctttcatactgggtgtcaacttgactgggcacatttagtcagatatcgcatgcataaggcattgcgattaaatgctcctttgccatatccacaccttgttactctcttttttcgccattttcaaattcctcttgattctgaaccttatgttccaatcaagagatcctttttaattggtgctgctgttattgcttctcttggttaccgcaaaaagcatgatggctcttgggtcaaaaaggctgctcaacccgctgatgatgaaggcaacctaccaactgaagatagttcctctcttcagaaaatattctcaattgtcacatcttttcatttggttcttgaatggctatcaaaggcctatatatatgtgacttga

SEQ ID NO: 54141 - DNA, 770 bp, Glycine max
  Peptide Sequence Number=SeqID_145826
ggtacatcctttgtggtacaagtagagcgtacatctacttgggttgtaatactgagaacaaaagagggcacatctcttgtggatcagttcaagtggagggtacatccacttggttgttcaaagagaacaagggagggtacatcccttatggatcaaggttattggaaaggattttacaaggttattggaaatctcaagaaccggtggttgcttggggactgaattatttcatggccccaatttccaagaagttatgtggcaggccaaatggctctaagaacaagcccaagtccacctcccgctcgatttgccaacccattgaatcctctgtgaaacttgtcacgatcaacgttgtttcaggcaagggtgtcatggagaccatccttgatgttgcttgttgtgaccatgttagcctcactgttctcaatgcctttggcatgatcaagaatgtgatcatttgcaacccaccacaaggagccacccatccccctccattttctttcgcgttcaagctttgcacatctcatggacaggtcttcgatggacttattggtggtagcatcattgttggtgacaatgtcagcctcatggcaaagaagggaacaatgatgacaacaacgtataattataacgataatccaagtgatttaagtcggcgtggtgacttgttgttgttcaacatggtgggatccaatgtccgcggggggcagaataagaggagagttctctacaatgctttatatgctggtggtgttttttgtgttgggtga

SEQ ID NO: 54142 - DNA, 359 bp, Glycine max
  Peptide Sequence Number=SeqID_145827
atgtcgcctaagatcgtcggagaagaagaaactgacgacgttcatgctaatcgtaatgatcatgatgcatcgcaaatgactgcaccacccaactctcctcctcctcctactggtgcaacatcacagtcgccatctaccttgaagcagacaagaaaagccacacagctaagatcattggcaactagaccagttggggcagcgaaactgctggtctatgtcgatcctacgaccaggaaggtcgatggtccccacagaaagaaacaattcaagtctgatttgacaacgaaatgggcacttgtagccgacaaggaaagtatcgacgacactgtatgcgaaaagtacgacattagcaaggagaa

SEQ ID NO: 54143 - DNA, 1130 bp, Glycine max
  Peptide Sequence Number=SeqID_145828
cgattcgacaatcgttatcaccctatccacccctcctccttcaaaatctacttcaccgtggtcgaaatcccgtcgtacataactacaaaaaccgtgcttaccccctcgccccgaacctccaacatcagcctacgtcatccaacagcgtcgctcacgacgctgatatcgccccgacgagggccccacacaaagcactctacatcattcgagtagccagcatagaggcctatcacgttgtcattttgaataatttcagcaaaaacttgccaccagtagcccttcatgccggccaacaatcgctgcatgatgagctccttcgggaccatgatcgcggacatggtgttctccatggcatcaacgatgggagggataagcacgacatagatctggtcttggaggcgttgacggagagcgtacatcatcgggttcttgaaggtgcaaattgtttggctggcatcattgctggcaatgactctaccgccaatggcaccaccaaagacttgcccttgacagccattgagggagaacaatgtgaagggcctgcgaagtgtgagggcatcaacaccatgcaaagagttgagggttgcttcagtgatcattccaaagacattggggatagtgaggctaacgtggcctcaatgagcaacatcaagaatggactctatgatgtcgctgcttggggtcacattgacaatgatgaccttcatgcagggttccatggagcaagattctctaggggttggtttgtagcaggtgatggtggacaacgagagcgttggaaggaagagctagtgttgttgtcccaagaggatgtcaagtctaagtcaaaggagagggagttatggaagatggagattaccatggaattgttggtcattatgacaaagaggggtgctcaaccaaatgatgatgaaggacaattaccggttcaagaggactcttctctccttcagagtattttggacaggtttgatggacttcaaacctatgttggtgagaggtttgactccgtggaacgtcaagtggacacacgattcgaggagatgaactcaaggattgcaaaggttgaagaagatgtcaccatcattcgcgactgccttgatttacctccaccacctccatcagtttag

SEQ ID NO: 54144 - DNA, 126 bp, Glycine max
  Peptide Sequence Number=SeqID_145829
atggtggaagtggtggataaggccgacagttattgtaaagaagaagatggaaatggcacggcagccccacaaccatgcatggatagcgacatggaggatggaacatgtgcagtgtgcatcaaataa

SEQ ID NO: 54145 - DNA, 945 bp, Glycine max
  Peptide Sequence Number=SeqID_145830
atgctacaatgcgaagggttttcctctaagctcagatatgattttgaaattcccaatggtgagaatgttcgaaattgggttgcgaacgtggtactcaaatttcatgacgatccaattgtgaacgagtctgagatcgtcatttttttgagacaggtttggtgggctgcgagaaaaagaaagaattacaaaaattgggatgttacacctctcgcccttcaccctaccgtgacctccgcaagcttaccgtggacattccctctattgctctcaactgcctctgggcattgtgcatctattctcaccaatcggaagtcgcgtgttaccgcaacccgaaacagcacactgcagtcttgtctaatggtaatggcgagttttagaaacgctgcaatcaacatcgttgaaaggggaaggaaggaaggcaaggaaggagagtggatcgattcctcaacagcaccagacatttataaaagctcattcccttccccgaaatcgctcatactcttccaatctttttttttttttacctttctctctcgctcaataatacaaaacaaaaaaaagaagaaggaactcaaggatctccagaaggatcctcctacctcttgcagcgccggtcctgttgctgaagacatgtttcactggccgacaacaattatgggtcctccagacagtccttatgctagaggtgttttcctagtcactattcatttccctccagattatcccttcaagccaaccaaggttgcattcaggacaaatgtatttcacccaaatataaatagcaatggaagcatttgccttgacatattgaaggagcagtggagccctgcgctaactatttcgaagctgctgctttcagtgttgggtggggttgcaacttcagacttttataggtatgtttcaattgctaactttcttgaattgccgcagaatcctatatcttaa

SEQ ID NO: 54146 - DNA, 864 bp, Glycine max
  Peptide Sequence Number=SeqID_145831
atggattgggaggtcatctcgataggcggttcctcgtatgaggatacgtgccgaggtgcctccaatagtgagtcctactctacggagagggagcctttcccaatcactgtgatcctccccctttctgcttctgggggtgtaagaagaagtagtggcgacagagatgtgaggcgtctccctgtgttcgatgtgaagctggcaaaccctaaggactcctgtaagctgggcgttcaggcttgcgggagtgatgacttcccatttttgagggcggcaattggtcgtcttgagtgtcattctgcccttgatcgcttttcagtgtgctctactagagcacttgaatgtggcctcttcccaacttcacccaaacagttgagtgatagtagtgacaagattggatgggtctccttgaacaatgttgagtttgattcaaacatcttccgccatttaaaggaccattttttcaagtctgaccctacccttgtagagagggtcaacaaagcaattttggagcagttggtgacctcgctggacacatggctcattctgtctctttcatcagcaagtgatcctctcgttgccttggatggtaaagtgcctaaccttgtccttaggccactcatgaagcaggttggacctacaagtgggactgtgccactgtttgctgctactccacccgttggagaagggggtcaacttgctggtgaggtttgccctattgttgttggggctgaggctgcagggttgatggctactacgggtcgcctttcgattgtgcaagatgtgcatccagctccaccgattgtcaaggctcctgctactgttgctactcctgcttcttcacctcctcccactattgttgtttag

SEQ ID NO: 54147 - DNA, 171 bp, Glycine max
  Peptide Sequence Number=SeqID_145832
atgacgggagtgcgggcgaaaagccaaaggagcgtcttccaaaaaggaaaacgcgtgggagtcaccaccaacatttattcgagaaaaacattagaaaaaccaaaaatgagattcattttaactgcgaaaaaaaagtcgtttaaggcgttggaccttgaaacaatgttttaa

SEQ ID NO: 54148 - DNA, 264 bp, Glycine max
  Peptide Sequence Number=SeqID_145833
atggccaaaaatcatatcttccaatgggcttttcacttaaggcttgtaatgagcttcaaaacaaagaaaggggaaaataggctcaaaggggctatcaaaggaattaattcaaggaagcatcaacaagaatcaagccaaggctattgtgcaagcaatcaatggggcaaaacacaccaaaagattatgatgatggatggctcgaattctcacaaaggtaaacttatcactttcaaattgagctttcaaaactatcatgacatgtaa

SEQ ID NO: 54149 - DNA, 963 bp, Glycine max
  Peptide Sequence Number=SeqID_145834
atggcccataccaagaaaactggtcaaatgacgtctgaggcagcaaagaaaattatagacaagattatgcaatcacatgaactcacatttcctcctaagcctgaggttggcccccctgcttcccgtgtcggcacaaaggagagttgtgttgatccctcagggcacgacccagacacgggtgacttagagaaatatggattgtacgttgatgaaaatcctcctcgtctggttgcccttggaagactttataaggggtcgaccaccattcacaacatccctttgggcaatgatcaagtcaaggataaacagggagctgaaggaccggcaaaaactacagataggttggatgctgatgtcaatcctctatatctgatgacattgaccatcccacagctttttctcaagccgttgcatgttttgtgtgatgctaccgtgtttggggtttataatgacaacttctccttgtacatgaagcatgaagatctatctgaaataacacatgatggtcaatgtatgagcatctttgttataccattgtggatttttgctttgaaaggatttgtcgatagtcaacaaagtaaatccaagcctgctgctagatggattgttgttaaatgtaataagaaaaaaggaagcactgagtgcaagtactacgtaatgtattggatgtcaatgctaatcttaggaagttttaagaataattgggaaatggtaattttttacttcaaaagacctgcagtacatgttgtagtagagaatgagcacacccaaccattactaataaactcgaaagccaaggagcaggatgaagacagagaagaagaaaatgataatgctgaagaaactaagaaacatgtgacttctattgtggtggcatataagttatttacaccatcagtaaaggtgagaaacccgtcaatatggaggaaaatagagattaagcagttcaataatctaaaatga

SEQ ID NO: 54150 - DNA, 489 bp, Glycine max
  Peptide Sequence Number=SeqID_145835
atgaatcagacaacacacaagtggcttgacatgggtggaaagagatggtggcaagataaccctcatcaattctgtcttaacagccctccctgtttcgaaacatcacaacggagacagaccattgaacaatggattttcatcattagcatacaacagagacataccttcgatggcttctctgggagtcttaaagccaagcataatggacttccaaaatcgagtcccaccctttccgggactcgattttttcctagttttcttcgacctacgaaagtgagcaaatgttcaaacgaggaacgcctaatgttaaaaccaaaggacgtacctcaaaagataagtgccagacacgaattccacaaacacgaactcgacaatgtggttgcagtcacggaagcgcagcccagtttgcgtcaaacaccaactcaggcagaaggagaaacaacaagaatgccctgggagtaccctttccgggactctttcctttcctag

SEQ ID NO: 54151 - DNA, 732 bp, Glycine max
  Peptide Sequence Number=SeqID_145836
atggtggatataatgctttatgaaagaccacgtccaaaatctgttaacaagaagacaatgggattggtgttcgataaagactgggaggacataaccgaagaaacggtggatataatgctttatgaaagaccaagtccaaaatctgttgacaagaagacaatgggttatgtggttgttattgcaataccgaaagaggaatacagagaaggccttgaagactgcaaaagttatttgcatagcaggattcttttggcaaagggcgtccctcctccaagagtttctgatttgcaagccaaagctttggcatcctttgggacgttggcatatggtcccaattggaaaaggctattgcaattcttctttctccttagtttaagatttacgtgttgggatcccctctgcatagatgatgcaatgaatagtcgtgcatttggacgctatgcttggatttttgtagatgtggaccttgatagaaaactaaggacaagtcttagtggaatggaaaggatatgccttctatgtgggtatcgacaaggaagaaagaggttcatgtcctccaaacagaaaaataaagagatcattttgcaagacaatgcccttgctagggaaggtccaagctatacccttaacaatcaagctgcgaatcctgaaccatggtgttacaacggtgactttaatagaattgttggggctcatgagaagaatgatgggtgctatcctttcttggcctag

SEQ ID NO: 54152 - DNA, 264 bp, Glycine max
  Peptide Sequence Number=SeqID_145837
atgaagtgctttaaatgtcttggaggagaacactttacttctcaatgccccaccaagaaaatcatgattatgaggggccaagacatttatagtagccaagatgaggctactacttcaccttttgcttcttcactttcactagatgaagttgtggttctttcttgttgggggtttgaaaaaaaggtaaaagatagggttccaaaagaactcaagataagcgtgataagcaagaagaaagtattatgcaataacaagataagctag

SEQ ID NO: 54153 - DNA, 114 bp, Glycine max
  Peptide Sequence Number=SeqID_145838
atgactattacaaatggaaattgtgcttctatatttaccacatctagtgtggctgcgaggaaatttcagaccgagaatgagggtagacagtcattgctctggtactctgaatga

SEQ ID NO: 54154 - DNA, 210 bp, Glycine max
  Peptide Sequence Number=SeqID_145839
atgttgatacttaaaaaacatcgtaccccattgcccagaggctcttcgctatgcgaaagtatgggggagggatgttgtacgcagccttacccttgcatatgcaaagaggctgtttccggattcgaacccatgaccaacaagtcaccaaggcacaactttaccgctgcaccagggttcgccctcactatgttgatactgataattatataa

SEQ ID NO: 54155 - DNA, 598 bp, Glycine max
  Peptide Sequence Number=SeqID_145840
gagtggtgcgctcagcggatggctcgctaagccggatggtctaaacgtaaagacaaaccctcttgccagtcatgggggaccagttgttaatgcggtggaggagtgcggacctcagaggccaaagcaaatgaaagatgtggtaacctctaggaggtttatattgaaggcgctacgccaggcgggcatcatttgctttgacgggggtgagggggatacctgcttgatacacccgggggtagcgcatgatgtagaggtatgccctgtggcagaggatttgctgcaagggataatggatcaaggacggtttgaagttggtggcgcaagcaagggtgagcaacatgtgtgcatgcaattggctgacaaaagctcgagtaagcccaaacctttagtgatccaattcaccagagatgctactacccaaaagccccgaggcttccagcctgtctcgggtaagaagcctatccctttcccttataagaatgacaaggcgtgggtgaatcttcacggcacccgacctgttggtgcagtccaaggacatgaagggaaaggaaaaggtgggcatggaagaaagcgacaaggcaagcccgattctggatga

SEQ ID NO: 54156 - DNA, 1059 bp, Glycine max
  Peptide Sequence Number=SeqID_145841
atggcagaaccatcaaaaaagcggaaaggaacttcgagtcggagtcagcggcattcagggtcacaggaagccccaattccttcctccattccctctggatcattattctcatcaaaggaacagcgtatacgatacacaaacctcttttcctctcgttccattatagacccaaaattcatagatatggagttcttctcaaatgagaattttgaatgcttccaagcatttgaaaactccaatcttattccattcatgtctctgaaattacctgtctattctgaattagtcaaagctttctattctaatttagaaatccatgaaggtattctaatgtctgaaatctatgggattaagatggtcattgaccaatctctattttatgatttaacaaaattgcctagtgaaggtgtgccttttgagggtgcattgattgatgattggaaattcgatttttctgtgcatgatgcccgccggttggtttgcaccaaccaagcggatatgaccggaaggcttcttgccggttcattggcttttgagagccgcatcctccattaccttattgttcgcatcttactccctagatcttccaaccttgctcaggtttctgaagaagatatcattgtcatatatcgcatgcataaggcattgcgattgaatgccccattgccttatcctcatcttgttacccttttccttcaacccttcaacatccctcttgattttgaaccttatgttccaatcaagagatcattccttataggcgctttagtcatagcatcctttggttatataaaggagcatgatggctctcgggtgaagaagggtgctagaaatgttggtgaagaaagacatgaaggagaagattcatcccttcttttgaagattttggaaaggtttgatggtcttcaaacctttgttggtgagaggtttgatactttggaattgcaagtggatatgcgcttcaatggaatgaagtcaagaatgacaaaggttgaagaagatgtatcttacatccggtcaagctttgatcttcctccaccgccgccaccatcatcttag

SEQ ID NO: 54157 - DNA, 264 bp, Glycine max
  Peptide Sequence Number=SeqID_145842
atgatgacaaaggtgatgacaacaagcccaaaggtcaatcaaaggatgagttcaagatgttcaagaaggaatcaagaacaatttaagactcaagaggaaaagttgaagaacacttcaagattcaagaagaatgatgaattcaagaatcaagattcaagcttcaagaatcaagatcaagattcaagattcaagactcaagaatcaagagaagacttaatcaagataagtatgaaaaggattttccaaaaactgagtagcacatga

SEQ ID NO: 54158 - DNA, 162 bp, Glycine max
  Peptide Sequence Number=SeqID_145843
atggctatgcaaatggcaagtctatgcatggtcggtgttcggattgatctttggaccaattcttcttctcatggagttgtattttatttgtcattatttggtaatgctgatagcttggaagaggccataaacattatcaatgaaaacaaatacattggttaa

SEQ ID NO: 54159 - DNA, 312 bp, Glycine max
  Peptide Sequence Number=SeqID_145844
atggcttccttggtatccttcttagtgcttcttcttgcaacccttatcctcatgcctcaagggcttgctacttactacaaaccaattaagaagtcgccagtgtacaagccactggtttataagccgaagccaccggtttacaagccaccatacatgaaaccaccttatggaaaataccctccagtagcaatgaatgttcttggctcttgcatgcacttcaatcctttgtataatgctgtggccaattcatcatcatcatacctatgtttatgtgaatgtaaatcagactataagagagaaaacggtgcttga

SEQ ID NO: 54160 - DNA, 240 bp, Glycine max
  Peptide Sequence Number=SeqID_145845
atggcaagacacaagatattttttgcccacttcccttgcaattgttgttccatgcaccacaggctgttcatcttgcacaccagaggcacctatgagtactacctgtggggggaggcactcggtcctccggattttcaagggccgccgggggcgcaccggacaccacgcgacgtgcggcgctcttccagccgctggaccctacctccggctgagccgtttccagggtgggcaggctgttaa

SEQ ID NO: 54161 - DNA, 131 bp, Glycine max
  Peptide Sequence Number=SeqID_145846
ccgacaaggacagtgttgatgacactatatgcgaaaagtacgacattagcaaggagaagtgggctcaattttgtcagacccgtagagacccttcgtgggaggatgtgcaaaagaaagctcaggccatctag

SEQ ID NO: 54162 - DNA, 321 bp, Glycine max
  Peptide Sequence Number=SeqID_145847
atgatggcacatcaaaaccccccatacttagccttttgcactcctgggcaaaatgaaacaaagaacaaaatccaaggatatgaaagggagacaaacaaaaacattcacatatttctcaatgaacatcaaggaatgaaaggaatggcctttgagaaacaacattttcattcagcatgtccaacatttaaccaatatacaatgtacatcaagtatggcccaaaatacatcatgaagcatagccaacaaaacaagttatccaatgaaacaaaaaccccccacacttattcccaaaacaatttccaaagctccagaattccttaa

SEQ ID NO: 54163 - DNA, 1236 bp, Glycine max
  Peptide Sequence Number=SeqID_145848
gaattggaccggggaaagcaagtcgaaaatggggtggttggagtaccaaggaaatgtttggaagcaaaggcgagagtcttggcaagtcaagacgaatgggccccgttcatggacatcctggcactcttgatcttcgggttggtcctctttccaaatgtggatgggttggtggaccggacagcgattaatgcttttctcgccttttatgaccgcaggaaaagcccggttgtcgctatcttagccgatctatatggcacattcgaccgaagatgtgagaagaacaatgcaaggatcgccaccgctcatgcaccgagaaaaaaaaaggcaaattgggaccgactcttagcaagcaaagaaggagcgtctgtcaattggttcccccgatggaaggaaggaagagccgggattcttatttcgtgtggggaaattccaaatgttcccttgatggggacgaggggttgcatcaattacaatcccgtcctcgccataaaacaacttggttatcctatgagaggggcaccatcagaggaaggcctcacaccttttattgcacgaggtttcaatagcaccaacgcgggggtgattcacagggtccgcaaggcatgccactcagtgggagtcgtcccctccacactccaccaaaagctgaagttcgtagtggaaggacatttggtcataatatcagtaagtatcgcctccgtagattccctccctaggcagccccgcctatccgatgcggcaataatggtggcccggatgatgttggggcacagctacgagcccagaatgggtttgggcaagaacaacaacagcaggaccggcctggtaagcaccagaggaaaccgcgggaagtttgggttaggctataaacctacgcaagctgacatatggaaaaacatctcggaaaggaagaacaaaggccaaggtccacgatcgggacaacaagccaaagaggctccgccatgccacatcagtaggagcttcgtaagtgcgggtttaagatgcgagggacaagtcgccgcgatatgcgatgaggactccctgaggagatcgaatttggtacagccatgccctcccggtttccaactaggaaattggcgggtggaggaacgcctggggctttacacaacaagcataatatccgacgacgagtctcgcaaaggtactaataccggggacctggccgtcaatttcgagcaagaagcaagtcggacggaggatgaagaggacgaggat

SEQ ID NO: 54164 - DNA, 144 bp, Glycine max
  Peptide Sequence Number=SeqID_145849
ggcagaggtcgcatggccgaagattggcctgaggctcaagcaggggaggcgcccgcagaggctcccgacgacatggaggaggcccgcatggatgaggagatgacaaatttactcgatttcttgggagggagcggagccacatga

SEQ ID NO: 54165 - DNA, 333 bp, Glycine max
  Peptide Sequence Number=SeqID_145850
atggattcttttggtgggtttttcggcttttgtgtgtttttggcttttgattttttctgttttggttttgtgcgaggcgaacaagtcatcgacgcacaggattttggttgggaaggattgacattctcaccttgggtcaaggtttatggtgagttaggattttggctcaaggcttgtagaatggctagacatgatacatgtcagggtttggtttggttcaaggataaaagggatgccccatattatttccatgacacaaatgcaaaaatgatgatttggaaactttatgcaaaactggtcatgcatgcacctatgtggacactcaagtgttaa

SEQ ID NO: 54166 - DNA, 511 bp, Glycine max
  Peptide Sequence Number=SeqID_145851
aggactatacatcgtcgcaatcagagggctacacgtcctcgcctttagagggctacacgtcctccccttcagaggacaacatgacctcccctttagaggactgcacgccctcgccttaacaggactgcatgttctcatatttagaggactacacaacctcgccttccgagggctagacgccctcgcctttagaggagtacacatcctccccttgagagggctacacgccctcgccttcggttacacgtcctccacttcagaggactacatgcccataccttcaaaggataccttcataggactacacgcccttggcttcggctacacgccctcaccttcagaggactacacatcctcgttttctgagcgatacatgccctcgccttcagaggactacatgcctaacctttcaggggactacatgtcctccatttctgaggactacatgttctccactttggaggactacatgtccttgccttacgaggactacacggcttcacctttttag

SEQ ID NO: 54167 - DNA, 489 bp, Glycine max
  Peptide Sequence Number=SeqID_145852
atgattacctttctagtaaaaagaatcactcgattcacgcttaagaaagaactacgtaggtctgatttcgtcttcgatggagggctgttgtcctttgggacaaacgtgagaggtgctaataccttcctcaaacaaataaacgttggtggcgactccgcgcatctttcctcctttgaaaagcgcacccgtgagcctcgccctcgctcgcccgcaaaagggcacgagactaataaaattctcctacaaggagtggttggtgttgatggcctatattattttcacaacctcaagcttcaaggcaatccttctctactgatgtccacttctgcatctgttacaaatgctgagtttcctacttcagctgctactgccaataatacttctaatattgtttcaaattcggatgttacctcttccagtagtgctaatctttggcatgctaggttaggtcatcctaatgagcatgtaatgaaaattgttctcaaatag

SEQ ID NO: 54168 - DNA, 309 bp, Glycine max
  Peptide Sequence Number=SeqID_145853
atgggtcaagactcttggtcggtgttccgcaaccatctgcttaaagaacttgccaatttctcagaagactatatcaagctctttggtggcacggagagatttgaggaattaaggatgtcactacttgttgatgggttaaccaaggtgacaacggataagtggatgaatataacggacatgagacatgtcattgcatcaagcaattgtcatccgcaggcgaagtcgtggccaaatccatatattagcagaatgcagcattacaagagcttcgtgatgtttaagagagactatgttgacataaatagatga

SEQ ID NO: 54169 - DNA, 678 bp, Glycine max
  Peptide Sequence Number=SeqID_145854
atgggtgacatagaagaggtgcaggaacaaatgaaggccgatatggaggccttgaaagatcaaatgacctccatgatagaggccatgttaagcatgaagcgaataatagaaagcaacatggccgcaacagccactgaggcggatccgacccatccctctgccataaaccaagcaaaccaacccatcccggacgtgttgggtcaaggaggagaggtgttgggcagcaccagtggtccacacgtagggcataataacaatgcttacccctatggcttaccccccaattatacgccacctaccatgcacatgcccaacgagaatgctaatcacgtcgttctcgttacctttgagggtcaacaaccccagcctatagggggcgtccgtgaagaacctcaggagcatgctcaaggtgacttcgacccataccccactttcaccactgagggaccaacatttaatgttatgcctcgacccaataccgcgggagctcctcaaccccgccctctgcaatcgctgcatttctcagtagaggggtcgcctccgacaatggaagggagaaagagacttgatctcatcaaggagagattaagggctgttgaaaggtttggtgattacccttttgttgacatggaaaaattgtgtttggtacttgatgttgtcatccccccaaagttcaag

SEQ ID NO: 54170 - DNA, 252 bp, Glycine max
  Peptide Sequence Number=SeqID_145855
atgttgctaagtagcaacatcatccctatctgcgtaagagtggtcatgttggtgcacatgatccgcactcgtctctttgcagcgacacgggtgaaatcttgccccaatatgcatagtagttgcacaatagcctccctctctggttgtgctcgtacaattggtcaccttccaatatcagggggtggcccaggaactgataaaagcaaactactagcccttcatccgagagcgcaggcctcgattaagcattaa

SEQ ID NO: 54171 - DNA, 261 bp, Glycine max
  Peptide Sequence Number=SeqID_145856
atgcagcacaagtacttgcactacctccggagcctaaggttggtccttcagctgctcctgtcagcacaaaggagagttgtgttgatccctcagggaatgatccaaacacgggtgactcagacaaatgcgggttgtacatcgaagaaaatcctccccacctgggagctgtgggaccagcaaaacctgcagatagtgatgcagctccatgtggagcttgtatgccttggatcttcttcatcaatggagtcctttgcttcttga

SEQ ID NO: 54172 - DNA, 354 bp, Glycine max
  Peptide Sequence Number=SeqID_145857
atggggctccgaaaaaggggtagagattggagaattgcactaagcaatcagtacgcatggctccaaacttgtgggtggaggatgcatgaacgaaaacgcaattcatggggctcgaaaaaaagggtagagaatggagaattgcaacaagcaataactgcgcatgactccaaactcatgggtggaggacgcatgaacgaaaacgcaattcatggggctccaaaaaagggtagagaatggagaattgccctacgcaatcactacgcatggctccaaactcataggtggaggatgcatgaacgaaaacccatttcatggggctccgaaaaaggggtagagattggagaattgcactaa

SEQ ID NO: 54173 - DNA, 342 bp, Glycine max
  Peptide Sequence Number=SeqID_145858
atgcataaggcattgcgatcaaatgctccacttccatatcctcatttgatcaccttgttcttacaacattttaatgtatctcttgactctgatccctttgttaaagtcaagagatctttctctatcggtgcgaatgtggtctcctcttttggataccgcaaagagagggatggttcttgggtgaagaaggacgcaccagcacaggccgtagaagaccgttctccatcaccacctcctcagagagatgattcttcatctcttatgcacaacattcttgacagattggatggactccacaccttcgttgtttgcgggaatggatactcgcatcactcagcttga

SEQ ID NO: 54174 - DNA, 120 bp, Glycine max
  Peptide Sequence Number=SeqID_145859
atgacgagtccggggaagaaagagcgtgttgtctactacttgatctgggcgtcccaccatctaagacaatacatgctgagccataccaccttgtttgatatccaagatggacccggttaa

SEQ ID NO: 54175 - DNA, 423 bp, Glycine max
  Peptide Sequence Number=SeqID_145860
atgacgttgccacttagcaacattctgcccagcgaccacaatgtcgatctccccctacggaagtatcagttggggtcgcgcccacaagacacccagtggacccggagaagtccaacagggcccgggggtttccagctcgggttacgggcctctgtcagtcctacagggtgtccgtcccccccagcaaggtcataccatcgtgacatatgtaaggatcacgcccgcaagacacccagtggacccggagaagttcaacaggctcttgggtttctagctctgattatgtgcctttgtcagttctatgaagcgtctgtcacccccaacaaggtcattaggccccccattaaccgggctttcatcaagaagtactgcgccctcaggcaggcgcagggcgagacaccacagcagcctggggatggctga

SEQ ID NO: 54176 - DNA, 546 bp, Glycine max
  Peptide Sequence Number=SeqID_145861
atggaggtaccagctgctgtggaggacattcctgcggacacaagcgcagaggcggctgaggatcagcctcagggatttccgggtggtccgagcggtccatctgtgttgacagcgtatgcggatcacgttgcttgcagcgtatggacgggagaagagcgtcttgaattgaagctatcctctcatgggaggaaggtccacagtttaggcaggcctgtccctgccattgagggacttattgctggtacaggactaagtcctctgatcgcgtgttcgatagacaccggcgatcggggacttttgtccgcgtttgtggagcggtggcaccgggagacgtctagtttccatctcccggtgggggagctcaccatcacattggacgacatctcctctcttctccatcttcccgttattggcgacttacacgcatttgagcccttgcacttggacgatgcggttcagatgctggtggacttgttgatggtctctccagagtctgctagggctgagacagtccagtgtcgcagactgtacgtacgcctgcaatgg

SEQ ID NO: 54177 - DNA, 978 bp, Glycine max
  Peptide Sequence Number=SeqID_145862
atgggatcgagtcagacgccttcgcttaaaaagaggttctatcaagtcaaggtcaagagcctaggaatcgccagtctggaagagttaggacagttgatgggtcagctccagcgacaagcctttcgcaaagcttatggtaagatctgggacctaaccatggcagaggtctccatggaggccattgcctccctcgccccatattatgaccagcctttgaggtgcttcacctttggggacttccagttaacacccacggtggaagagtttgaagagatcctggaatgccctttgggaggaaggaagccatacctcttctcaggattctatccccccttagctagaatttctaagatagtcaaaatctcgacacaagaattagaccgcgaaaagcaagaaatgttggaagcaaaggcgagagtcttagcaagtcaaggcgaatgggccccattcatggacatcttggcacttttgatcttcggggtggtcctctttccaaatgtggatgggttggtggactgggcatcgattgatgcttttctcgccttttacaatcgcaaggaaagcccagttgttgctatcttagccgatctatacgacacatttgaccgaagatgtgagaagaacaatgcaaggatcatttgctgtacgttggccctctacgtatggttggttttgcacttctttcgccaagagatgagacacgtttgcccgttagaaggccaccgctcatgcactgagaaaagagaggcaaattgggattggctcttagcaaacaaagagggagcgtctgtcaattggttcccccgatggaaggaggggagaatcgggattcttatttcgtgtgggaaatttccaaatgttcccttgatggggacgcggggttgcatcaattacaatcccgtcctcgctataagacaacttggttaccctatgagaggggcgccatcagaggaaggcctcatacctttcgttacatga

SEQ ID NO: 54178 - DNA, 327 bp, Glycine max
  Peptide Sequence Number=SeqID_145863
atgatggtggcccgggtgatgttagggcacgactatgagcccggaatgggtttgggcaagaataacggcggcagggccagcctgccatgccctcccgatttccaactaggaaattggcgggtggaggaacgccctgaggtttacacgacaagcataatatccgacgacgagtcccgcgaaggtactaataccggggacccggccatagatttcgagcaagaagcgagtcggacagaggatgaagaagacgaagatgtggggcttcccctagagctagaaagaataattgctcggcagaatcgagagatgaggccgcatccagaatag

SEQ ID NO: 54179 - DNA, 225 bp, Glycine max
  Peptide Sequence Number=SeqID_145864
atggagagtgcactaagcgatcactacgcatggctccaaactcgaaggtggaggacacacgaaacgaaaacgcaattcatggggctccgaaaaaagattgagaatgaagaattgcacttaagcaatcactacgcatggctccaaactcgaaggtggaggacacatgaacgaaaacgcaattcatggggctccgaaaaaagattgagaatggagaattgcacttaa

SEQ ID NO: 54180 - DNA, 79 bp, Glycine max
  Peptide Sequence Number=SeqID_145865
gcaagagtgaaaacatcacacaaaagcctatattgagagcatcaaacacgagtgaactaccatcaaagagagaaaacac

SEQ ID NO: 54181 - DNA, 1070 bp, Glycine max
  Peptide Sequence Number=SeqID_145866
ttcatcttttgaggatgaacactcatgctcttgctaaactacctatggctaagcgagttaagcgagctttgctcgctaagctcccaacagttagtagaatttttgaagagttggtgccgctaagcgcatcctttaaggagcttagcgcaaatccttgtggcacatgcaagctaagcggaccatgtctcgctaagaggccaatggcttcaagaaagagaaagagcattggtacaaggcccacatctcagtatgacacaaggagattctcttcattagatgcttggaccagatatacagataatgttcttggaagaaaaattttacctgagaggaaagtagagttatatcacactgagctagatgactttaaggccgagctggagaggcgtaatttccataaatgcctcaccaatttagctgatgggagcatagacctggctttggtgaaagagttctatgcaaatttataccgttctgaggaccatccactaaagcagtccagagttagaggtcatttggtgaaaattgatgctgacaatctcaacgcagtccagactctacccgtctactccagatactgcaggttgcctacagactttagagagatagaggctgccttatgcatacttggccgatggttcattttgaactctgagggccaatctgggaagattctcaggaaggatatgactacactagcttatatgtggagtttcctcccatactccaacttggcccccacatcacatacctatgatttgacagtggacagagctaggctgatctttgacctatctaacacctctaaacttgggttccttgctctaatcaccgcattatacagagccagaggggttgtctctgacagccttacctttgagtgcctgagctcggtcattaacctggcctacatcaggaagaactgttggaaccacgaggatctaacagtctctatcagaggggctaggagggcgagggcaaggccagctgagcttccttctacttctacagctcctactccaacatccacttcagcaaccccttctgtcccagctcagacaaattcttag

SEQ ID NO: 54182 - DNA, 684 bp, Glycine max
  Peptide Sequence Number=SeqID_145867
ggtaggtttgttcaaaggccaacttctctagcagccctcttgaccttcctatggttgccaattggcatcatactctccatcttatgggtctaccttaacatccctttgcctgaaagaattgcttggtataactataagctattaggaatcagagttattgtgaagggtacccctccaccacccccaaagaaggttgtggcactctcaagggaaagagagaaagatgctgccaatattaagagactacttgaggaaggggacttggtgatttgccctgaaggcacaactcgtagagagcctttcctcttgaggttcagtgtactatttgctgaactcactgataggattgtcccagttgctattaacacaaagcaaagtgtgttctatgaaaccacggtttgtggacacaagttgttggagccctactttgtattcatgtatccaatgacaacatatgagatcactttcttgaaccagcttcccaaggagctcacatgcagtggggggaaatcagctattgaagttgcaaactacattcaaagggttcttgcagggactttgggatttgagagtgaggtggtttgcatcgctgtttttgagtttgggggagttgttccatggccttacgtaatactgcataggacttatgctttcatgacctttattatgtcccgaaagaattag

SEQ ID NO: 54183 - DNA, 754 bp, Glycine max
  Peptide Sequence Number=SeqID_145868
atgtggtatgatgaaagaatatcaaaagataaaaattgtcagaatccaagccaatattctggaattcagagccatattgtttcaggtttaagtcacatgctcaatcaacacaattctcatgctaaaagttttagaatggccagggatagattggcaggtgatcaagccaataatatcaaattgcaactgatagctgctcgaggaaaagatgggcgtgtatataatatgcctaatgttccagaaattgttgcacttattgttggcgattttcatctaggctcaaaaagagatattattgttgaaactcaaaatggagaattacaaagaatccatgaacttcatgctagctatctaccactacaataccctatactctttccttatggagaagacggatatagagctgacatacttcaccgttctacttcatccagcaaaaaaagaaagcgaaaccgtctgacaatgagagagtggttatcttatagacttcagtccaggtcaaatgaagcacagactttattccattctcgaaaattatttcaacaattcattgttgaaggttataccatggtcaaatctgaaagacttagctacatcagaaacaaccaaaagaagcttagagttgataagtattctagcttacaaagttcattggacactggaacagctaaaagcttaaccaagggaaaaagagtcatcttaccttcaacgtttgttgggagcccacgttatatgaatcaactttactttgatg

SEQ ID NO: 54184 - DNA, 609 bp, Glycine max
  Peptide Sequence Number=SeqID_145869
atggcgaacgcatctacttcatcgaaagcttcgacaagctgggagacgaggtcaaaacatatttgtccaatccaagcaaatggcaagaccggcatcatcacagcaaatagtggtagccgcttcaaagcgagtaacggagataacttcctccgcatggagcatggcagacgctatgaaattacaccgaatacgcgagaagtcttgacgactgagtttgaacgctatgacattcgtgtggaaatcaaggaaacagcaccatcctccgatactgctcagacgcgatcaacccgttcattaattgcgggcgccaccaatgctgatcatgcagagttgcactggcgcctggcgattcccatctcgaccatcgtgatggtgctcctagccattccgctcagtttcgtcgacccacgtgctggacgctcactcaacatcatgtttgccattctgatcttcatcatatacaacaatatgctgagcattttccaagcctgggtcactcaaggcaaaatctcagtgatggtcggcttatggccagtacatttcagttttatcctgctaggctggtacctctattaccgccgcaaaacatctcaaaccactgatccctga

SEQ ID NO: 54185 - DNA, 580 bp, Glycine max
  Peptide Sequence Number=SeqID_145870
aggactacacatccttgccttcagaggactacacgtcctcgccttcagagggctgcacgccgtcaccatcaaaggactacacattctcgccttcagaggactacacgtcctcgtctttagagggctacatgtcctcaccatcagagggctgcacgccctcaccttcagagggatacacgtcgtcgccttcaaagggcgacacatcctcaacttcagaggattgcacgtcatgtcctccccttcagagggctgcacgccctcaccttcagaggaatgcacgccctcgcctttaaaggactgctcggctgcacgccctcgccttcagagggttgcatgccctcgccttcaaagggcgacacgtcctcaacttcagaggactgcacgttacgtccttgccttcaaagggctgcacgccctcaccttcaaagggatgcacgccctcaccttgagaggaatgctcgtcctcgtcttcagagggctacacgccctcgtcttcagagcgctggacgccctcgccttaagagggctacgcgtcctcacttttagtgggctacatatccaccccttaagagaatttaag

SEQ ID NO: 54186 - DNA, 447 bp, Glycine max
  Peptide Sequence Number=SeqID_145871
atgaaggccaacatggaggccatgaaggaccaaatgacgtccatgatggaggccatgttaagtatgagaaggatggaggacaatgtggccgcagttgccgccaccagtgccaccaccgaggtggatctgactcacccatccgacataaaccaaacaagccatccagtcccggacatggtaggtcagggaggagaggtgttaggcagcacgggtggtccccatgtggtgcaaaataagaattcttgcccaccgtacggcttacctccaaactatacaccacccaatgcaatgcacgtgcccaacgagaacgccacccactctgttctcgttccccttgaaggccagcaaccccagttggggcatacaccttttgctcagcctgtgggggaagcctgtgaagagccccgggatcatgctctgggtgagttcgaaccataccctacatga

SEQ ID NO: 54187 - DNA, 302 bp, Glycine max
  Peptide Sequence Number=SeqID_145872
atgggtgaccaagaggagacacatgaacagatgaaagccgacatgtcggctttgaaagagcaaatggcttccatgatggaggccatgttagggatgagacaactcatggagaataacgtggccaccgctgccgctgttagttcagctgccgaagcagacccaactctcctagctaccgcacaccatcctctcccaaacgcggtaggacgagaaaggagcacactggggcacatcagcaacccccatttgggatacaaccgggtggcttaccctcatggataccacctaattacacggcacca

SEQ ID NO: 54188 - DNA, 429 bp, Glycine max
  Peptide Sequence Number=SeqID_145873
atgatcgagtctgatggcacgcatagacaaattatggtcattctacgccttttgtcatccagaggcggagagcccgatgacatgcggagacaaattatggtcattccgcaccttttcgccatctggagacgatcgagtctgatggcacgcaaagacaaattatggccattctacgccttttgtcatccagaggcggcgagcccgatgacacgcggagacaaattatggtctttccgcacattttgtcaactagaggcaagcgagcctgttgacacgcagagacaaattatggtttttttcactctcgtcgtccgaaaacattcaagtccagcgatgcgtggaattcttctctgttgggcagagatgattgggtgcaatggcaaagggaagtgtcgcggttgtccaactttgtcgttttcaaaacactga

SEQ ID NO: 54189 - DNA, 150 bp, Glycine max
  Peptide Sequence Number=SeqID_145874
atgagtttgtgagtgattgtgagatcctagaggaggttttcggactatggaaagctaaatcctctgttggatcttcccttgggaactggtctgattctaaagtccttgatagtacaggactaagttattgtgctatcatgaggaatcggg

SEQ ID NO: 54190 - DNA, 1196 bp, Glycine max
  Peptide Sequence Number=SeqID_145875
atgcaagagaatcataagatcctggttgtcgatgatgacatgcgcctgcgcgcacttttggaacgttatttaaccgagcagggcttccaggttcgcagcgttgccaacgctgagcaaatggatcgcttgctgacccgtgaatccttccatttgatggtgctcgatctgatgttgccgggcgaagacggcctgtccatctgccgccgcctgcgcagccagagcaacccgatgccgatcattatggtcaccgccaaaggtgaagaggtcgatcgcatcgtcgggctggaaatcggcgccgacgactacattcctaaaccgtttaacccgcgtgagctgttggctcgcattcgtgcagtgctgcgccgccaggctaacgagctgccgggcgcgccttcgcaggaagaagcggtgatcgcgttcggcaaattcaaactgaacctcggcacccgcgagatgttccgcgaagacgaaccgatgccgttgaccagcggcgagttcgcggtactgaaggcgctggtcagccacccgcgtgaaccgctgtcgcgcgataagctgatgaacctggcgcgtggccgcgaatacagcgccatggagcgctccatcgacgtgcagatctctcgcctgcgccgcatggtggaagaagatccggcgcatccgcgttatatccagaccctcgtttgcccgaaccctgttgttgatcgtcaccctgctgttcgtcagcctggtgacgacctatctggtggtgctgaacttcgccatcctgcccagcctgcagcagttcaacaaggtattggcctacgaagtgcgtatgctgatgaccgatcggctgcagctggaggacggcacgctgctggaagtgccgccggcgttccgccgcgagatctaccgcgaactgggcatctctctctacaccaactcggcggcggaggagagcggcctgcgctgggcgcagcactaccagttcctcagccagcagatggcgcagcagctcggcgggccgaccgatgtgcgggtggagggcgacttctctccgctgttccgctatacgctggcgatcatgttgctggcgatcggcggcgcctggctgtttatccgcattcaaaaccgcccgctggtggagctggaacatgcggcgctgcatgtgggcaagggattattccgccgccgctgcgcgagtatggcgcttccgaagtgcg

SEQ ID NO: 54191 - DNA, 258 bp, Glycine max
  Peptide Sequence Number=SeqID_145876
atggagtcgccaactgtcgcaacatgcccttttgcgggcgagcgaggcgaggctcatgggtgcgctttccaaaggaggaaagatgcgcggagtcgccaccaacgtttatttgtggaaaacgtcgaaaaaaccgaaggaaaccgttcaaaaatgaaaattctaagttcgggagttgtatttacgtttgaggaaggtcgacaaaagtggggcttttgctcctacgtacccttcatcgaagaggaaatcagacctacgtag

SEQ ID NO: 54192 - DNA, 162 bp, Glycine max
  Peptide Sequence Number=SeqID_145877
atgtctccttattgggttgtctttggcaaggcatgtcatcttcttgtagaaatagagcataaagcctactgggctgtaaagacctgcaacttctctattgatcagttgagatcaaaagtgaatccacagataagagcttcaaggtcaatggacaccgactaa

SEQ ID NO: 54193 - DNA, 291 bp, Glycine max
  Peptide Sequence Number=SeqID_145878
atggctgataacaatcgaactctcaaggaattggctacaccaaatattgtgtatcaactttggtgtgaagatccacacaagcatcttaaggagtttcatgtaatgcgttccaccatgcgaccacatgacattcatgaagattatgtgaagctaaaagcattcccattctctatggatggtgtggctaaggattggttgtaccttcaactagataccatcaacactttgaccgatatgaaaagaagatttttagagaaattcttccctgcatccaaaacaacatccatctag

SEQ ID NO: 54194 - DNA, 462 bp, Glycine max
  Peptide Sequence Number=SeqID_145879
atgcaatctcagggacttgcaccgcctcctgaccctttggttggtcccttcggtcctcgagtaagcacaaaggggagttgtgttgatccctcaggaaacgatcctgagacgggtgactctgataggtgcgggttgtacatagaagcagatcttgcccgcctggttgccctgaggagagtttatgagggatccactattattcataacactcatttgttgcctggccaagtaaaggtgagtgcggaggaggttacagatgcagatgctccagttcctgtacccactgatgaggtttccatagtggggcaggcacttcacaccttccttgcttggtcgacacatctggtcaagtttttatcacagctggtagttgtgtctccggcaaaaccacctccaaggcccgatccggagatcgatgattcgctttatctgatgacattgaccatcccagagcttttttga

SEQ ID NO: 54195 - DNA, 195 bp, Glycine max
  Peptide Sequence Number=SeqID_145880
atgggccccaaactacgaaggtcctttgttgtgaagagggctttttccggaggagccctggggcaggatcatcttgagctaccttctggggtggggacaaaacatgaaaagcagaaaccaatcaaggtacttaggaacggatgcaagtggggatggagtcacgaccgactgatcgttgccccttctctgcgctga

SEQ ID NO: 54196 - DNA, 376 bp, Glycine max
  Peptide Sequence Number=SeqID_145881
atatgagggtcgattctttgagaatcctaacgacgagggtttgacgatcgattttgaccaagatgtgagccaaatgatgaatgaagaagaggaagaggacgtcctttcaccagagttggagaggttgatcgctcaggaagaacgtgaaatgaagcctcaccaagaagaaaccgatctggtgaacttagggaccgaagaggaaaagagagaagacatgcccggtctggactccgacattgtgcaacataagttgtcgttgaatcctggctgtggcgcgatacccagagtgggtggccaacattgtcccggtcccaaaaaaggacggcaaggtgcgaatgtgtgtagactatcgggacttaaaccgagccagtcctaa

SEQ ID NO: 54197 - DNA, 660 bp, Glycine max
  Peptide Sequence Number=SeqID_145882
atgcagtacgatttaattatcgatttgcaaaccaatgataaaagccgcagtttactgaccatgctcaggttgatgggtaaggcgccagcgttgttactcggcaatcatccgcagtttccgtacacggttaggcagccgcagcatttgccacaagcacacagctttcagatcatgcagcaaacgttgctgtccgcgggcattccagtgtctaccaatggccccaagttgcatatcgcatcatcgtcagttgagtctgccgagctgttattggcgcaatatgggttagcgcctaaatcatttgcggtttttctgtgcggtagtcatgcaggtggcctcaccaagcgctggggagttgcgcattattctgaactggctgaaaagtgtatccagcaaggcgagcgcgtggtgttattaggtgggcgtgatgaggccgaagagtgtcattgcgctgcagctggatgtgccgtgcaagaactgttatgccaagcaatgcagccatcattcctgcatgcgccagttatctccatcgcaattgttgtcacatttgcccgtttcaggggcgttggatgcttaaagtgctttggtgggggcggtctgacctcaactattccagaaatcgtatttgccggcggttattacagtcgctgggctatgagttga

SEQ ID NO: 54198 - DNA, 289 bp, Glycine max
  Peptide Sequence Number=SeqID_145883
tagaggaggtgcaagagtagatgaaggccgacatggaggccatgaaagagcaaatggccacaatgatggaggccatgatgagcatgaagaagataatgaagccaatgggttgcaattgccactaccagcgctgttgctaagtacgggtagcccctattatgcgcaaattcaaaacaagcacgccttcccgccatatggcttgccttccaactatacaccacccaatgtggcgtacactcccggtgaggatgtcaataactccactccgatactcattgagagccaataa

SEQ ID NO: 54199 - DNA, 114 bp, Glycine max
  Peptide Sequence Number=SeqID_145884
atggagttgttggatgagggtttggttcgcaagagcttaaatccttgtgctttgttggtgcccaaaataggtgttgaggaaaaaacccagagtttcaacaacctcggaatttga

SEQ ID NO: 54200 - DNA, 202 bp, Glycine max
  Peptide Sequence Number=SeqID_145885
atgcccatgaaaagggttttccgaccttaccctactctaacatacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagg

SEQ ID NO: 54201 - DNA, 228 bp, Glycine max
  Peptide Sequence Number=SeqID_145886
atggctttcaaagacctagagcagctgacacaaaaaatcaaggaccagctagaggagtcgatcatagaaaaaggagtcgcattgccttctgaggttggtccttctactgctcgtgtcaacacaaaggaaaattgtgttgatccctcagggcacgacccatacatggtcaaggtcgatgttgaggaagttcgagatgttgatgctcgcattcatgtacctactcaagag

SEQ ID NO: 54202 - DNA, 96 bp, Glycine max
  Peptide Sequence Number=SeqID_145887
atggattttgagggcgacaacaatgaggcgagcgaggagcgtgtagtattggctaacgatggccttgacgacagccttgtggagggtggtgattga

SEQ ID NO: 54203 - DNA, 387 bp, Glycine max
  Peptide Sequence Number=SeqID_145888
atgacgtacatgcaattcgtaatgatcatcatgaaggtttatgggagaacattcctacgtaattgtgttgtatcaaagatcatgggaacatcgccaaggtcccctccgcatttagatggtcattcagaagctacatccaagaagactagacaatccacacggctaagaaggttgactttaagaaccttagatcagcccagaccaacagttaatgccgatcctacaactgggagaggatcaagcccacaaaaacaaaagttccacaactatttgggggtcgtagctcgaaaaaagattcctattgtacatagcaattggaaagacgtgccggaatctctaaaggacctagtatgggattacattttggaaatcaggaaaaaggcatag

SEQ ID NO: 54204 - DNA, 192 bp, Glycine max
  Peptide Sequence Number=SeqID_145889
atgacgttttttcctcttagaagtcaaccaccgggagattcttcggtgtatcgcataatttgtatcggttacgtctatgacaatcattttgttcagttgtgtacgattgagttaatatttttttttgcacgtacgaaagatttatttaaaagatcgttgtcctttaccgccgttagcattgttatggtctag

SEQ ID NO: 54205 - DNA, 234 bp, Glycine max
  Peptide Sequence Number=SeqID_145890
atgtatggaatcacctctgctgtattttttaatacacatagatgcgcttgtgagacttcatgtcgagggggtggggataacgttgaatcctcatgtacccttaccccccagtgtccgaccatggcgactttcgggaacctcgacgggttgagcacattgaatgtactgggagcaaaactcaatacactcttcagcaacatacctttcgacaatcgaagcttcgggtcggggtag

SEQ ID NO: 54206 - DNA, 252 bp, Glycine max
  Peptide Sequence Number=SeqID_145891
atggatttcttgactagacatggagagtctataaaaggtacatctacttgggtgttatattggagaacaagagagggtacatctcttggtggatcagttcaagtggagggtacatccactttgggtggtcaaagagaacaaggggagggtacatcccttgtggatcttttggcttgcaaaggattttacaaggttgaaagaaatctcaagaactgcaggttgcttgcacggtttgtggccgaaccagtataa

SEQ ID NO: 54207 - DNA, 345 bp, Glycine max
  Peptide Sequence Number=SeqID_145892
atgacgggcaaaacgctcattgatgatctccagcgcctgcagacgctcgcgcaccacgcgacgctgggtattgggatcatagggcggatatcgccatcggcccctttggaactgttctctacttccgcactgtcactgtcgccattgagcagcgcgtcaatctcagcctgggagagaatgctatcgcccattaagtcacctcaaaatgaaggcggtaaacagcacgtcactgactacctgcgcaggttgaccttttaccagcggtggcgccagcacctgtttgatctgttcaaccagggcctgtttcccttgctcggttgccagcgcgctggcgctctgacgtga

SEQ ID NO: 54208 - DNA, 302 bp, Glycine max
  Peptide Sequence Number=SeqID_145893
gtgaattagttccattggatttagaaattgaagcaaccttcaaaagaaacaatgtagagagaaaaagaaagcttttgcacgatagaacagtagcatcaatccttgaagaggctcacttttctgagtcatcatcttctaattcacctacatccagggaatctcaaatagcagaatttgaagccgaagtcatggctaaagaacaacctcgacgagtgaccctagtgtttctgcccctaggaatactgcttgtttgtgtgggtgctaaatctaccggcaagtgcaccggatcgtcaagtaaataa

SEQ ID NO: 54209 - DNA, 462 bp, Glycine max
  Peptide Sequence Number=SeqID_145894
atgtcggaagtgtgggaaacctggtcatttaaagagggattgccgggtgttcaaaggaaagaacacgacttcagctggtccaagtgggttaatgattctgaaaagcaacaagatgacaagcaggagatgacgttgcttggtggtttgattcgggagcaacaagccatgtgtgcaaagatcgtcgttgtttcatctataattgataaactgccttcttcttggaaagacttcaagcataccttgaaacatatgaaggaagagttgactctggttcaactcggcagtcatttcatgattgaggagtcgctgagggctcaggaaattgacaaagtcaataataaaaccgtagcaggttcctcttccgttactatggtacaggaaagtggaacagttaagcaaaattacaatgctaaaggtaaccaacgaaaatttcacggaactaagaacaaaggtccaaactaa

SEQ ID NO: 54210 - DNA, 309 bp, Glycine max
  Peptide Sequence Number=SeqID_145895
atggtccccagtggagtcgccaactgtcacaatgtgcccttcgcgggcgagcgaaggcgaggctcacgggtgcgcttttccaaaggaggaaagatgcgcggagtcgccaccaacgtttattttggaaaacgtcaggaaaaccgaaggaaaccggtcaaaatgaaaattctaagttcaggagttgtattttacgctttgaggaaggtcgacaaaagcggggcttttgctcctacgtaccctccgtcaaagaggaaatcagacctacgtagttcttccttatgcgtgaatcaagtgattctttttacttga

SEQ ID NO: 54211 - DNA, 543 bp, Glycine max
  Peptide Sequence Number=SeqID_145896
atgtttgatctgaaatacgccacagccgataacatcgccgggtatgctatttatcgcgacgcgcaggcgctgctgcatccggatgcagccgccgcgctgcgccgcagcagtgacatcgcccggctggcggggttccgcctgctggtgctggacgcgtatcgtccgcagcaggcgcagtggcacttgtgggatgcctgtcccgacgcggattatgtggtgccaccggcgcggggctcgaatcacagccgtggcgtggccatcgatgtgacgctggtggatgaggcgggcaacattctggagatggggaccgggtttgacgacatgtctgctgagtcgcacccgttccatcccaacgtgccgcagcaggcgcagcgccatcgcctgttgctgaacgccatcatgctcggcggcggttttgtcggcatgcccaccgaatggtggcactttgaactgccggatgcgcaaaactatccgctgctcagcgatcgctttgcctgcgtcagccggaccgatcgcgctcctgtgagtgatattgcacgttaa

SEQ ID NO: 54212 - DNA, 405 bp, Glycine max
  Peptide Sequence Number=SeqID_145897
atggaggccatgaaagagcaaatggccgcaatgatggaggccatgatgagcacgaagaagataatggaagccaatgcggttgcaattgccgctaccagcgttgttgctaaggtgaacccgacgtccccatccggcatcaaccaaatgaatcatccaacctcagatatggtaggtagagatttgggaagtacggacggcccccaggatgtgcaaattcaaaacgagcacaccttcccgccatatggcttgcctctcaactatacaccacccaatgtagcgtacactcccagtgagaatgtcaataactccactcctatacccattgagagccaacaaccccgaatgatcatgcacatgtctcttaaaccgtgggggagacacatgaaattccccaccacaatctag

SEQ ID NO: 54213 - DNA, 126 bp, Glycine max
  Peptide Sequence Number=SeqID_145898
atggtccatgacatcattgtcaaggtgaaattggaaaggaaaatgcaaggatcatgcatgagcgaacatgaaaacaaaaggtatgcagtttgtagaacaaaaagtatgttgaacgcatatgcatga

SEQ ID NO: 54214 - DNA, 228 bp, Glycine max
  Peptide Sequence Number=SeqID_145899
atggcatccttcagccacatgcagtcccaacttcagttgcagatgcaatctcagggacttgtagtgcctcctgaccctctggttggtccctccggtcctcgagtgagcacaaaggggagttgtgttgatccctcaggaaacgatcctgagacgggtgactcaaataggtgcggcttgtacatagaagtaggatcctgcccgcctagttgccatggggagagtttatga

SEQ ID NO: 54215 - DNA, 1310 bp, Glycine max
  Peptide Sequence Number=SeqID_145900
gtcgactctagaggatcccaccgaaccaacaatggtggttcgatagaggcaagtactttggagtctgtggagattctaaaaggtagctcggccttgttgtatggaggagtatccgggggtgctgttgtcaatttagttacaaaaaagccgaagttttattatgggggggaagcttcgatgcgtgttggaagttacgacttttataaaccaaccgtagatgtatatggacctatctccaataaggttgctttccgggttatcggaacttatgaaaaagcggggagctttagggatcaggtcaagtcaaaacgaacttatgtaaatccttctgttctatataaaatatcggataaaacagaactcaactttacattcgattacttaaaaagtgattttacgcccgactttggaatgggaaccgtggatggaaagttgaataatgaagttggaagaaacacttttatgaatgtgccttttgctttcaacaggacaaacacttcaaacggacagatcaatttgaatcataagtttaatgagtcatggaatcttaatgcaatagcaagctaccaaacatacgatcgagattattatggatcagatcggattcaagcgaataaaaatggaattgcttcgcggagtttgaccagatccaaatcaaatgagtttacagccaatcagcaattgaatctaacaggaactgtgaaaacaggatcgatcaagcataagatcttggtaggagcagatgccgatcaatcgcatgcaaacgcgtatgcctataaaatcgatgcatctaaaaatgtgggcggtgcatacgattctatttacgtctttaatccctcgcaaactgcgcagcatttggcttcgggaaagggacttcggacagatatgccacaagcggatttattgaccaaaacaacgacggatatttaccgttatggtgttttttttcaggatttaattgaagttaccgaaaagtttaaagtattggctggtattcgttatagctatcaacgtacaccgaattcggaaaaatatacctatgcgacaaatctatcggaagaaatcataaatttagatggtcaaaaaaatccgatcggagctaaggtggataaagcatggtcaccgaaatttggattaatttatcagccgattccttcttcaagtgtctatgttacttatgcaaataactttacatcgaattccggatacgatgtgaattatcaaccattggctccctccatcatcgatcagtatgaagcaggtgtgaaaaatgactttttcaatggtcgtttatcggcaaatgtcgcttg

SEQ ID NO: 54216 - DNA, 216 bp, Glycine max
  Peptide Sequence Number=SeqID_145901
atggctcacgggtgcgtcttccaagaaaggaaaatgcgcagagtcgccaccaacgtttatttgaggaaaaagtcggaaaaatcggaaaggtgtggtgtacgaattttaatcgtgaaaggttcgggagttgtttttacgcacggggaagggtgtttccctcgctcctacgtatcctcaattgcgatgaggaaattagacctacgtagttctttctaa

SEQ ID NO: 54217 - DNA, 190 bp, Glycine max
  Peptide Sequence Number=SeqID_145902
acccatgactgtctctaccagctcagcctcagtctgcagagccagggtttcgctccttttccgtgccctactccagattggttcagggcagaggtcgcatggcccaaagattggcctgaggcctaggccggggaggcgcccgcagtggctcccggcgatgcagatgaggcccgcatggacgaggagatga

SEQ ID NO: 54218 - DNA, 633 bp, Glycine max
  Peptide Sequence Number=SeqID_145903
gatgtgcgaaaaaaggcacaggcgatccagaaacagaacattgcctcccacgttttgtctcgtgggggttatgaatatttggagcagaagctcctggctgagaagaccaagaagaagctggaggaagctgcacagtcaggaagcattgatggcgtcatcgaccctccatcccccgtcagacgccacgtgaagtggacgatggcctgcacgaagaaaataggggagatgacgactgaggccgcaaaggaaatcgctgagaagatcgattattcctttgaggagcaggcgacacagggatccttcgtcccccatggacgtcaggatgttctcaccgctgctattggacgtccagagcaccctggacgtgtccgtgctgctggagccggtgtcaccatcaagcaatacttcggatcggctccacggatgtctcacagctcttcctccctgcctcctgaagaattgcagcagctgacccaacaaatcagggaccagctagaggagtcgatcaaagaaaaagtgactcgacaactcatggcatcgttcagccagatgcagtcccagtttcagtcccagatgcaatctcagggacttgcactacctccgaagcatctggttggtccctcaggtccttga

SEQ ID NO: 54219 - DNA, 84 bp, Glycine max
  Peptide Sequence Number=SeqID_145904
atgattttgaagggcgagttgaaggctagtcttaggtctaaaagaagtttgtcccagcagttaagcgagacagaagtgttataa

SEQ ID NO: 54220 - DNA, 48 bp, Glycine max
  Peptide Sequence Number=SeqID_145905
ggtaaacgctgtgaaatttccccggacgcccaaaatggactcggatga

SEQ ID NO: 54221 - DNA, 371 bp, Glycine max
  Peptide Sequence Number=SeqID_145906
tgtttccggaaaacacttccggaagcacttcttccggaatgggtctcagtaacttccggaagaccttcttccggaagttactgaggcctcttccggaagaagtgtttgcggaagtggattccggaaacacttcatccaggctcagcgcacgactggcgctaagctcaaatccacttactcgcactaagcacgagggtggcgctaagtgcaacgtcgcggatgggttgagacaacaatctaagaagctattggatgcttcagctgggggtaagatcaaaatgaagatccccgacgaagcaatggacttaattgaaagcatggctgctagtgacattgctattttgagagaccgagcccacattcctacctag

SEQ ID NO: 54222 - DNA, 270 bp, Glycine max
  Peptide Sequence Number=SeqID_145907
atgcttagtacgccatcacctcgctcagcgagacatttgtctcttcctacgctaagcgcacccagctcgctcagtggattttcactaactcgcgctaagtacgaaaatggcactaagcgagcctttgaggatagaaagccctttttaaggctgaagctggaaaaatcaagagaaaggttagaagagaggctaattcagagcgtaaagagtagaatagaggcgcaaaacagagcaaggaagccaaaacctcagctttcaaaaggatcttag

SEQ ID NO: 54223 - DNA, 695 bp, Glycine max
  Peptide Sequence Number=SeqID_145908
agaagcctgctagagctttcatcacaagatgcattgttggcacaaaacaagctgttgtccaagcaattggaagcattgacagaaacactaagttgcaggttatgtcatatgtggaggagcacatgagtccggctactgtattccccaagaagaaacaccacatgaagtcaactacatggggaaccagccaagacaaaatttcaatgcagggacattggaggaatcaccctggaaaccagttcaacatagaccagggtggtccatctaagaggccacaacaacaagggcctagtctctatgatcgaacaacgaagctagaagagactcttactcagttcatctttggagctaatactgagaaaaatccaaaggaggaatgtaatgctatcatgactagaatcaaattggtgaccatgaatgagagtgagaatggaataggtgcagagaaacaacagctagtgtctaacccatcacttgacactatggtagagtctttgagtgaatctgaagaagagttggaggtagaagatgagaagaaggagacaacaataaaaaaaagcaagagtgagatttcaagggagaagaagagagaaaccactccagctgaaggcaaggaactaccatatcctttggtaccttccaggaaggataaggagagacatctagccatatttcttgcatcttcaaaaagctag

SEQ ID NO: 54224 - DNA, 386 bp, Glycine max
  Peptide Sequence Number=SeqID_145909
atggcgacttaccaaacctatgcaaactccgaataccgcagagtacagcttgggagacagagcaccgggtgcctggtaacgggtgctggaggtatcagaagtgcgaatgctgacatgagtagcgttaaagggggtgaaaagccccctcgccgtaagcgcaaggtttcctacgcaacgttcatcggcgtaggtgcgatgtggggacggagaaggttagctcagccaactgttggatatgttgacgaagtgagtgataccctgcttccaggaaaagccactaagcttcagctacacacgaccgtaccgcaaaccgacactggtgcgcgagatgagtattctaaggcgcttgagagaactctggagaaggaactcggcaaattgatacc

SEQ ID NO: 54225 - DNA, 156 bp, Glycine max
  Peptide Sequence Number=SeqID_145910
atggcagtcgacgtcggctgcattaatgaatcggccaacgcgcggggagaggcggtttgcgtattgggcgctcttccgcttcctcgctcactgaacttcgctgcgctcggtcgttcggcttgcggcgagcggtatcagctcactcaaaggcggtaa

SEQ ID NO: 54226 - DNA, 204 bp, Glycine max
  Peptide Sequence Number=SeqID_145911
atgaaaggaaaccacgacctaaagtggtcctctccctttgattgccaaccaaaaacctgtgcgtcggtgacttgttcgcctcacgctaaacaaaaacaaaaaaggaaaaggccaaaaacactcaaagccaaatttcccaccaagaaaacaaaccattcccaagaaaaagtcctattgatccatgatcacgcatgtaatctttga

SEQ ID NO: 54227 - DNA, 705 bp, Glycine max
  Peptide Sequence Number=SeqID_145912
gtcgactctagaggatcccaccagagggctgcacacctcgcctttagagggctacaggccctcgcctttagagggctacacgtcctcgcctttagaggactacacgccctcgcctttagaggactacatgtcctcaccttcagagggctacacgtcctcgcctttagagggctacactccctcaccttcaaaggactacacgttctcaccttcagacaactacatatcctcgcctttagaggggtacacatccttgcctgtagaggactacacgccttcaccttcaaagggctacacaccctcgcatttagagggctacatgccctcgccttcatagggttacacgcactcatcatcaaaggtctacacgccctcaccttcaaaagactacacatcctcaccatcagaggactacatgtcctcgccttcgaagagctacacgccctcgtattcagagggctacacaccctcaccttcagaggactacacgtcctcaccttcagaggactacacgtcctcgccatcagagggctacacttcctcgccttcaaacgattgcacgtcctcgtctttagaggattgcacgtccttgccttcagagggctacacaccctcaccttcagaggactggaagtcctcaccttcagagggctacacgccctcgcctttagaggactacatgtcctcgccttcagaatactacat

SEQ ID NO: 54228 - DNA, 138 bp, Glycine max
  Peptide Sequence Number=SeqID_145913
atgtatgatatgccttttagaggcttgaaaactttatctgaagaactcgccaagcgcacttactgcgctaagcgagttcatcctttgaggataaacattcatcctcttgctgaactacctatggctaagcaagggtga

SEQ ID NO: 54229 - DNA, 279 bp, Glycine max
  Peptide Sequence Number=SeqID_145914
atgcatatgacacagatgcaatttatgaatacgagagcccgggaaattgtctcctttgtggaagcaaagcttcatgatgaatcaacaatgattcaaagctcaaaagatcaaagagcaactcaagtaaatcaagaacaagtcaagagttcaagaatcaagaagaattcaagactcaagaagaaagtctacaatcaagattcaagattcaagatctcaagaatcaagatcaagattcaagactcaagattcaagaatgaagaaaagactcaatcaagataa

SEQ ID NO: 54230 - DNA, 300 bp, Glycine max
  Peptide Sequence Number=SeqID_145915
atggctactcccccccgagctctgttttctctgtcttttcttattaaattgtatccatttacaggtggagcggttgagtttggcttgagccatgtctcttggatgagcatcaggattctgcttgaaccaagggttctgtgcaggaggacttgcagtgcggtatgcttcacaaaagcggtaggtaatagggtgtttttggctgcacattggacaacatggttcttttgctgtgcagtcatctatactatgtttttctccgcatcgcccgcagcatgcattgttgtgacagtatttttttag

SEQ ID NO: 54231 - DNA, 368 bp, Glycine max
  Peptide Sequence Number=SeqID_145916
gaaagcttgggaggattgatggggacccggtgttgagagaaacgaagatatgggctacgtgggagtacgtgagctcagttggaggtgggcaacaggggatggtgggtttatgcgcgctttgtggatgtggaaaaacttgttgtgcaccatcacccgaccgccacctagtaccacatgtgatggtggtacctggagatatgccgctggggtcaggagaccttggggacgtcaggcgagctcctgacagtcaacagataaaaggaactaagaccacaaagcaaggaggcttgtgtggtggctggctagctgaggctaagatggtctctggtaatcgattaccaaggggtgtaatcgattaccaggcttga

SEQ ID NO: 54232 - DNA, 56 bp, Glycine max
  Peptide Sequence Number=SeqID_145917
cgtaataactcaccctgggatccactcgaattcgtcaaagaaagagtggatcccag

SEQ ID NO: 54233 - DNA, 192 bp, Glycine max
  Peptide Sequence Number=SeqID_145918
atgtcgttagccaaagaccttggcatccatgtttgcctttcgccctacacggggtctgtacaaaacctcggtgcgaacttcaatactggggcaaggcagccgtaccttggtttatgggatggaggcagtactctagcttccttctcagagaataatgagcggagtgggaagagtcaggtggtcaacatgtga

SEQ ID NO: 54234 - DNA, 657 bp, Glycine max
  Peptide Sequence Number=SeqID_145919
atgacttctatagcccagcctaacacttctagacttgggtttcttgctttgatcaccgcactatgtagagaaagaggggttgtctctaacagccttacttttgagcgcttgagcccggtcattaacttggcctacattaggaagaactgttggaatcccgaggatctaacagtttctatccgaggggctaggagggcaagggctaggccagctgagcttccttccacatctacagctcctactccagcatccacttcaacagctccttctagtttacaggtggtggcgcctccaggatctattccttccattgagcagttcaaggagatggtagcctggcccgggactcaaccttatcttcacagggaagatgaaggtcccacatcccaggtaccacaacatgtggaggatgagtcatctaaggccaccattccagagccatttgatttaggggaggaggcaggtgagacacaggtaagacatgtagttgctgccactcctgagagatctcttgaggccacttcagagcctcctgcaccagtggtggacctaccctcacctcagcatacaacagttccctccactcctattctagaggtaccaaaggaaccaaccacaccagtcctggctatggacacttctcctcctactactcca

SEQ ID NO: 54235 - DNA, 224 bp, Glycine max
  Peptide Sequence Number=SeqID_145920
ggactatcagcgataatgcatcaccaaaagaggaaaactctatgaggattcactgttatcaagcgagtcagagacctagcatgaccacagataaacctccactccctatggctcacatagacccgggtatagggcctaatatctcaacgtgtgtgcaaaggtgtaggtgccatgtgtgcataggaaaaaaaatatttctaactacgaaggtaatagagagatag

SEQ ID NO: 54236 - DNA, 666 bp, Glycine max
  misc_feature (89)..(89): n is a, c, g, or t
  Peptide Sequence Number=SeqID_145921
atgttgtatatctggtttttcgggattcttaccgcagcttctgctgttctaaattatgtgatcccggccagaaccaataaaaaatatgncggcacaaaatggggaagcataggttcagtagtcggaactattgcaggagtatttattggagaacttcttcacgacagtaaggacatggataaggccctgaaatccacaaaaggagcctttatcggattcatatacggtacgggattcagttttgtggggtctaagccatccgcagcaaccaacacaaaagaaaaaacaatgaataaggaaggagacattatttacttcaatgagggagaaaacagattcctcaaagaataccagatgaatgttacttttaccaatatttccgaagacagccgttgtccggaaggcgttaattgcatttgggcaggtgtcgcggtggccaatgtactggttatggggactacaacgagacctgtaacgttaacattagccacaatggataatccgggaagaaactatgtacaatctgcagaatttaatggatataccatctcattaaaagatgttacaccctacccgactgcacaagaaggaacaaaaggacttccgggaaaatacaaaattggaattaccatcaaaaaaacaggcgaaaaaactaccacgaaatag

SEQ ID NO: 54237 - DNA, 527 bp, Glycine max
  Peptide Sequence Number=SeqID_145922
ccagaggaaaagaaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggggtgaaatgccactcgaacccagagctagctggttctccccgaaatgcgttgaggcgcagcagttgactagacatctagggggtcaaggtcggccagtgagacgatgggggataagcttcatcgtcgagagggaaaacagccccggatcaccagctaaggcccctaaatga

SEQ ID NO: 54238 - DNA, 267 bp, Glycine max
  Peptide Sequence Number=SeqID_145923
atgtctaccagtttgtggtggggacatcacaaattcgtctgcagaatccttggaagcagcatctttgtacgagcaggcagcaattatttccttgtttattgtgccatgcacaatgtcaacaactttaacataaaagagatgaagaggtgccctcttaggaacaaagaggataggcttacaggcataagtgtccctcacctgagaagtgcttcacaggcaaatgctcttccagtcattggagtcaatcttgtaggtgggatcctctag

SEQ ID NO: 54239 - DNA, 495 bp, Glycine max
  Peptide Sequence Number=SeqID_145924
atggtgcctaccaggcaccctttggatccagataagtccaacagggccctgggatttcccacactgatcacaggactctgccagtcgttcggagtccccgtggcacctaccaaggtgattcggccgcccatcacccgggcttttattgagaagttcggcacccagagacaggctcaggggggatgctccacaggctgcgggcacgccaccaccacctcatcaggctggcccggctgggcagccaaccaccgagcacatgtgcagacccatgattgtctataccagatgagcctcagcatgcagagccagggcttcgcttctttttcatgccctactccagaccagttcagggcagaggtcgcatggcccggggattggcccgaggcccaagcaggagaggcgcccccggaagttcccgacgatggagaggaggcccacgaggatgaggagatggccgatttgcttgacttcttgggagggagtggagctacatga

SEQ ID NO: 54240 - DNA, 502 bp, Glycine max
  Peptide Sequence Number=SeqID_145925
tcttaagtcttgggatgaagtggttgaaaaattcttgaagaaatacttcccagagtccaagactgctgaaggaaaagctgtcatctcatcctttcatcaatttctagacgagtccttgagtgaggctttggaaagatttcggggaaaaataaaattgaagacccctgaagaagccatggaattgattgagaatatgactgctagtgaccatgcaatcttgcgagatagagcacacatcccaaccaaaagaagcctgttggagctttcatcacaggacgctttgttggtccaaaacaagttggaggttgtgttatatgtggtggagcacatgattctggctgctgcattcccagagaagatacagcacatgaagccacaacaacaagggcctagtctctatgatagaatgaagaagctggaagagacttttgctcagttcatgcaagtatccatgtctaatcaaaagagcacagagttagccattaagaatctagaagtccag

SEQ ID NO: 54241 - DNA, 260 bp, Glycine max
  Peptide Sequence Number=SeqID_145926
caccactcattgagttggtgaggaaccatgttccttcatgggaagatgcccaggaaatgggttttcaaaccttaccttacttcaacttcccaaacaccactaatatgagttttgatgataacaaagatgatgacaaaaagcccaagagaatgagttcaagattgagtcaagaacacttcaagaatcaagagaaatttgatttcaagattcaagaatcaagtttcaagattcaagtttcaagaatcaagaatcaagaataa

SEQ ID NO: 54242 - DNA, 504 bp, Glycine max
  Peptide Sequence Number=SeqID_145927
atggggctccaaaagggtagagaatggagaattgcagctaagcaatcactacgcatggctccaactagtgggtggaggatgcatgaacgaaaacgcagttttcatggggctccaaaaaggggtagagaatggagaattgcactaagcaatcactacgcatggctcaaactcgtgggcggaggatgcatgaacgaaaacgcaattcatggggctccgaaaaagggtagagaatggagaattgcactaagcaatcactatgcatggctccaaactcgtgggcggaggatgcatgaacgaaaaggcaattcatggggctccgaaaaagggggtagagaatggagaattgcactaagcaatcatacgcaggctccaaactcgtgggttggaggatgcatgaacaaaaagctaattcatggggctccgaaaaggggtagagaattggcagaattgcgactaagcaatcacttacgcatggctccaaactcgtgggtggaggatgcatga

SEQ ID NO: 54243 - DNA, 413 bp, Glycine max
  Peptide Sequence Number=SeqID_145928
atggcctgcaggaagcgtaagagcattggggcaaggccaactgctcaatatgacactagacggttccattcgcttgatgcctggaaccgttatacagataacgtcttaggaaggagcaattttccagagaggaaggtagagatataccacacagagtttgatgacttcaagacagagttggagaggcgtaatcttcacaaacacctcaccaacttggctgatgggactattggtgttgctttggtgaaagaattttatgctaatctctatagctctgaggacccttcaccaaagcaagccagagttagaggccacttggtgaggatagacaccgatagcctcaacacatttctagagactcctgtagtcctagaggagggggagacattacccacctactctaggtactgcag

SEQ ID NO: 54244 - DNA, 693 bp, Glycine max
  Peptide Sequence Number=SeqID_145929
atgtctcctccacctctagaacattacaatcactcacaatctcatctcatgctctcaggatggcttcctcttcaagctcagttctctaccagtggcctcattggtgcttgcgcacttagcgcaactctggcttgcttagcgcacatatctcatccttcttccaaattcttcctcgtgctcagccgcatgagtggtgcgcttagccgcaagagtggtgcgctcagcggatggcttgctaagtcgcttggcagatgggtcgacatcgagctcatggttgaagaaattgggattgaggctagcatattggctagagttcttggcttatcttcactgatcgcaatcaacattgctccttggatcatgatcatctacaagtcttcactcaagaatttctttgttaggtggggtattgacatgaatgcttctaatgcattcagggtgggtcagtgggtgatgtccgaaagtaaccaagagtttaatgtatccaagagaggtgacattatgttcaaggaaccctatgaggtcttcctcaagtctttgcacttccttgttggccatgagtgtggacacgaggagagggtcattatggtgaaggattatgtcgacataatcactatcatcaaagcatattggaggatgatcgaggccgtacccgaatcaaataaacatgaaaatgcagtaactaggaagtga

SEQ ID NO: 54245 - DNA, 366 bp, Glycine max
  Peptide Sequence Number=SeqID_145930
atggttaaggaggagtgtaaggaggtaagtgtctcctccaagaggttagctaagaaggaaagtcattttggaataaagacaaacattgaagaagcttcctctcttagacaatctccacatcttctcatttttaaaaagacacttgttagcactgtcacacctcttgggcttgtgattattcctcaactaaaggagttgttggatgatggtttggttcgtattatgaggcaccaaatccctatgaaaggtggtatgatgaatgtgttgagtggtgcaaccctcttttgtaaaatcacccatgcatccaacatcttcatgattcacatacatagggactcattaggtaggggttcccacgaaccctaa

SEQ ID NO: 54246 - DNA, 291 bp, Glycine max
  Peptide Sequence Number=SeqID_145931
atgatgaaagactatgaaaacggagaagagcaaaagcgatacattgataacaatttctccaaacacatggcatacatcaaagtttattcaacaaacaaaggccacttgatcaataagcccaacaattatgtagaaaaacctgaaaattatcctgtcataggaacaaaatgggtttttagaaataaattagatgaacatggcatagtaagaaacaaaacagtgttgctttatccactgctaaagcagaatatatctctgccagcagttgttgtgcacaaattttatggatga

SEQ ID NO: 54247 - DNA, 129 bp, Glycine max
  Peptide Sequence Number=SeqID_145932
atggtcatgacttgtcccttggatgtcctattcggtggaaatgttcgatgggcgtcatccggtgattcttctttgtttgacctcgatcggtcatctctcctggccgacgtcgactgtcattttttttga

SEQ ID NO: 54248 - DNA, 631 bp, Glycine max
  Peptide Sequence Number=SeqID_145933
ggagaggcgtgtccagctcagggaagatgagtactcgaagttccaggaggagatagctcatagacattggacacctctagtgactcccatgcccaagttcgaccctgagatagtcctagagttctacgctaatgcctggcccacagaggagggagtttgggacatgcgctcgtgggtaaggggtcagtggattcccttcgatgcagatgcccttagccagttcttgggtgacccgctgattttggaggaagtccagcagtgtgagttcagccaaaggaggagtcaggccgacggtttcgatgaggaagccatcgcccagctgttgtgcataccaggggaggcgggtgttgatcatgcgcaccagcatgactactttgacccagatatggatgacactgctgctcagcaatgtatggcgcctactaggcaccctctggacccagagaagtcgaacagggccctagggtttcagtctctgatcataggcctctgccagtcctacggagttcgagtcacccccaacaagggtgacacacatcaggctatagacgcaccgccaccacctcggcaggccaatccggctgggccattaggcgtggagcgttatctacagcatttggttcaccagtag

SEQ ID NO: 54249 - DNA, 87 bp, Glycine max
  Peptide Sequence Number=SeqID_145934
atgtctaagaaaggtgctaacaggagttcaaatatggatgcacgtgatcagaaatattttatcacctacatagatgattattcatga

SEQ ID NO: 54250 - DNA, 417 bp, Glycine max
  Peptide Sequence Number=SeqID_145935
atgagtcattcatctagagttaatggcgagggtactagtcataaggaccctctatctagaatcttagatgagttgagttccctcaagttatggaaagaaaaactagaaagaaaagaacaaggaaaagagaggagcctaagtgaagaacttcgtgactattatgaaggaagacataggtcacatcttagacctcactcccattggatagaaaaggaaagaaagcctcaagaggctaacattaacctcccatacttccatgggaatgacaatgtagaggctagcttagattgggaaataagggtagagcaacaacttaaaaggaactctacaaaattttttggctctcactcttatccaaagaaagaccaaggtcaaagcatcttttgggtgacaccttctatgcccaaagatgattag

SEQ ID NO: 54251 - DNA, 885 bp, Glycine max
  Peptide Sequence Number=SeqID_145936
atggggtggttggaataccgaggaaatgtttggaagcaaaagcaagagtcttggcaggcagcgatcgacacttttctcgcctttcatgaccgcaaggaaagcccagttgtcgctatcttagccgatctatatgacaccttcgatcgaagatgtgaaaagaatagtacaaggattgtttgctgtactccggccctctacaaaaaagaggcaagttgggaccgactcttagcaagcaaagaaggagcgtctgccaactggttcccccgatggaaagaaggaagaaccgggattcttatttcgtgcggaggatttccaaatgttcccttgttggggacaaggggttgcatcaattataatcccgttcttgctataagacaacttggctaccctatgagaggggcaccacttgaggaagagctcgcacctattattgcacgaggcttcaataagaccaacgtggaggcacttcagaaggtccgcaaggcgtgtgagatggtgcaaaagaaggacaaagaactcagaggcagtaacaacgggcccatcggcggctaccgtaagtggttgaaagcccacatgcaaggtttggattggctcctgagcttgagaaccactaaaaggaaggaagttaaggcaccggaggaagatgaagaggtgcagacccttagggcagaacttgagcaagcccaaacaatcaaagaaaggttccaatcagcagctctcaagatccgaaaggagaatgccgaactgagagatgtaaatatagctaccaccaaggccttggaacaagagaccaaaagggcttgtagggaagaacatggccagaacaaattccgaggggctctgtggggcattaacaacgagcttaagcttccgaggcacccatcc

SEQ ID NO: 54252 - DNA, 56 bp, Glycine max
  Peptide Sequence Number=SeqID_145937
atggctggtacattcttccttttgaaacaacaaattagttttagagattatgaacg

SEQ ID NO: 54253 - DNA, 360 bp, Glycine max
  Peptide Sequence Number=SeqID_145938
atgggtctattattttacgtaaaatacatgcaaaccgctaatgttactagcgagaagcccctatgtgcaacacgtggcgaaaatgccactgccactggcagaatagcgaatggtctcgctgtttgtgctggcgatatagctatgcagggttccgctagattgactggcgatacagctagtatacgtggcagcagacacactatatttcgccattgcgaatggcgaaatatttttgactatttgccaaacttcgcccaaagttatggactaactcaattcccaaagggttcaatgctcaataacactcaagcgcaatgttcctatgatccaattgcaaataacaagttgcacttgggttga

SEQ ID NO: 54254 - DNA, 459 bp, Glycine max
  Peptide Sequence Number=SeqID_145939
gatctaccatctgtgggggagctcatgaatttggacgttgtatccctattgaagaacaacccactcatgaagtcaattacatgggaaatcagcccataaacaattttgacgcaggaggattttctggattccaacatggccagcaatacaatcaacaacagggacaatggaggaaccaccctggtggaccatccacaaggccacaacaacaagggcctagtctctatgatcgcacaacaaagctggaagagactctagctcagttcatgcaggtttctatgtccaaccagaagggcacagagtctgccataaagaatctggaggtccaagtaggacaacttgcaaagcaactggcggatagatcatcaagcagttttacagctaatacagagaaaaatcccaaggaggagtgtaaagatgtgatgactagaagcataatggcaatccatgtggatgaga

SEQ ID NO: 54255 - DNA, 210 bp, Glycine max
  Peptide Sequence Number=SeqID_145940
atggagtgcctagagggagcttgggagaccctcgaaggcaacatgaggtgccgatttcggggcaccattcgattcacggctacttctttggtgcttccagatgaacctgcacggacgcttcagcgcacgcaaaatagtttagagattatgagcggtaagaaagaaatgactccgaatagagttgtgaactggccattcaggactctgtag

SEQ ID NO: 54256 - DNA, 288 bp, Glycine max
  Peptide Sequence Number=SeqID_145941
gggggcggagcctatggaaaaacggctttgccgcggccctctcacttccctgttaagtatcttcctggcatcttccaggaaatttccgccccgttcccttttttctcttgccacatgaagcacttcactgacaccctcatcagtgccaacatagtaagccagtatacatccgctagcgcccaatacgcaaaccgcctctccccgcgcgttggccgattcattaatgcagttggcacgacaggtttcccgactggaaagcgggcagtgagcgcaacgcaattaatgtga

SEQ ID NO: 54257 - DNA, 512 bp, Glycine max
  Peptide Sequence Number=SeqID_145942
atggggaaaaatcaaaacggcaaaaggttttatcaagtcaaggttaaaagtctagatgtcacctgccttaaggaattgggacgattgatgggacctctccaaaggcaagccttccgcaaagtgtacgggaagattctagatttgactgcagcggaggtatttacggaagctgtcgtatccctcgcccaatactatgaccagccgttgagcaagattgcagctgtggttggagattcggcaaaagagatggatcgcatgaagcaaactcggaacggcgtagtgggcctgcctcagaaatacttggaaggcaaggtaagggatatggcgagccaagagaagtggggcccgtttgcggatatattagctttgttgatttttggggttgtcctctttccgaacgttgatggtttggtggacttagccgccattgacactttcctcgcatatcaccatagcaaggagagtccagtggtggctatcttggcagatttgtttgacacctttgaccggag

SEQ ID NO: 54258 - DNA, 561 bp, Glycine max
  Peptide Sequence Number=SeqID_145943
atggacaaagctccaccaattaaaacaacgcatggtatgcatgagaggaaaacaagagtgagacaccattctcttacaaagccaatcacaaagccaccaataaaagttgaagcgagttgtaaaacttcccaacctgtcattatatataagtttttaaatcataaggtacaagctagatcggtgagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 54259 - DNA, 904 bp, Glycine max
  Peptide Sequence Number=SeqID_145944
ggtggacccttgggtacttgtacctatcacttttagaggactacacgtcctcgccaacagagggctgcacgccctcaccttcagaggactacatgtcctcgccttgacagggctacacgccctcatcttgggactacacgtcctcaccatcagagggctgcacgccctcacctctagaggactacatgtcctcgccttgagagggctacacgccctcaccttggagggctacacgtcctcaccttgggtactagttaccctcaccgtcagagggctacacgccctcaccttgaaaggactacacgtcctcgccagcagagggctgcacgccctcacctccagaggactacacctcctcgccttgagagggctgcacgccctcacctttagagggctacgtgtcctcattttcagggccagtagtttccttttaacggttcctgggccaccccctgatattggaggagggccaactgtgcgagcacaaccagagagggaggctatcacacagctactatgcataccggggcaagatttcacccgtgcctgcaaagagacgaggatcgcacccacaagacacccagtggacccggaaaagtccaacagggccctggggtttccagctctggttacgggcctctatcagtcctacagggtgcccgtacccccccggcaaggtcacgtcatcatagggatcgcgcctgcaagacacccagtggacccgaagaagtccaacagggtcttggagttgtcaagctctaaatacgggtctctatcagttcaagggagtgcctgttgcccccagcagggtcatcaggccccctaccaatcgagttttcatctagaagtgttgcgcccccaggcaggcgcagggcgagacaccacagcagcattgggatggacg

SEQ ID NO: 54260 - DNA, 1064 bp, Glycine max
  Peptide Sequence Number=SeqID_145945
gcgcggcgctggggaggtatccggtcacgacgttccagccgacgcggccctgcgtgaggtggtcgagcgtgctgagtcgtcgcgcgaaggggtaggggtgctcgaacgcggtgccggccgtgatgccgaagcccaggttctcggtcacggcggccatcgcgctgaccagcaggatcgggtcgttcacgggcacctgggcgccgttgcggatcgcggcctcgttggtgccgccgtacacgtcgtaggtaccaaggacgtccgcgatgaagacaccgtcgaacgtcgcgctttccagcagcttcgccaggtccgtccagtacgagatggtgttgtactggcgcgagcggtcgtcggggtgccgccacaggccggacgactggtgggcgacgcagttcatgtcgaacgcgttgaagcggatctgacgggcgggctcgtcctggcgccgcgggctcgggtcgggagggaggatctcgatgtcgtggtcggccgtgcgctgtgcccgccaccagatcacgaagccgaccgcggtgaagacgccgtagaacaggtacatcagcccggtggcgtaatagccggagctgaacagcagggggattccgaccgcgtcgacggcgatccagatcaaccagaactccgtccaccccctggccatcccgtacgtggcgaggagcgagccgacgaacgtccacgcgtcagcccacaccggctcccacgagccgagcgcgcggaacacgggcgtcagcgcgacggtgccgacgatcagcacgaggaccatgccgatgcgtgcgctcgtcggcgcccaccgcggcaccacgcgtccgccctccgcgtgccgccagcggatccatccgtagatcgccacggcgatgaacatgatctgccggccggcctggcccagcagatgaggcagcgacgggtcggggctcagggcggagccgaggaacacggtgagcagcagcaggttgccgacgatgccgaccggccacgcccacaccttgcgccgcataccgccgagcgcactcgccagcccgaatgcgttgccgacgacttcgcggacgaggagc

SEQ ID NO: 54261 - DNA, 60 bp, Glycine max
  Peptide Sequence Number=SeqID_145946
atggttcaaggcaaatttttcccaaatttgggggaggtattatcaaggtatgaaagctaa

SEQ ID NO: 54262 - DNA, 1341 bp, Glycine max
  Peptide Sequence Number=SeqID_145947
atgatcggccctctcaatgactcaatctcttgctttctcataagggtggacccttgggtactagtacctattgccttccgaggactacacgtcctcgccttcagagggttacacgcccttgccttgcctttagaggactacatggctgcatgccctcggcttcagagggtagcacgccctcgccttcagagggctacacgtcttcgcctcagaggaccacacgtcctcgccttcagagggctgcacgcactcttctttagagggctacacgtcgtcgcctttagaggactacatgtcgtcgccttcagaggactgcacgtcctcgcctttagagggctgcatgccctcgcctttagaggactacacgtcctcaccttcagagggcagcacgccctcgccttcagagggccaaatgccctcacctttagaggaccaaacgcccttgccttcagaggactacacgtcctcgccttcagacgactacacgtcatcgccttcagatggctaccctcccatgccttcagaggactacgcgtcctcgccttaagagggctacacgccctcgccttcaaagggctacacgtcctcgccttcagaggactacatgtcttcgccttcagaggacaacacgtcctccccttcagagggctacacgccctcaccttcaaaggactacacatcctcaccttcagaggactacacgtcctcaccttcgaagggctatacgcccttgccttcagaggactgcacgacctcgccttcagagaactacacatccccgccttaagagggctacacgtcctcgttttcagagggctgctagccctcgccttaagaggactccatgtcttcgccatcagagggctacacgtcctcaccttcagagggcaacaccacctcgcgttaagagaactacacatcctaaccttcagaggggccctcgccttcagagggttgcacgccctcgccttcagagggctacatgccctcgccttcagaggactccgcgtcctcgccttcagagggctgcatggcctcgcgttcagaggactacacgtcctcgccttcagaagtcttcacgtcctcaccttcagagggctgcacgccctcaccttcaggggccacacgccctcgccttcagagaactacacttcctcgccttcagaggactacatgtcatcgccttcagagggctacacgccttctccttcagagggctacacgccctcgctttcagagggctacatgccctcgccttcagtggactgcacgtcctcaccctcagagggctacacgtccttgccatcaaaggactccacgtcctcgctttcagagggctag

SEQ ID NO: 54263 - DNA, 156 bp, Glycine max
  Peptide Sequence Number=SeqID_145948
atgggaagtgattctccgtcacagtggcttctgtttgtatcagctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 54264 - DNA, 370 bp, Glycine max
  Peptide Sequence Number=SeqID_145949
agctctcagccacatggatagtttaatgtgctcatcggcgcctgaccctgagatgtggatcatccaaggcacattagcatggcgtacttctcctgtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctgggggaccaggagattggatctagccataagaagaatagaatgcttggctga

SEQ ID NO: 54265 - DNA, 417 bp, Glycine max
  Peptide Sequence Number=SeqID_145950
atgtccaaatcttgtggatttgggatgaccggccctctcgatgagtcgatctcttgctttctcataagggtggacccttgggtacttgtacctatcacttttagaggactacacgtcctcgccaacagagggctgcacgccctcaccttcagaggactacatgtcctcgccttgagaggactacacgtcctcaccatcagagggccgcacgccctcacctccagaggactacatgtcctcgccttgagagggctacacgccctcaccttgggtactagttaccctcaccagaggactacacgtcctcgccttgagaggactacacgtcctcaccatcagagggctgcacgccctcacctccagaggactacatgtcctcgccttgagagggctacacgccctcaccttgggtactag

SEQ ID NO: 54266 - DNA, 336 bp, Glycine max
  Peptide Sequence Number=SeqID_145951
atgaatgccttagaaatttactcgaatagagtaaaaaggcaattagacagaaaggtgaaagttgttaggtttgatagaggtggtgagtattatggaagatacgatgaaaatgggcaacatccagaaaagtcaaaggggtatatgttttattattctaatcataatatgagaagtgttgaaactggaaatgcaaggttcattgaaaatagtgaaattagtgggactacaattccacgagatgtgaaaactatctttcttaatggagatttagaggaaagtgcttatatggaccaaccaatagggttctcagttgaaggaaaggaacacatggtgtga

SEQ ID NO: 54267 - DNA, 327 bp, Glycine max
  Peptide Sequence Number=SeqID_145952
atgaacaacaaagctagtataaacaacagatggaaatttgtgtggttagctctatccttcttcgtctggcatcatagaaatgctatgattttcaagaaccacccgtttgatcctgaaaagagaaggactacaccagggactacaccatccatatgtagcagttgcatgtggaggtcaacaccaggttgtctcatgaacgacaactccattagccatcttccggcggtcaatgacatggtgtgcatgcaacgggactcgagaaatttgaacaccttgcaatacatgttctgggggtggtcgggtaaggacataaaaaggcggagatga

SEQ ID NO: 54268 - DNA, 307 bp, Glycine max
  Peptide Sequence Number=SeqID_145953
atggtgaaagttggaacctcttacgtgccgatcaacgtctcattttcgccaaaagttggcccagggcttcccggtatcaacagggacaccaggatttatttattctgcgaagtgatcttccgtcacagtggcttcttgtttctatcagctgtccctccctgttcagctactgacgggggtgggcgcgtcccattcgccattcaggctgcgcaactgttgggaagggcgatcggtgcgggcctcttcgctattacgccagctggcgaaagggggatgtgctgcaaggcgattaagttgggtaacgcca

SEQ ID NO: 54269 - DNA, 213 bp, Glycine max
  Peptide Sequence Number=SeqID_145954
atgggtgccaagcacctcacaaggaccaaagcagggcgcatgtcatcaagcaaagggtgcagaatgaccaaatttggtctctgcttgtcatcgggcccgttgcctctggatgacaaaaagggtgcggataaccgtaagggtgcggataaccgtaagggtgcggataaccgtaaggtatctccgcgtatcatcgggcccgccgcctctggatga

SEQ ID NO: 54270 - DNA, 462 bp, Glycine max
  Peptide Sequence Number=SeqID_145955
atgcaagagaagactagctccatgaagtgctttaaatgtcttggaagaggacacattacttctcaatgccccaccaagaaaaccatgattatgaggggccaagacatttatagtagccaagatgaggctactacttcaccttcctctagtaaaagtgaagaagcaaaaggggaagaatctagtgaagagatgtacccccaagaagaaggacaacctttaatggttaaggaggagtgtaaggaggcaccaatccctaaaataggtggtgtgatgaatgctttgggtggtgcaacactcttttgtaaaatcactcgtgcacccaacatcttcatgatttgtgtacatagggactcattaggggttcccatgaaccctaagagaataaaggtcattcctgagtggcccgctccaccaagtgtgttgagggaaaaagcccagagtttcaagaacctcgggatttga

SEQ ID NO: 54271 - DNA, 288 bp, Glycine max
  Peptide Sequence Number=SeqID_145956
atggatgacatggggttgaatcaatttagattttgcaacatggtccatgacatcttggtcaaggtgaaactggaagtaacaaggacatcaacggtcctaaatgtgcttggcagtagacaaagcagtgatgtaacacgattcatcttttgccccaatttttgcaagatggttacttccatacttcaccttgacttggtgaacttttttcgaaaaagcatgagcttagttcaaccccataacccagggaatggcaattttgatcgccaatacttcaacaacctttcatag

SEQ ID NO: 54272 - DNA, 180 bp, Glycine max
  Peptide Sequence Number=SeqID_145957
atgactatatcaagctctttggtgagcacagacaaattcaaggaattaaggaagtccctacttgttgatgagttatccatgatatgttactatggaaagtggatggatataacgagaatgggaatatcattgcatcaaggtataaaatccttgtatcgttgtccctacaacaaagcatga

SEQ ID NO: 54273 - DNA, 117 bp, Glycine max
  Peptide Sequence Number=SeqID_145958
atgcatagctcaaaactcgaaggtggaggacacatgacgaaacgcaattcatggggctccgaaaaggttgagaatggagattgcctaagcatcactacgcatagctccaaactcgag

SEQ ID NO: 54274 - DNA, 1221 bp, Glycine max
  Peptide Sequence Number=SeqID_145959
atggaactgaggaagcctggagtggagaagtctcaccagacggacatcggtgtgctccccgtgtcttgggaggttcgcacgcttggcagcatttctacgctgctgaacggcagggcttatggtctggccgaatgggagcaatctggaacgcctgtgatccgactgcaaaacctgactgggggcgaagattactactattcgaatctcagattggcagccgaaaagtactgtttccgcggagacctactgtatatgtggtctgcaacgttcggtccacacatttggcaaggcggcagggctatttatcattaccacatctggaaggttgtgccaaagcccaattgcagcgaccggatttttgtgtatgacaagctaagcgagatcactgctctcaagaaggcaacatcgactaatggtggaacgatgctccatctcacaaaacgggagatggaatcaacactagttgccgtgcctcctctaccggaacaagaagctatcgccgaagcgctctcggatgcggacactctgatcgaatccttgtctttcctgctggcaaagaagcgcaagataaagcaaggtgcgatgcaagagttgcttaccggcaagacgcggctgcctgggtttcaggctccgtgggcacggactcagcttgggaagcttctttcagtgcggcatgggcgcaaccaacggttggttcaatatgacgatggcccatatccgatcttggctacgggaggccaaatcggttgggcaaaccgatttctgcatgacaagccctccgtactgattgggcgaaagggtacgatagacgagcctcagttcatggatacgcctttctggacggtggatacactcttctacactgacattcatccgccgaatgtcgcaaagttcttgttctacaggctttgtttggtgcattggatgcgtcacaacgaggcgtcaggcgtgcccagcttaagcgccaaggtcatcgagtcgatcgaaattgagcatcctgatgcggacgaacagcaggcgatcgctgatgtgctttcaactatggatgcggagatcgaaagtgcggaagctaggcttcagaaggctcgccggctgaagcaaggtatgatgcaagcgctgctgaccggtcgcattcgcctggctcagcctgcgtttgatgctgttccgcttctcaccgatctagctgtccactcaccctccattcactccgaccccaactag

SEQ ID NO: 54275 - DNA, 682 bp, Glycine max
  Peptide Sequence Number=SeqID_145960
atggctccgagaaagctttccgcaaagagatctaggaaggacgtcacgactgaagggaccagtgccgctcccgagtttgacagccatcgtttcaggagcgctgagcaccaacagcgtttcgaggccatcaaaggatggtcattccaccgagagagacacgtccagctcagggacgatgagtacacagatttccaggaagagatagctcaccggcgttggacgtcgctggtcactcccatggccaagtttgatccggatatagttctagagttttacgccaatgcttggcccacagaggagggtgtgcgggacatgcggtcatgggagtgcgagtctagtcagagaaggaatcgggctgatggatttgacgaggaggccattgcccagctgttatgcataccggatcatgcgcaccaacatgaccaccttgactcagatgtggatgacgttgctgctcagcaacgcatgccacctaccaggcaccctctagacccagataagtctaacagggccctgggatttccagcgttgatcacgggtctctgccagtcattcggggttcccgtcacacctagtaaggtgattcgaccgccgatcacacgggccttcattgataagtattgcacgcctagacaggcgcagggtgatgcaccgcaggccgcagacacaccaccaccacctc

SEQ ID NO: 54276 - DNA, 489 bp, Glycine max
  Peptide Sequence Number=SeqID_145961
attttttcggttcacggcgttcgcggcgaggtgaaggtgtattcctttaccgatccgattgaaaacctgttggattatccgcgctggacgcttcggcacgaaggcaaggtaaagcaggtcgagctggtcaacggtcgtggctcccaaaagggcctggtcgtgaaactgaaaggcctcgatgaccgtgatgaagcccgtcttctgagtggttacgaaatctgcattccgcggagccttttgcccagcctggcggccgacgagtactactggtaccagttggtaggcctgaaggtcatcaaccaggacgaacagctgttcggcaaggtcgatcacctgctggagaccggtgcgaacgatgtcatggtggtcaagccctgcgcaggcagcctggatgatcgcgagcgtctgttgccctatacggcgcaatgcgtgctcgatatcgacctggaagcaggcgtgatgcgggttgagtgggacgcggacttctag

SEQ ID NO: 54277 - DNA, 638 bp, Glycine max
  Peptide Sequence Number=SeqID_145962
gcgtggaatgagacaaacgcggcccataacagcggaatgacaccggtaaaccgaaaggcaggaacaggagagcgcacgagggagccgccagggggaaacgctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcgtaagccatgcgctcgccgcagtcgaacgaccgagcgtagcgagtcagtgcagcccgggaggaatttccactagttctgagctggccgccaccgcgcagcgtgccgctacacttgccagcgctgatgcttccggcggaggaacagctgatagaaacatgaagccaggagcactcgaaattaaccctcatacactaggaatcataaagctggtcggccatccccgagcgcacggtatcgatagcttgcccgaatataaaatcaaatacaatgcgtacaaactcacttcgcagaaaaataaatccggtgccatgttgataccgggaagccctgggccaacttttggcgaaatccatgagacgttgatcggcac

SEQ ID NO: 54278 - DNA, 243 bp, Glycine max
  Peptide Sequence Number=SeqID_145963
atgtttcttgatttcagggttgtcatcatcaaaaagggggagattgtggaagcaatgtcttccaaggttattttgatgatgccaaagaatcaagagttaagaaaagtttcaagcaaagattcaagaatcaagtttcaagtttcaagtttcaagattcaagattcaagaatcaagtttcaagattcaagaatcaagtttcaaagatcaagattcaagaatcaagacaagcctcaatcaagataa

SEQ ID NO: 54279 - DNA, 597 bp, Glycine max
  Peptide Sequence Number=SeqID_145964
atgggatcaagtcaaaagccttcgcttaaaaagaggttttatcaagtcaaaatcaagagcttagaggtcaccagtttacgaaagttggggcaattaatgggtcaacttcaatggcaagccttccgcaaagcctatgaccatcaaaagcaagtcgaaaatggggtggtcgggataccgagaaaatgtttggaggcaaaagcaagaatcttggctggtagaaacgaatgggccccgttcatagacgttctcgcactgttgatctttggaggagtcctcttttcgaatatggatgggttggtggacctggcagcgatcgacgcttttctcgcctatcataaccacaaggaaagcccggttgtcgctatgctagccgacctatatgacacgttcgaccggggatgcccgtctatccgctataaggtcaccgctcgtgcgtcgaaaaaggaaggaagaatcaggattgtatcttcatgcgaaggatgtcccatgagaggagtgccatcagacgaaagcatcacgcctttcatcgcacggggtttcagtgaccacaacgcgagggtactccaaggagttcgcaaggcatgggatgcggcgtga

SEQ ID NO: 54280 - DNA, 99 bp, Glycine max
  Peptide Sequence Number=SeqID_145965
atggaccctaagagaataaaggtcattcctgagtggcctacaccaccaagtgttgaggaaacaatccttgagtttcaagaacctctggatttgaggtaa

SEQ ID NO: 54281 - DNA, 255 bp, Glycine max
  Peptide Sequence Number=SeqID_145966
atggccatgagccatgggtgcctgtatcaacaaaggaaaaagaacgcgttcgacaaaaagggattcatgtccgttgtaattgtctcgtcacagttctttaaaagaagagaacacgggtctgaggcttcaatcctcactttggtacttatgaacggacgcaaggagaggctagggtcacgaccaataggtcgtcatcctttgcctagctcgggacaaacagaaagcgctgctgcaaagcagcctagtatcctttaa

SEQ ID NO: 54282 - DNA, 306 bp, Glycine max
  Peptide Sequence Number=SeqID_145967
atgagtgatctaaaaagcattggtgagttcttttctcgaatcttggcaattacaaatcagatgagtgcttatggtgacaagcaattagacttagggatcattgacaaactgttaagaaccttgacaccaagattcgatcatatagtttatgtcaaagtctgtgcctatgtccagtactcaagcaacccacttgagattttccactccctttgtaaaaatccgtttacaaagtctgaaccatacagggataactcgatcccttgtgttcaggaatccttacaacttaagagatcctcagtcccttaa

SEQ ID NO: 54283 - DNA, 760 bp, Glycine max
  Peptide Sequence Number=SeqID_145968
atgtcttggtctgcttccgtggagttatggtttctcggccaaggatatcatgatcacttggaaaagggagttgatgctgttccgaatgacaagagagctgaatgggagaagctggattttcagttgtgtgcagtgctatggcaatctgttgaaccggatgttttggagatccttagatcattcaaaacatgttgcttcttttggaaaaaggcacaagagatatttgccaatgacattcaaagtttgtttgatacaacccagaaagttgctgctctcaaacaaaccaaccatgatatgattgcgcatgtaggtgaccaagtcccgtcaatggactccctcattactagacttcttcatgtgcctcaagctttgaaagaagaaaatttagctaaagttgtggaaacatcagccacggctgcatcttgtggaagaggaggaggtcgcaacaatagaggaggccgtggtggaaggagtggacgccctcaatgcacatattgcaagaggatgggtcacacacaagaaaactgttattccttacacggttttcctgacaaggtagctcatgtttctaaaatagaaaaatcagagtctaaattttctgatgagaaataccaggagtatctacggctcaagtctacaaaagccgacaatcaagcacaatcttcctcagtaccatatgtttcatcagcatgtatttctcaatctgtgaaagactctagtccttggatacttgattcaggtgcttctgatcatatctctg

SEQ ID NO: 54284 - DNA, 141 bp, Glycine max
  Peptide Sequence Number=SeqID_145969
atggcctctggtaatcgattaccaattgggtgtaatcgattacataggatcgcgatggcagtgcagttgatccatgatcgcgtggtgatggagtgcctagagggagtttgggagaccctcgaaggcaatgagaggtgctga

SEQ ID NO: 54285 - DNA, 450 bp, Glycine max
  Peptide Sequence Number=SeqID_145970
atgaccactcttacgtggatatggatgacgttgctatttagcaacattctgccctgcaaccacaatgccaatctccccctgcagatgtatcagttggaatcgcacccacaaagacacccagtggacccggagaagtccaacagggccctagggtttccagctctggttacgggcctctgtagtcctacagggtgcccgttcccccggcaagggatcgcgcccgcaggacacctagtggacccgaagaagtccaacaggttctacggagtgtctgtcgcccccagcaagatcatcaggccccctactaatcgagctttcatcaagaagtactacgtccccaggcaggcgcagggcaaaacaccacagcagcctggggatggccggcagcggtcaacagaagcaccgcagtcacctctagagttcacttcagctcatcgacaaaaaggttag

SEQ ID NO: 54286 - DNA, 280 bp, Glycine max
  Peptide Sequence Number=SeqID_145971
atggaaaaattcgacaagaaaaatttcaatgataagaataaaaagaaagcatatatcacttgggaagataatgagagggattcatcaagtgattcagaaaatgaaatcctaaacctaagcctcatggccaaagactatgaaatcgaagaagaggaatccttgaagcaaagttggtacgttgatagcagttgctccaaacacatgacaggagatgcatcaaagtttattcatatttcttccaaaaatagtggacatgtgacctatgaaaacaacaacaaag

SEQ ID NO: 54287 - DNA, 228 bp, Glycine max
  Peptide Sequence Number=SeqID_145972
atgggctcgtttgcccctggttgcacgaaaggtgcgggacgacaaaaggtgcagaagatgatgttagtcttcaagcgtcacgggctcatttgctcgtttgccctatggttgacgaacggtgcgggtaaccataaggtcaggacaacaaaaggtgcagagacgatgttagtcttcaagcgtcaacgggctcatttgccctatttgacgaaatttgcgggtaaccataag

SEQ ID NO: 54288 - DNA, 264 bp, Glycine max
  Peptide Sequence Number=SeqID_145973
ggtacatcctttgtggcacaagtagagggtacatctacttaggtttgactgagaacaagagagggtacatctcttatggatcagttctagtggagggtacatccactaggttcaaagagaacaagggagggaacaggttattccaagatcatgatgaagaccaattcaatctgtgtctcatgacaaaatctgatgagaataacaaagaagattctgtaaggaagaaatggtacatagacagtggatgttccaagcacatgacgg

SEQ ID NO: 54289 - DNA, 228 bp, Glycine max
  Peptide Sequence Number=SeqID_145974
atggttggctcatggtacctaacacataggaaaacgcaaggatcatgcatgaaaataaaagttaagaaggtgatatggaccttccggcttcccgtgacaaaagacgagaccaacatacaatgcatgcgtgacgacatgatgcagacgcgcaaaagcgcaacatggggatgtacacagtatggaaatatccccaaagaatcatacaacaaaggcatacatgacatttag

SEQ ID NO: 54290 - DNA, 750 bp, Glycine max
  Peptide Sequence Number=SeqID_145975
atggcgcggctcaacagagcagccgcaccgtcctacctatttaaatctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaaacccacagggggatcccaccaatcagcttccttgcgccttacgggtttactcgcccgttgactcgcacacatgtcagactccttggtccgtgtttccaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcacctccttttcatctttccctcgcggtacttgttcgctatcggtctctcgccagtatttagccttggacggaatttaccgcccgattggggctgcattcccaaacaacccgactcgccgacagcgcctcgtggggacttgggcccggtccgccactgaggacgcttctccagactacaattcggacgccgagggcgaccgattttcatggtgggcttttcccggttcgctcgccgttact

SEQ ID NO: 54291 - DNA, 746 bp, Glycine max
  Peptide Sequence Number=SeqID_145976
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaacttataagctagtcaaaggaacttctaagctcctcaaagccttacatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 54292 - DNA, 531 bp, Glycine max
  Peptide Sequence Number=SeqID_145977
atggaaaattattggtgggagcaagagttacacccttataatcaatatgaagaaaaaagactttctaatcttgagaatgtgttgatgcaattcatgaaaacatctgaagctaacttcaaagtcaatcaaaacgcaattcaaaatctggagattgaggttgtcacaagagaagaaaactttgaagaggttaaagctcatgaggagagtcttgtagaagagcatgattcaagagaaaaagatgaagaaaaaggtgaggagagaacacaacaacaatgggagaagaattcacaagtaaaaattcaacaagaaaacattctccaagtcaatatccctcctcatcaactgattggcaaggaagaaaggcatgtggaatgcgataaatctttaagtgtcattctctccttgaacaccaacacttctcccgcaatggtatggaaggcgtttttgagatacatgagtttcatggagtctctagctaataagcaaaaatgcaaagaaaatgtgttctatgtgacattcatgtcaccttaa

SEQ ID NO: 54293 - DNA, 124 bp, Glycine max
  Peptide Sequence Number=SeqID_145978
ggcggggatggaaaaaccccatcatcatgcctacttgaatagtagtggctctgctattcaagagacacagggttaccactgctcaaggcttgtcagaaccatttgcactgtggggatcctctag

SEQ ID NO: 54294 - DNA, 276 bp, Glycine max
  Peptide Sequence Number=SeqID_145979
atggtgaaagttggaacctcttacgtgccgatcaaacgtctcattttcgccaaaagttggcccagggcttcccggtatcaacagggacaccaggatttatttattctgcgaagtgatcttccgtcacaggtgctccagtggcttctgtttctatcagctgtccctcctgttcagcttctgacggggtggtgcgtaacggcaaaagcaccgccggtcatcagcgctggcaagtgtagcggacacgctgcgcgtagccaccacacccgccgcgcttaa

SEQ ID NO: 54295 - DNA, 317 bp, Glycine max
  Peptide Sequence Number=SeqID_145980
gattcctgaacacaagggatgggttgtccctgtgtggttcagactttgtaatggattttacaaagatagtggaaatctcaatcattttcaaattccgcttaatgatgagccatttgttcaagtcaagtgttcctttgctattggtgctggtgctgtgacttcctttggttaccgtaaggatcggaatggtcaatggctgaagaaagacgcactccctcctcaagatgagcgtactccttcacctcctcttcagcgtgaagattcagcactcctgaatgaagtccttaccgaattacgaggtcttcgttcttatgttg

SEQ ID NO: 54296 - DNA, 255 bp, Glycine max
  Peptide Sequence Number=SeqID_145981
atggcacgcagagacaagttatggatattctgcgacatttgtgatctagaggcgacgagcccgatgacaccgtgcccttttgcgggcaagcaaagcgaggctcacgggtgcgttttccaaaggaggaaagatgcgcagagtcgccaccaacgtttatttgtggaaaacatcagaaaaaccgaaggaaaccggtcggcaaaagcgggctcttgctcctacgtaccctccatcgaagaggaaatcagacctacgtag

SEQ ID NO: 54297 - DNA, 579 bp, Glycine max
  Peptide Sequence Number=SeqID_145982
atggctgcaagtgacattgctattctcagagatagagcccacgcaccaaacaaagaaaagtcttctggaacttacatcgcaagatacgctgttgcagggtgtgccatctgtggtggagctcacaatttggctgttgtatccccaatgaagaaccagctcatgaacatgcccagccatataattcacaacagggacagtggaggaatcaccctggaaaccagttcaacaaagaccagggtggtttcaatgtttaaccataagagcacagagtcagccattaagaatttggaagtccaagtgggacagctggcaaaacagttggcagataagttatcaagcagctttagtgctaacattgagaagaatccaaaggaagaatgtaaagatgtaatgacaaggagcagaatggcaattcagcttgatgaaggtagagctgaagagaaggcggagggacataaacaacagtcggcagctaagccggcactagaaccagtttttgattttgttgaacttgaggaagttgtggaagatgaagatgaccaacaggagagagagagagacaccaataaaagaaagtga

SEQ ID NO: 54298 - DNA, 624 bp, Glycine max
  Peptide Sequence Number=SeqID_145983
atgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggaggtaagtgtctcctccaagaggttagctaagaaagaaagacattttgaaataaagacaaatattaaagaaatttcccttcttagacaacctccacattttctcctttgtaaaaagacacttcttagcattgccacatctcttaggcttgagtttaatcctcaagtaaaggagttgttggatgagggtttggttcgcaagagattaaatccttgtgctttgttggtgcccaaaataggtattattaggcaccaaatccctaaaataggtggtgtgatgaatgctttgggtggtgcaacactcttttgtaaaatcactcgtgcacccaacatcttcatgatttgtgtacatagggactcattaggggttcccatgaaccctaagagaataaaggtcattcctgagtggcccgctccaccaagtgtgttgaggaaaaaagcccagagtttcaagaacctcaggatttga

SEQ ID NO: 54299 - DNA, 103 bp, Glycine max
  Peptide Sequence Number=SeqID_145984
gttatcaaaaaggatctcgaacttaatgatttggatagaagtatggttgaaggtctgcgtattttgaaaatgagagtttgggagttgtttacgcacaggaaag

SEQ ID NO: 54300 - DNA, 213 bp, Glycine max
  Peptide Sequence Number=SeqID_145985
atgccgatctccccctgtggaagtatcagttggtctgtgtcgttccgacatagggatcgtgcccacaagacacccagtggacccagagaagtccaacagggccctcgggtttccaactctggttacgcgcctctatcagtcctacagggtgcccgttccccccagcaaagtcacgccatcatgacaaaggtaagtatgcacatcgctcaatag

SEQ ID NO: 54301 - DNA, 198 bp, Glycine max
  Peptide Sequence Number=SeqID_145986
atgaaacgacatgagtttctgtgggagccttacatagcaactgttttgtcgatgttgcctcccatttgtttggttggtagtgtggcgtggtgcgcagtggtgccactcatttgtttccatgttgtagagtggcaccaacccgatagagtgttgcgacaatttgaaatgcaacaacctattccggagtctccttcgtaa

SEQ ID NO: 54302 - DNA, 228 bp, Glycine max
  Peptide Sequence Number=SeqID_145987
atgagggagaattacacagtacttcttgggattacaatgactcaagaaactcaagagaaggaagcatatgaagattctcaagatcaatggcaagttagactgcaaggaataatgaacttcaaaagatttgggatggaaagctgcaagaacacatcacaccgatcgagcactagctgttacttagataaagatgaatctagtcaatatatagacatgaaacagtatcgg

SEQ ID NO: 54303 - DNA, 336 bp, Glycine max
  Peptide Sequence Number=SeqID_145988
atgtggagataccttatggttatccacaccttttgtcaaccagaggcaagcgagcccattgacacgcagagactaacttcttgtcaccagagtctgcatccttttgtcaaccagagagatggcgagtctgatgacatgcaggagataccttataggttatcagcactttttgtcaaccagaggcaaggaagcccattgacacgagagactaacgtcgtcatctgcacctttgtcatccagagacggcgaagtccggtgacatacgaagataccttatggttatccacaccttttttcagaccagaggcaagcgagccgttgacacgtagatactaa

SEQ ID NO: 54304 - DNA, 540 bp, Glycine max
  Peptide Sequence Number=SeqID_145989
atgggtgaagtagaggaggtgcaagagcaaatgaaggccgacatggaggccatgaaagagcaaatggccacaatgatggaggccatgataagcataaagaagataatggaagccaatgcgattgcagttatcgtagctctgttgctaagccaacaacctcaatttgatcatgcacatgtctctcgacccatgggggagacacatgaaattccccaccaaaatctagccgacttcaacccttgcctcggatatgccactaaagggcaagcagttggtagtatacccctgcaaaacactttagagggccctcaatttcgcccccaaccacaaccctcttgcattccacagcaggaaaggctcaggaccattgaaggaggtgaagattgtgccttttctaacctagaagagttgttcctagtacccaatatcatcacccgtcccaagttcaaggtgtcggcctttgacaagtacaaggggactacttgcctcaagattattgtcgaaagatggaggcatatgcaaaagatgagaaactactga

SEQ ID NO: 54305 - DNA, 69 bp, Glycine max
  Peptide Sequence Number=SeqID_145990
atggcgactccgcgcatctttcctcctttgaaaagcgcacccgctaagttcaacaagagggatctgtga

SEQ ID NO: 54306 - DNA, 459 bp, Glycine max
  Peptide Sequence Number=SeqID_145991
atggataacgaagagggagtgcaagaacagatgaaggccgacctatcagccttaaaagatcaaatggcttctatcacggaggccatgctgaagcttcaaaaaactatagaagataatgctacggcggccgcttccaatacagctagggaagcggaaccggtgctacagcctgcaataaacttgggccgagatagaaacacgacggttttcggtcggaggtatagtcctcaagcctacccttatggtttgcctccggatttcactccccgtaccgctccagatgatttgagccaagcccctaccttcgaggggcaactccctcctcatgccgacattcctctgcaagaagatgatgaaggagatgcccatttaggccctctacttcccctcaaggatccgaccccccatgagttgccccaaccaaacatagtccgccacgtcccgtctccacccgcaccc

SEQ ID NO: 54307 - DNA, 210 bp, Glycine max
  Peptide Sequence Number=SeqID_145992
atgcgcttgccgtcgcctggcttaaggcacatccgcacaagtctgctgggtgaattatacggcctggcaggaaagcgacaatttcatcgccctccgcagcgttactcgccgaagccgttcggccacgccttcatttcgtcaagggcggttacgcggccgacgcgcactggtcgaaggtgcagctattcgaacatctcgctatatcgatga

SEQ ID NO: 54308 - DNA, 485 bp, Glycine max
  Peptide Sequence Number=SeqID_145993
acttggctttggtgaaagatttctatgcaaacttatacagctctaagggaccttcaccaaagcactatagagttagaggccatttagtgaagattgatgctgacagtctcaacacattcttggagacacctgtggtattggcagaaggcagagggttcatcttgaacactgagggctatcttgggaagattctcaggaaggatttgactactctagctcagtctaacacttctagacttgggtttcctgctctgatcaccgcattatttagagccagaggggttgtctttgatagccttacttttgagtgccttagcccggtcattaacttggccaacatcaagaagaactgttgcaatcccgaggatctaacagtttctatccaaggggctaagagggcgagggaaaggccagctgagcttccttccacttctgcagctcctactccagcatccacttcagcagctccttttgtcccagcttag

SEQ ID NO: 54309 - DNA, 282 bp, Glycine max
  Peptide Sequence Number=SeqID_145994
atggtttctatcagctgtccttcctgttcagtactgaaagtggtgatccgctcacaattcggcacacaagcataccgagccggaagcatcagcgctggcaagtgtaaagccgggactcactataggcgcgaattgcttgagctcgctaccgctcggtgtatgcggcacgctctagaactagtggcttatcccccgggctgcggaattcgatggagattccagaggaagatacttaacagggaagtggtggccgcggcttccaaagtctccgtttttgcatag

SEQ ID NO: 54310 - DNA, 657 bp, Glycine max
  Peptide Sequence Number=SeqID_145995
atgacatctgaggcagcaaaggaaattcctgacaagattggttcctttgttacccatggacgtcatgatatactgattgctgtcattgggcgaccagaacaccctagtcatgtgcgtgctataggagccggtataaccatcaagcaatactttggatcgacttcaaggacctcctccattgctcccgaatacctgcaacagttgacgcaacaaatcaaggaccagctggaggatccaatcacagaaaaagtcactcgacgactaatgttatccctcagccaaatgcaatcacagggacttgcactgcctcctgaacctggtgttgatccttcagctgctcatgtcagcacaaaggagagttgtgttgatccctcagggaacgatccagacacgagtgactcatacaaatgcgggttgtatattgaagaatatcctcctcgcctggttgccctaggaagagtttatgcgggatccacaaccattcacaacattcctttgctgcatgatcaagtcaaggttggtgttgaggagattagagatgcagatgctcccattcttgtacccactaaagaggttaaggtcatgggacaggctcttaacacattccttgcttggccgacacatcttgtcaagcgtttatcagaacatgtattttag

SEQ ID NO: 54311 - DNA, 1048 bp, Glycine max
  Peptide Sequence Number=SeqID_145996
gcaacttggctaccctatgagaggggcaccgctagaggaagagctcgcgcctgtcatttcacgaggtttcaatgaaacctacggtgagacacttcagaaggtggttgaaagcccacgtgcaaggtttggattggctccgctcccgagtttgagaaccgctaaaagggaggaagttgaggcactggaggaagacgaagaggtgcaggcccttagggcagaactcgagcaagcccaaatagtcaaagaaaggttcaaatcaacagctcttaaaatccgaaaggagaatgccgaactaagagatacaaatatagctaccaccaaggccttggaacaagagaccaagagggctcgtagggaagagcatggctggaacaagttccaaggggctctgtggggcagcaacagcgagcttaagctccggagagaggaaagagaccaatcacgagtacatggcatggtcttaaaggaggagttagctgcttgctcaagatccaagaaaaggcagtacaaagaagagttaaaccaatctttgacccatgagcaaaagctagtagaggacttcgcacaagcatacgccgagaaggaaacaagagggagggtgattgatgcattgcatcaagaagcaaccatgtggatggataggttcgccttgaccttaagtggaagtcaagacctcccgcgactactagccaaagcaagggccatggccgaagtgtgttcagccccaaaggaaattcacgggctaatcaattactatcaacacatgatagatttaatggcccaagttctgaaactcatcacgttgtctaaaaaggccttgagaagtgtgacgggtttcaatcggaggtatagtcctcaagcctacccttatggtttgcctccaaacttcattcgccgtaccgctctagacgatttgagccaagcccctaccttcaagggacagctccctcctcatgccgactatcctctgcaagaagatgatgaaggatatgcccatttaggccctctacttcccccaaaagaaccggccccccatgagttgccctaa

SEQ ID NO: 54312 - DNA, 516 bp, Glycine max
  Peptide Sequence Number=SeqID_145997
atgcaattaccgcaagggcccttgaacgagagaccaagagggctcgcaaggaagagtatggccggaacaaatttcgcggagctctatggggtagcaatagtgaactcaagttgcgaagggaagaaagggaccagtcgcgagcacatagcatggtccaaaagaagcttgtctcagcgtttatgcgagacagagaccaacatgttagctatcatcgccaagtacgaagaagagttgggtctagccacggcccacgagcatagaatcgcggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccacccccgaagagattcatgggcttctcggctattgtcagcatatgatagacttaatggcccacataattagaaatcgttag

SEQ ID NO: 54313 - DNA, 198 bp, Glycine max
  Peptide Sequence Number=SeqID_145998
atgtcctccccggagcttcattgcctaacaggccaagttacaaaagcaatccccaagagactcaacgagggaatgatgagaatcatgaaactggccaaatacaggctaaaggcccaagtggagaaggacgaaggcccaagtggagaaggacaaagcccccgagtggagaaggatgaaggcccaagtggagaaggatga

SEQ ID NO: 54314 - DNA, 213 bp, Glycine max
  Peptide Sequence Number=SeqID_145999
atgccttcagcacgcgaaatggctccaagaaagctttccatgaagagatctaggaaggacgccgcggccgaagggactagtgccgctcccgagttcgatagccatcatttcaggagcgctgagcaccagcagcgtttcgaagccatcaagggatggtctttccaccgagagaggcgcgtccagctcagggatgacgagtacatagatttctag

SEQ ID NO: 54315 - DNA, 288 bp, Glycine max
  Peptide Sequence Number=SeqID_146000
atggtcataaattttcacacggatgtccgattcatgggccataatatagacctcaaaaatgaaccacggaagctctcagaaattcaaaatggtcataagttttcaaacggatctccgattaaggtgcatcaatatatcgagacgctcaaaatgaacaacataggaagctctcgagaaattcaaatggtcataaattttcacacggaggtccgaaattcaggcatcaatatagtcgagatgctcgaaattgaacaacggaagctcttcgagatattcaaatggacataa

SEQ ID NO: 54316 - DNA, 700 bp, Glycine max
  Peptide Sequence Number=SeqID_146001
ggtggacccttgggtactagtaccctcaccttccgaggactacacgtcctccccatcagaggactacacgtcctccccattagaggactacacgtcctcgccatcagagggattcacaccctcgccttcagagggctacgcgtcctcaccttcagagggctacatgcacgccctcagagaactatgcgtcctcaccttcagagggctacatgccctcgcctttagagggctacacgccctcaccttcagaggactgcacgtcctcacctttagagggctacacgtccttgccttcagagggctgcacaccctatcctttagagggctgcatgccctcgctttcagaggactacacgtagtcgccatcagaggactacatgtcctcgccttcagagggctacacgccatcaccttcagaggactacacgtcctcacctttagagggttgcacgtcctcaccttcagagggctgcacaccttctcctttagtgggctgcacaccctcgctttcagacggctggacgccctcgccttcaaagggatggccaactgtgcgagcacaactagaggaggaggctatcgtacatccactatgcatactggggcaagatttcacccatgccgttataaagagacgagtgcggatcatgtgcaccaacatgaccactcttacacagatatagatgacgttgccacttag

SEQ ID NO: 54317 - DNA, 204 bp, Glycine max
  Peptide Sequence Number=SeqID_146002
atgtcccaacaatcctgggagatccacacgaaggagtgtgatattgctgtgcttctgatgctgatcaaagagttccaaggaacatcttccactccaaagcgaagccctccacttcacccaaagaagggaatttcaacagatgaagaagatcaagccacagaagagaccacctgcaccaagggcaccagaacctgctccaggtga

SEQ ID NO: 54318 - DNA, 255 bp, Glycine max
  Peptide Sequence Number=SeqID_146003
atttttctatccaatgcccttgcggggtacgattgcatcacagatgctccagttcctatacccactgatgaggtttccttagtggggcaggcacttcacaccttccttgcttggccgacacatctggtcaagtctttatcacaccaggtagctgtgtctccgccaaaaccacctccgaagcccgatccggaggtcgatgatccgctttatctgatgacattgaccatcctagagcttttcttaaggccttatcag

SEQ ID NO: 54319 - DNA, 525 bp, Glycine max
  Peptide Sequence Number=SeqID_146004
atggccagagatagattgacagctgatcaagccaataatatcaaattgcaactcatagctgctcggggaaaagatggccgtgtatataatatgcctaatgttccggaaattgctgcacttattgttggcaattttcatccagactcaaaaagagacattattgttgaaactcaaaatggagaattacaaagaatccatgaacttcatcctagctatctaccactacagtatcctctactctttccttatggagaagacggatatagagctgacatacttcattgttgtacttcatccagcaaaaaaagaaagcaaaactgtctgacaatgagagagtggtttgcttatagacttcagtccagctatatcagaaacaaccaaaagaagcttagagttgataagtattctagcttacaaacttcattggatactggaacagctaaaggcttaaccaagggaaaaagagtcatcttaccctcaacgtttgttgggagccacgttatatggatcaactttactttgatg

SEQ ID NO: 54320 - DNA, 246 bp, Glycine max
  Peptide Sequence Number=SeqID_146005
atgatgataacaaaagatgatgacaaaggtgatgacaaaaagctgaaagatcaatcaaagaacagctcaagtgaatcaaaaacaagtcaagagttcaaagataagaataaagaagaaatcaagactcaagaagaatgtctagagtcaagaatcaagattcaaggttcaagatctcaagaatcaagatcaagattcaagactcaaggttcaataataaagagaagactcaatcaagataagtattaa

SEQ ID NO: 54321 - DNA, 618 bp, Glycine max
  Peptide Sequence Number=SeqID_146006
atgaacgaccctctcaatgagtcaatctcatgttttctcataagggtggacccttgggtactagaacctgtcgcctttagaggactacacgccctcgcctccagagggctacatgtcctcgctttcagaggactacacgtcctcgccatcagaggactacacgccctcgccttcagaggactacatgtcctcaccttcagaggactacacgtcctcgccttcaaagggtcatgtaccttcgcctttgtagggctacacgccctcgccctcaaagggcgacacgccctcgccctcaaagggcgacacgccctcgcctttagaggactacacgtcctcgccatcagaggactacacgtccccacctttagagggctacatgccttcgccttcagaggactacatgtcccccttttcaaagggctacacgccctcgctcttagagggcgacacgccctcacctttagaggactacacgtcctcgccatcataggactatattccttcgccttcaaaaggcgacacgtcctgaacttcagagggctgcacgccctcgcctttagagggctacgcgtcctcactttcagtgggctccatatccacacctttaagataatttaa

SEQ ID NO: 54322 - DNA, 480 bp, Glycine max
  Peptide Sequence Number=SeqID_146007
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccccgacgatgacgacgacgtcaaagagacacaagacataaagaggctaaggtacgagtggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 54323 - DNA, 270 bp, Glycine max
  Peptide Sequence Number=SeqID_146008
atgttagaaaaacacactctaggagcatctgcaatatggattaaaaaaggaaaaagttacatgtggtatcagcaatatggggtctggtctccccctaaggcaatttttgctaaagtgaattgtgatggagcatgttcctatcagcaaaatatagcgtcagctggtgttatcatcagggatagtaatgggcaatttattgcttcgttctctactcaattgggagaatggtcggtggtcataactcagcagaactccgggcaatctatttga

SEQ ID NO: 54324 - DNA, 75 bp, Glycine max
  Peptide Sequence Number=SeqID_146009
tatcgggcaatcatgaggtaactggcagaggcaggttagtgaattcgatgcctggcaaaggaaaacacgctgccg

SEQ ID NO: 54325 - DNA, 494 bp, Glycine max
  Peptide Sequence Number=SeqID_146010
ggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtacccgattatctttatggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 54326 - DNA, 507 bp, Glycine max
  Peptide Sequence Number=SeqID_146011
atggcatccatcagccagcttcagtcgcagatgcaatctcagggactcgcagtgcctctagagcctctggttgttccctccgatcctcgtgtgagcacaaaggggagttgtgttgatccctcaggaaacgatcctgagacgggtgactctgacaggtgcggcttgtacatagaagcagatcttgcccgcctggttgccatggggagagtttatgagggatccactgttgttcataacactcctttgttgcctggccaagtaaatgtagttgtgtctccgacaaaaccacctccaaagcccgatttggaggtcgatgatccgctttatctgatgacattgaccatcccagagcttttcttgaggccttatcaggttagatgggatgccaccgtgttcggggtctttaatccagatttccccctctacataaagcacgaagacctctcaaaaattgcacgcggtggtcaatgtctcaacatatcagtgttacagttgtggattatgtaa

SEQ ID NO: 54327 - DNA, 240 bp, Glycine max
  Peptide Sequence Number=SeqID_146012
atgtacaaattcatagtttgtagcattggttttctgacttatcaaggtaatccttgtggcgtctaccctgacttatcttccttcactggaagtggcgtctacccagacttatcttccttcaccggaagtggcgtctacccagacttatcttccttcaccggaagtggcgtctaccctgactttcttccttcaccggaagtggctcacaaaaaacgcctagttttaataatagcattataa

SEQ ID NO: 54328 - DNA, 432 bp, Glycine max
  Peptide Sequence Number=SeqID_146013
atggcggcgcagctaatccatgatcgagtagagatggagtgcctagagggagcctgggagaccctcgaaggcaatacgaggtgccgattttggggcactattcgatttacgacgacttctttggtgcatccagatgagcccgtgcgcacgcttcagcgcactgtggagtggatactacccacgcctacaccataccgtctagtggagccagtccaagtgatcgaggtgacgtcatccgaggaagaccctgaggaggatcccgaggagctacctcctgagcctgctgtggatgctcttgattttctagagggcgatgaggacccacttcctgaggtggatcctcccgaggaagtcatgtcggcatctgaggcagactctacggaggatagtggcccgagagagatggcgactagtggaggctcttcatcatag

SEQ ID NO: 54329 - DNA, 1413 bp, Glycine max
  Peptide Sequence Number=SeqID_146014
atgagaattagaaaccttctaatggggatagaattgctaattaaagtgaagagtaattttgctataaagtggtatatgttctaccaaggagatataaggtatggcaaaataattgatttcagcaatgctgatgttgcggtggatcagtaccaccgatacgaagaagatatacaactgatgaaggacatgggaatggatgcctatagattttccatttcttggtctcggatttttcccaatggatatggccaaatcaatcaggcaggagttgatcattataataaactcatcaacgcgttactagccaaaggaattgaaccatatgtgactctctatcactgggacctgcctcaagccttggaaaacaagtacagtggatggctaaacgcttcaatcataatggactttgcaacttatgctgagacatgctttcagaaatttggggatagggtgaagcattggatcacattcaatgagccacatacatttgccacccaaggatatgatgttggtctacaagcgcctggtcgatgctccattctccttcacctgttttgtagagcggggaactctgctactgaaccttacattgttgcacacaatgtcctactctctcatgcaacagtagcagatatttataggaaaaaatataagaaaatacagggaggatcactaggggtagcttttgatgtcatttggtatgagccactaacaaataccaaagaagacattgatgcagctcaaagagctcaagattttcagctgggctggtttcttgatcctttgatgtttggggattatccaagctcaatgaggactagagtaggaagcaggctaccgaaattttcgcaatcagaagctgctcttgttaagggttcattagattttgttggaatcaatcattacaccacattttatgcaaaagacaattctactaatttaattggaaccctgctccatgattccattgcagactctggtgccgttacccttccattcaatggtactaaagctatttcggaaagggcaagttctatatggctgtatattgtgccacaaagcatgaaaagcttaatgatctatatcaaacaaaagtatggaaaccctcctgtctatattacagaaaatgggatggatgatccaaatagtatatttatctccattaaggatgctctaaaggatgaaaaacggatcagataccacactggctatttatcttacttgttggcttctatcaaagatggttgcaatgtgaaaggttattttgtgtggtcactattggataactgggagtggtcagctggatacacgtctagatttggtctatattttgttgactacaaagacaacctgaagagatatcccaaacaatcagtggaatggttcaagaacttcttgaaacctacaaaataa

SEQ ID NO: 54330 - DNA, 1479 bp, Glycine max
  Peptide Sequence Number=SeqID_146015
atggctattggaagacccgagcatccaagtcgggtatgtatggctgggacaggagttacaattagccagtactttggtccaacatcacgtcagtctatgacttcgtcaaacttgatcactccagaacagttggctgatatcattgtgggcacacagtgcgacagttttggcaccatccacaacgtgccctatgctgatgatgttgttcgtgttccaatccctacatcagaaataaagtttgtgaaagaaactttagggagttttgttccatggtcaacacatttggtgaaacccatcttgcctgaggatctagagaaggctgttagcttaccattgaagattgttgaggaggaaaaggcatcggtggtggttgatccattgggagacttggtcaagaacttgttcgatatttaccaaaggcctgttgagttgtcatgggatggcactaaatttgggatcaataatgtcaaagatggcttcttcatcacacacgctgatgtcattaagataattttaggtgacaatctagcggtttggttttgttctttgtggaagaagcctgatgctaccatcaagggtacaataaacagatacaatgcatatggtcactgcagtgaaggagcaaacactcattctggaatgtccaatgaggaagctaatgctaaatttatgacagcaacgtatatgactaaatacaagaaggcaaagaaaggaattcaattccttatcaatggcagcaaagtgggtaattcaccagaggaaatagctgctttccttaaagatgcatctgggaagattctttgctctctgtcacccttccctccgatgttgaatgaagttattgaagttatgaagagggttgcacctctgatattggaggaggtttcacttcttaatgatgcggtttctcaaattgatgagccatgcttactggtaatagcggggaaattcaactctggtaaatctactgtgattaatgcgcttcttggagaaagatatctcaatgagggagttgctccaacaactaatgagatcacatttttacgatatactgacttagatattgaacaacaacagtgtgaaaggcatctagatggtcaatatatttgctacattcctgctccaattcttaaggagatgaccattgttgatacacctggaactaatgtgattcttcagaggcagcaacatcttacagaggaatttgtaccttgtgtagatttacttctttttgttatttttgctgatcaccctttaactggaagtgagattgcttttcttcgttattctcagcagtggaaaaagaaagcggtttttgtcttgaataaagctgacatatatcagaataatcatgaggacgagaccgtcgtaaattttatcttagtcaacgacgatcgtttggacgacactgtcatagaagaaaggcttgtctatgacggtcgtggggaacagaccgtcgtagaattcaccaatgtctaa

SEQ ID NO: 54331 - DNA, 1626 bp, Glycine max
  Peptide Sequence Number=SeqID_146016
atggggtataagagatgccgtgaggctaatgaatttgaggatctttctttgaacaaggcaaaacgttttgaatgcaacaatgagctggtttcattagctgatattgttacgcccaacaaggcctttgctaagactgttattaaaggtgatgaagatggcttttacaacattcaatggtatgatccacttgaaacagatgctgccaaagaatctccatatagtggtgacaagaatggtaaaaccagtggccacttccgcagctgttctagtgaggatgatactggttctggggcgacatcattatcatctgcttcctcagattgtttggaatttgatactccgcagaaagtatttgttcctttggatgatgactatttagactttgattgctcacctagaaaatcagttcccattggaccaaatcatcaagccaccattcctgtttggaggggtaaagtgaataagatgttggagttaggcatatataatcatgacagtccctcctctggcttagtatcagctcatactgttgatgaagatgaagagaggctcatgggaacttctgtgctctcaatggatgagtttagctttcattattttagtagtaatgagattggacaaggcaggacagagtgtaactgcatggatcgttgctccatcagatgtgttagacagcatgttagggaagcgcgtgaaaatttgatggagactcttggggaggaaaaatttgttaacttgggcttttgtgacatgggagaggatgtttcacgtcaatggactgaggaagaagaagacatgtttcatgaggttgtctacagcaatcctgcatcattgggtagaaacttttggaagcatttgtcagtcactttctcttctcgaaccagtaaagaaattgtcagctactattttaatgtttttattctgcggaggagggctgctcagaacagatccagatttttggatattgatagtgatgatgatgaatgtcaaacaagaaactctaggatttttggttttgaaaattctgatgattctgccattgagtctcttggtgatgaagatgtccgtgtggaaaaccatgataattattctgatgaagatgatgatgacgataacactgatgatggaactgaagataatgttcatggagtaactggatgtgatattggaaacaccactgagatagagggtgagattgatcaaaacccatcaaattcgaaggtgaactcacagattgagccttggagtaatcctgatgagcatgtcaatgggactcctggaatcctgaactacaatattgctgtcggggatgactcctgtatgtccttcgaatgtgatgccaatatgcatgtgtcttgccattctcatggtttaggaggtgctagttccgctttgcaagctaggggatataattgtaatcagagtccacatacgcaaggaaaacttgatttgtccagcaatgagatggatcatgtttatttgatggagccctgtgtttctaaagattggtatcctgggtactcaacatgtccaacgccaagtacagatttagacttcttacctacctccaatttgattgaagagttttttggctatggtactctggataaaaaagacctgaagtga

SEQ ID NO: 54332 - DNA, 273 bp, Glycine max
  Peptide Sequence Number=SeqID_146017
atgcaggattcaatagcggcggggaatgaagaaaagcagaggggaatgaggaaaaatagacataaaaaagaaaaggatataacaggaaaaatgaggagaaaaaagaaatgttgtactcagagattaccactagattactcaaaaatactcacgagtaattacttagaccaacaaatcattataaaagagatcatgagttttaaaaagatattaaaaaaatataaagatatgaaaagtcgtttacgggaactcatgccaatgccaccagtgtaa

SEQ ID NO: 54333 - DNA, 1368 bp, Glycine max
  Peptide Sequence Number=SeqID_146018
atggttgacggcggaaaaggagagggaggaggagagcaagcatcgccaccctcgacggcggcgcgtcacggaaccactctccggccacgcgcctccgtggagagtgttttcagcggcgggtatagccccggtcccatggctctgctttccaatttctacggcgacggcgatgagtgcaagtcgttctcggagctcctcgccggcgccatggtggaccccacggcaccctcgcccatgcccaccacaacgttcgcgcttccacctggattcatcgattcaccttctcaagtaataacacataatctcatatgctatattttgtaccaacaacaacacattaccaaaagggatcatgggattcctcttgggaaaatctttattatgttggagattagtactataaggaagacacggctgaactctgtatttgctattgaagagggccaatttggaataacacaccagcagatgctagcacagatctcatctcaagctgtgcaaacccactctgaacatccattctctatatcagccgtatctgctacctcatcatgtgctgcacaacagctgattccaccctcaatgccagattctaaggtgaaagaatcccttgattattctcactctgaacaaaaattgcagtcttctgtgaatgttgataataagcctaataatgatggttacaactggaggaagtatgggcaaaaacatgtgaaaggtagtgacttctcaagaagttattataagtgcacacgtccaaattgtcctgtgaagaaaaaacttgagcgttctcttgagggtcatgtgactgcaattatttataaaggagaacacaatcatcaacgtcctcatcgcagtaagattgtgaaagaaacacaaacttcaaatgaaaattcagtgtctaagatggatctagggtctagtcaggccacaggtgaacatggatcaggaacaagtgatagtgaggaagtagatgaccatgaaactgaagcagatgagaaaaatgatgaacctgatgccaagagaagaaacacagaagccaggatccaggatccagccactttgcatagatctgttgcagagcctagaatcattgtgcaaacaacaagtgaagtgaatctcttagatgatggatatcgatggcgcaaatatgggcagaaagttgtcaaaggcaacccatatccaaggcatggcacccgggcggggcgggggcgggggcgggggcggggagtattcccctgctccccgtccccgaaccttaccctgcttcccgtttccgtccccgcttcccgtggtgggggtattttttgccctgttcccattctccggcttcccgtcggaacctgcgcagaccccgttttacattaa

SEQ ID NO: 54334 - DNA, 1800 bp, Glycine max
  Peptide Sequence Number=SeqID_146019
atggtgagcgtctgtaagggtggactggttctgggtaaggcggctgatggcctcttccaggcggtcggtagtcttggaacgtgtatggtgttcggccatggcgtcgccggtcggcagataggccttcaaactctttatcgtcccaaaattgggaagaaaaagaaaaggggagaaatggtgggggcaacaacattgctaaaaatcgcctttagtagtagcataaaatgggatgtacagaatccgataatcaccaaaacacttcactccaaccatcacatccggtcaccggaaccctcgctcatgtccaccgccaaatcccgcaacttccgccgccgcggcggcgacgacaccgaatccaacgacgacaacgacggcgacaccacctcaaccaccctcccttccaagcccccttcctccgccaagcccaagaagaagccccaagcccccaagctcctcagcttcgccgatgacgaagacgaaaccgacgaaaacccgcgtccacgcgcctccaaaccccaccgtaccgccgccaccgccaaaaaaccctcgtcctctcacaaaatcaccactctcaaggaccgaatcgcgcatacctcttccccttcggtccctaccaacgtccaaccgcaagccggaacttacaccaaagaagccctacgtgagctccagaagaacacgcgaacgttggtctctagcagctcctctcgctccgatcccaaaccctcctccgagcctgtcatcgtattgaagggacacgtgaaacccttaggtccggagacccagggtcgggactccgattccgattccgaaggcgagcatagagaagttgaagccaaattggccaccgtgggcattcagaacaaggaggactcgttttatcctgatgaggaaaccatcagagctatccgggcgaagcgggagcggctccggctggcgcgccccgccgcgccggattacatctccttggatggtgggagcaatcatggcgctgctgaggggctgagcgacgaggagccagagtttaggggccggattgcgatgtttggggagaaggtggatggtgggaagaagggtgtttttgaggaggtggaggagaggagagtggatttgaggttcaagggtggagaggaagaggtgctggatgatgacgacgatgaggaggagaagatgtgggaagaggagcagtttaggaaggggttagggaagagaatggatgaagggtctgctagggttgatgttgctgctgctgctgtgcaaggtgctcaattgcagcacaattttgttgttccctctgcagcaaaggtgtatggtgcagttccaagtgcagcagcatcggtgagtcccagcatcggaggagcaattgaatcgttgccggttttggatgtcgtgcctatatcgcaacaagccgaggctgctaggaaagctttgcttgagaatgtgaggaggcttaaggctgtatcgttacctgtcaaatttgtgatcttgcctatcttttgtacggaatctcatggaagaactatgtcatcattgagtaaaactgatgaaaatttatctgcctcccttttgaacatcactgctcttgaaaactctttagtagtagctgatgagaagtaccggtttatgcaaaagctccgaaattatgtcacaaatatatgtgactttttacagatggctgtgatttcacacgaaagtgaccatgacttgagctgcaacaactgcaacataaaactgttccacagcaggccacacaagcaggaagggggtacaatgcaacacacctatagcagctccatcgcatag

SEQ ID NO: 54335 - DNA, 405 bp, Glycine max
  Peptide Sequence Number=SeqID_146020
atgactgatccaggttcacttctcctgaggcctgggaaaggcagcattgatgttgccattgtgaaagagttttatgctaacctttatgatcccaaggataaatcacctaagcaggtgagggtgagagtccatttggtgaagtttgatgaagacactttgaataccttcttgaaaacccctgtaatcattgaggagggggagacattatcagcttactctagatttgcactcttgaggcctaatcctcaagagttggctgctaagttctacatcctagggaggggatttgagctaaatgctgatggtcagcctcttgaagattttaaggaagaacatgaccacactcactcagacttggagtgttctttcttactcgaacttggtccctacctcccatacttctga

SEQ ID NO: 54336 - DNA, 1878 bp, Glycine max
  Peptide Sequence Number=SeqID_146021
atgaccagtagaggatctggccctaacaaagaaaattttcatagttacctgggggtcgtggctcgtgacaaaatccctattgtccattctacttggaaagttgtccccgaaactctaaaaaatattataggggatgacatcttggtcaaatttgacatccctgaaggaacagttgcgaagaagaagatggtgaagagaaccatgatccatctgctaagtatgctttggatcaagaaacatgggaacaatttgcaaagagtcgacaaaccccaagttgggaatacgaaaaaagctcaggaaatacaaaaattcaatgactctccccacgtactatctcgtggaggctacgatctagtcgaaaaaaagtggatggctgaaaaaatgaagagaagacagaatgaagctgagttaactgaaaattcacctatgttcgtagaccctccatcacccatggcaagacatgtcaagtggaaaaaggcaagaataaaggcgtatggcgaaatgacatctacaatagctaaagaaatctcagacaaaattggaacttttgcgccccatggtcgtcacgacatactaaacactgcacttggccgagtagagcatcctggtcgtgttcgtgttgctggacatggagtcaccattggtcagttctttggacaacatgctagtggctcccataattctgcagcatcgatcaccccaaatcagttggtggaaataataggaattctaaaacaagagtggaggagagaggtagaagacgaaaacaaaaagacattggacataatgaaaaaagagttggatgcgataaagagtgagttatcccaaatgcaaacacaacaattagccccagtaagaccacctaacgctgatgcgttgattgaacgtgttagcacaaaagaaagctgtgctgaagctgctgcaaatgttgctgtaggtgacccatttgcagctgatgtgactaatatggggttgtacattgtgtgtagcaacaatatacagctagtggcctcgggtaaagtgtatggacaaggcgggaccatacacaatgttccttatgttgatgatgttgtcagggtttatgttgaaactatttatgatggtgacgtgaagatactagtaggatgtgccactgagtccaatgcagttgctgtaaaggatccattgggagaaatgatgaagataatgtatgacgtgtacctgaatccagtggaacttctatgggaggcgacccaatttggactcccaagtataggggcaaaattctacatcacacatggtgatgtagcggaaaaattaggtcacaagtgtttaaacatatctatactgcagttgtggatgatgtcacattggcaactatttgttttgtgtccaacagaaaacatggttgtttggttttgttctttgctgaagaagcttgatgtacacatcaaagccgcaattaacagtgcaatgaagacaataaccacttcttttgaaggtatggctgaacaaggttcacctcggtgggttgaacccaagagtcatgttcaaactggagggtacgagtgtgcatattacgtcatgcattggatgtggtgcatagttactggcagtttgaaggatgaatggaacaagctcaaaaaggctgtgaggtgtggggagggtcaaaggttgttgttagggaatacgaaaaggattatgtgtgttgcccagattgtgatttttacttttgttgggagactattatgttgctgccaacctgaggtggaaggtatgttgctggcatattttaattgttacatcataatgtgctcttcgaggttgagcaatccacctaacaacaaccatggactgacaacctatgactattttgtagccatgaaagaagttggatga

SEQ ID NO: 54337 - DNA, 707 bp, Glycine max
  Peptide Sequence Number=SeqID_146022
gggatcctcctttaccaccaccgctgcaggccatcgctgctacagaacatccagtgactcaccaacaccaattcctccttctctttcatctcccagatcatcaaccttgttttctttcgatgaccaacgtcagtggtattactcacaattctgcaatcgcatcattcttgaccctaatcaaggtgttccttttgagggaactcttgttgatgactgtaaacatgcttattcaagtcatgatgcttgaaaaatggtctggaatgaccatgctgacgtccattaatcttgcccatgcctctgaggaggatttaatcttgttgtgggcttttcaaattggtcgtcagatcgacatggcccatcttgttcagtatcgaatacataaggcatcacgggccaatgcacctctcccatatccccatcttgttaccttctttctccagtatttcaatgtccccttagatgatgaaccttttgtcaaagttaaacattcttttgctattggtgctggtgatgttacatcttttggttatcggaaagacatggatagtcagtgggtgcgcaagcaagacttaccacctcccattcttgatgacatcggaaagacatggatagtcagtgggtgtgcaagcaagacttaccacctcccattcccgatgagcgtacaccgtctccaccactgcaacgagatgcctcttcttctctcttaa

SEQ ID NO: 54338 - DNA, 189 bp, Glycine max
  Peptide Sequence Number=SeqID_146023
atgagaggcaccatgcatgaacctcaagcaaacctaggggaagatcagaagttctcacccggtagactccttgggattccttttagacatgacaatgaggcgggtcgggtacgggtattgtctccccaatcccttatcccgactcctcaacatatccccatacccgtacccgatacccgacgggtttga

SEQ ID NO: 54339 - DNA, 513 bp, Glycine max
  Peptide Sequence Number=SeqID_146024
atggctataccacccagctcccctcctcatcctcctcctcctactgattcaacatcacattcaccttctaccatgaagaggacaagaaaagcgacccagctgagatcattagctactagactagttggggcaaagatacccttggtccatgtggatcttgtaacttggaaagccgacagtccctacaaaaggaagttaagaacatatctagggatcgttgctcgcgataaggtagatgtgacatataagaattggaaacaagtccctgctaaccagaaggatttgatatggaaggatattcaaaaaatacttcaaaccataggggagcggtggagacagttcaagtctaatttaacatcgaaatgggcacttgcagccgacaaggatggtgtcgatgacattgtttgtgaaaaaaacaagtttatggatgagaagaaaaagaaacaactagaggaagctgctaaatctagaagcactaacaccatgattgatccttcatctcccatcaaatga

SEQ ID NO: 54340 - DNA, 375 bp, Glycine max
  Peptide Sequence Number=SeqID_146025
atgcgatttcgtcctcgtggtcatcgaagcagcaacctagtgttgtttgtggctaggtggtcggcgtcgctgcgtcgtcgtcctagtgaagaggctccactggtaacatcgtggatcgaggataatccaaggaagcatttttatggttgtggtctatacaaggttacaggtaggaaatggtgtaattattttgagtggcacgatccagttgccaacatttgtcagaagaagatcattgtaacattgatgaagaaggttgatgaattgaaattgagggaaaaggatttgcaaaccaagatgagtgacatgaagatgaagggaaaatttttagggattgtattggttttttcttggcagaggaatgtaatttcataa

SEQ ID NO: 54341 - DNA, 1230 bp, Glycine max
  Peptide Sequence Number=SeqID_146026
atgggaggctgcgcttcaaagccgaacaggaagagtaatgttcataaaagagaacacaaaaaatttaggaaacatgcttcacttggtgacataacaaagaaaaggcatagcaatgcttcagccacccgccggaaatctgatgtttctaacatgaagttgcatcttgcccaactccaataccagagccatagtaaaaaagatgcaagtggaaaaacccatgaggatgcctggtttgactcagttagcattatagaatctgaatcagatgatgattttattagtgtacttggagatggttttccctttgtcactaataatgctttgggaagtgtcccaaacacccagttactccaacatgaaaatgcatcatgcttggtagattcagggtgtaaatatgatcggttatgtgatagctacttcaaagcaggtgtacctgagagatttctttgtcgtcctagagctggccttcagattctaaatacaactcaagagaagccatgccccagttcctggtctgcagtttcaccttcagttttcaacctccgcggagaaaaatatttcaggcatgtttatcaattttttccattaagagataagcaaaagtgtcctgctccagattttagcccttatataccaataggtgttgatttatttgcgtgtccccggaagttgccaacatatgctgctagcatgttccctggtgatgctgatggggaaggcatgagccttgtattatactttaaattgtctgagaattttgacaaagatacctctcctcactttcaggagagcatcaagagattagtagatgatgagatggaaatagtgaaaggtttaacaagggaaagcttggttccctttagtgaaaggctaaaatttttggtaggggtggttaatccagaggaccttcagctaaaatccgcagaaagaaagcttataagtgcctacaatggcaagccagtgctttcacgccctcaacacaaattctttaagggacctaactattttgaaattgacttggacatacatcgctttagctatatatcaaggaaagcacttgattcactacgagaccgtacaaagaatgtagtacttaatatgggcataactatccaggcacagaagcaagaggaactgccagagcatgtcttatgctgcttacggctgaataaaattgattttgctaacaatggtcaaattcctactattgtggctcttgatgataattaa

SEQ ID NO: 54342 - DNA, 198 bp, Glycine max
  Peptide Sequence Number=SeqID_146027
gattcctttgaggagcaggcgacacagggatccttcctcccccatggatgtcaggatgttctcaccgttgctattggatgtccagagcaccctggacgtgtctgtgctgctggagccggtgtcaccatcaggcactactttggttcgtctccacggatgtcccacacctcttcctccttgcctcctgaggaattatag

SEQ ID NO: 54343 - DNA, 285 bp, Glycine max
  Peptide Sequence Number=SeqID_146028
atggagaagaagacaacgagaaggagaagacagcgtgaaggagacgaaacatacctaggtatggtggcgaaggagaagaagcagagacttgtgatgatgctcgagtgcgacaaacacgatgctcagatgcagaacagagaccttcaagtagtgccaatttcattcaaaggaaagttcacaaaggaaagttcacagagttttgcctctggatatgaggaagtggtattgaaaatggtcaaggcgcctaaaactcttgcattctgcataatatgtcttgcaaattga

SEQ ID NO: 54344 - DNA, 453 bp, Glycine max
  Peptide Sequence Number=SeqID_146029
atgacccacttctgggtgaaaccagacaagctcaacccagttgtggtagataaagatgttaacaacactgaatttcgtgaccccacagcagcttggtggggcaaggacggtcactggaggatgctggtgggcagtgtaaggaagcgcagaggaatagcttatctatacggaagcaaggacttcatgacatgggttcgggccaaacaccctatccattccaagggtggtacgggtatgtgggagtgccccaacttttacccagtttcagttataggaaatgtagtggtgaatatagtgaaatatgtgttgaagaacaaccttgatgatactaagttcgattactacaatgtggggacctatatggaggataaggataggtatgtgcctgacaacacttcagtggatggttggggtggacttaggtatgattattgttggatcgagtggccttag

SEQ ID NO: 54345 - DNA, 486 bp, Glycine max
  Peptide Sequence Number=SeqID_146030
atgcgtgtctgtgtctggcagatgttgaagttacgttctccttttcaagcttggacaaggcagaggtggggttcaaaactacagggtggggttggaccgtttggacttctgactttggctactcaaaatctcgaagagttcactcctgtgtttttcagagttttcaaaagtccaaataagcatattgttctcttatgctctgatgcgagaagttcatctttgaagagtgatctgtacaaaccacaatttgctgtgtttgtagatgtggatttgaccgtggataagaagatttctcttaggagtttgattgatcactcagttgtggagagttttggagcaggagggaagacaaacattttgtcccgagtctatcctgagctagcagtgatgaaccaagcgcacttgtttgtgttcaacaatggtactgaaccaatcgtagtgcaaaacctcaaagcttggagcatgatatcaactgatataaaatga

SEQ ID NO: 54346 - DNA, 1614 bp, Glycine max
  Peptide Sequence Number=SeqID_146031
atgtactacaatggagtataccatctgttctaccagtacaatcccaatggcacagtgtggggtaacatagtgtgggcgcactcagtgtccaaggatctgataaactggaatggcattgaacatgctatttatccatcaaagccctttgacaaatttggctgctggtcagggtctgctaccataatccctggtaaggggcccgtgatcctctacactggagttatagacgaaaataacactcaagtgcaatgctatgccgaaccagaagacccaaatgacccacttcttcggagatgggtgaaaccagacaagctcaacccagctgtggtagataaagatgttaaccacactgaatttcgtgaccccacaacagcttggtggggcaaggacggtcactggaggatgctggtgggcagtgtaaggaagcgcagaggaatagcttatctatacaggagcaaggacttcaagacatgggttcgggccaaacaccctatccattccaagggtggtacgggtatgtgggagtgccccgacttttacccagtttcagttataggaaatgtagtggggaatccagtgaaacatgtgttgaagaacagccttgatgatactaagttcgattactatactgtggggacctatctggaggataaggataggtatgtgcctgacaacacttcagtggatggttggggtggacttaggtatgattatggcaacttctatgcttccaaatcattttttgaccccagcaagaacaggaggatcttatggggttgggcaaacgagtgtgataaaccgatagacaattttcggaaaggatgggcaggaattcagggctatttaaaaagccagttgtcttcttcattcgataagaaattcactctcccgattacagagtttttatcagtttcaatagatgcagctacaggacagggcacagcaattccacgaactgtgtggctcgattttactgggagacaattggtgcaatggcctgttgaagagttaaacagtctcagaggcaaagaagttaacatagacaatcaaaggcttgagaagggagattatagtgaagtaaaaggaatcactgctgcccaggcagatgttgaagttacgttctccttttcaagcttggacaaggcagaggcatatgatcctaagtgggtaaaggcgcaggatctatgtgcccaaaagggttcaaaactacagggtggggttggaccgtttggacttctgactttggcttctcaaaatctcgaagagttcactcctgtgtttttcagagttttcaaaagtccaaataagcatattgttctcttatgctctgatgcgagaagttcatctttgaagagtgatctgtacaaaccacaatttgctgggtttgtagatgtggatttggccgcggataagaagatttctcttaggagtttgattgatcactcagttgtggagagttttggagcaggagggaagacaaacattttgtcccgagtctatcccgagctagcagtgatgaaccaagcgcacttgtttgtgttcaacaatggtactgaaccaatcgtagtgcaaaacctcaaagcttggagcatgatatctgctgatataaaatga

SEQ ID NO: 54347 - DNA, 201 bp, Glycine max
  Peptide Sequence Number=SeqID_146032
atgaagcacggacacaccgctgaagagttgtgtcccacgtcggaggcgcaccggacatgcaaacgggtacgactccggtgcgacgcggtgtccgttgcctccgctgtcaccagacatggaatcgcattagagcgagattcgaatgaaggagcagcgacggcagagagttacgccaagcgtggcggtggtggcgggttgtag

SEQ ID NO: 54348 - DNA, 1224 bp, Glycine max
  Peptide Sequence Number=SeqID_146033
atggaggtagttaaatcagacctcacgaggaaatgggcccttgcacctgataccgatagtgtggacgacactatctatgagaaatgcgggataagcaaggaaaaatgggccccgttttgccagactcacagagacacttcttgggaggatgtgcacaaaaaggcgcatgccatccagaaacagaacactgccccccacgttttgtctcgtgggggttatgaatatttagagcagaagctcctagctgagaagacaaagaagaagctcgaggaagctgcacggtccgaaagcgttgatggcgtcatcgaccctccatccccgatcagacaccacgtgaagtggaagatggccagcacgaagaaaacaggggaaatgacgactgaggctgcaaaggaaatcactgagaagatcgattcctttgaggagcaggcgacacagggatccttcatcccctatggacgtcaggatgttctgaccgctgctattggacgtccagagcaccctggacgtgtccgtgctgctggagccgcagctgatccaacaaatcagggacccgctagaggagtccatcacagagagagtgacgcggcagtgcctcctgaccctctggttggtccctccggtcctcgagtgagcacaaaggggagttgtgttgatcccttaggaaacgatcctgagacgggtgactttgataggtgcggcttgtacatagaagcagatcctgcctgcctggttgccatggggagagtttatgagggatccactgttgttcataacactcctttgttgcctgacccagtaaaggtgagtgtggaggaggttacagatgcaaatgctctagttcctgtacccactgatgaggtagctgtgtctccagcaaaaccacctccaaagcccgatccggaggtcgatgatccactatatctgatgacattgatcatcccggagcttttcttgaggccttaccaggttacatgggatgccaccgtgttcggggtctttaatccagatttcccgctctacataaaaaatgaagacctctcgaaaatcgtacacggtggtcaatgtctcagcatatcagtgttacagttgcatctgactgatacaagtatgcgagcggggaattatgatatctatggattcctcgagccacatgctttaaaaggtcttgatgatgctccacagcctaaatcaaaggctcctgctaggtggattgtcgtcaag

SEQ ID NO: 54349 - DNA, 391 bp, Glycine max
  Peptide Sequence Number=SeqID_146034
caaaggtgaaatgaaagatattgagctggtagaggaggaagaggcacgaattagtgcttattcttctagtgcaacctctaataaatctgagaattataaggaggaagcacgaaatgcagcacagaagcataaagcaaagagggtggagagtgtcaatgctgatgcagaagcctttggtgatcactggaaaaataagataggagattcaactgtgctgaagataggagattcggctaaagttgtgataaaacaagacatgaagggaggagagcataaatatgggtttaacaacaataaacgcgagaaagcagagaaggtaagggtggtggatgatgaaactggcgaacatgagttgtatgaagtcctaaggatgccatctagatgtgtatga

SEQ ID NO: 54350 - DNA, 183 bp, Glycine max
  Peptide Sequence Number=SeqID_146035
atggaggatagcccagaagtttctgataaagacattgagcaagataagcgattgggaatagtaaaattgccacttaatgacttggaaccagaaactgaaaaggagtttgaattggggctgctgacatcacttgatacactgaaagtgaaagacaagaaggatcgaggaaccataaccataaag

SEQ ID NO: 54351 - DNA, 735 bp, Glycine max
  Peptide Sequence Number=SeqID_146036
gacgatgtcgtcggaggcaacgaagaaggcgaggacgtgggtgatgaagtggcgcttgccattgctgaggatggcccagtggcgaaggtccggcgagaggtccacctcctatgtgtagaagcaagcttcatgatgatgaaccaagcaatgctgatgatgccaaaagctcaaatgattgattcaagattgattcaagacttcaagatcaagcatcaagaatccaatccaagattcaagattcaagagaagaaatcaagaagcaacaattcaagtggagcgtacatccacttggttgttcaaagagaacaaggaagggtagatcccttgtggatctttgcttgtaaaggattttacaaggttattggaaatctcaataaccattggttgcttggggactggacactttttaaccgccatatcactgaggatgttggagctgatttgaatgaaggttatgatacatacattcccaaaaaagacttaggctcagagggatttggtgatcttcgtgcttgcgttagagacaaaaatatcccgcttcaaaacattcattttgtgacattctgtaacaatcttaacaaggtaattattcattttggattgtttgattttggcattttagaaatttctaagtcaagtggtgataaccttatactggcaacagcttatatccgtcatgcaccttgggaaatgggagtgcataaaaggaatggtgttgtctatcttgatgtgtaa

SEQ ID NO: 54352 - DNA, 318 bp, Glycine max
  Peptide Sequence Number=SeqID_146037
atggacgcgttactattgttctactatgagaagattgtaggttacatgccttcgaattttgcagatctagtgtttgctggcgagagaattgaagcaggtttgaggaaaggaaaatttaattatgttgcttctgtgaatcctagtaatggaggacccaagaggagtggcgagaggaagaaggagggagaacctcatgttgtggctgcagttcctgcatggccaaactttccactaaccccttataatcctatgctggctaagattttaggaggacaatcacttgtgaattctgatgtcgtcaagccatattatgcatga

SEQ ID NO: 54353 - DNA, 228 bp, Glycine max
  Peptide Sequence Number=SeqID_146038
atgggacaccttaggtctatcatatttcttggtaggaataatcaatatgaaaatacagaaaaaggggttcccatgaaccctaagagaataaagttcattcctgagtggcccactccaccaagtgtcgagggaaggagcccagagtacgaagaaccttgggatttgaggttaaatcctttccaaggtggaggggatgatgcaatcctaccccccaagggtattggatag

SEQ ID NO: 54354 - DNA, 357 bp, Glycine max
  Peptide Sequence Number=SeqID_146039
atggccaagtgcaatattcatggaagaggtgaggcttgttatagcaaaatgcttgagaaggctaaagagaagatcacaaaactgaaggtaagcatgctccagaaatgcaatcaagagctcaggcttattacaaatcagaatgaatcaaaactgcaacagctctcgaaccatatacattcaaaacaaaaagcaagcaaaagaaaaacttaccaagacacaacagacaccagaagaggagcaaagagtgctttggtgccaacggctgcaaggaaagcaacgtcacaacagacacgacagacacgaagcaagaaaacttaccagagcgtgatgatggcagtgaaaagggtggctttgtga

SEQ ID NO: 54355 - DNA, 495 bp, Glycine max
  Peptide Sequence Number=SeqID_146040
atggctgaagagcaacccagaagagtaacccttaaagactactcgagtacatgtgtgccacaatttttcaccagtattgtgcggccagaggttcaggctcaaaatatcacctatccacattctttggttcagcttatacaaggcaatttgtttcatggattgccaaatgaatatccttacgtgaacctagcaacatacattgaaatatgcaacactgcgagaattgttgagaagccaagaggtggttgcattcattcgaagaacaagttgttgtccaagcagcttaaagctttaactaaaacactaaattgcactatttgtggtgctgctcatgagtctagcttatgtatttccactgatgaaaatgttcatgaagtaaattatatggggaatccgcccaggcaaggctataatgtaggcggatactcaggttttcaacatggtttgaattttaatcagcagcaagggcaatggagagcccaccctggcaattaa

SEQ ID NO: 54356 - DNA, 2019 bp, Glycine max
  Peptide Sequence Number=SeqID_146041
atgaggaaacatgggtggcagttaccttaccatcctcttcaggtggtggctgctgctgtgtttctggctctggggtttgccttctatgtgttctttgctccttttgttggagagaagatgtatcagtacattgttattggcctttactcaccactgttcaatgaagggttctatgaagctgtctctgtatctgataagattattagtgtctttggactgtacatatggtgtgctgcagcagatccaggagatccaggggtttttaagtcaaaaaagtatcttaaaatcccagacagtaaaaagcttgctgaactaaagaattctaaattaggtgaagaatcaagttcatcaatgcatgaagtaaatgcttcaatagttggagctaaatctgtggataaagaggcattgggaacaaaaggaacttcgaaagatgcttcaaattcagtagagaagagtacattgtcgtcttgttcatcctgtgtcctcttggtttcttctccgtgtgcatatatctgcagctgctctagttcaaccgagaaatcatctgataaacaaacaattgaagatggcatgttctattgcagcctgtgtgaagtcgagacatgtggaggtggaaagataattttgcctcagcatcagtgcttgcagaacttcacaattacctactgttacaaactcatgtttactctgcaatgcttatatggtaaagttttcaagtacagcaagcactgtagagtctgcgacaagtgtgtagatcactttgaccatcattgtcgatggcttaacaactgtatagggaaaaagaactatcgacaatttttcaccctcatggttgctgctatgctcttgtttattcttcaatggctgactgggatacttgtgcttatctgctgttttgtcaaaaggaagcaattttctgtggatatctcctccaagttgggaaccagtttctctatggttccctttgttattgtggtgtctatctgcaccattctggctatgattgctaccttaccggttgttcagcttttcttctttcatatcctcctcattaaaaagggactcagcacatatgattacatcatagcaatgagggagcaagagcaggagcagctaggaaatggaggtcagcaaagtccccagatgtcaactgttagctcatttactggattgagtagtgcaagctcctttactactttacaccgaggtgcatggtgcacacccccacgtctgctgcttgaagatcagtttgatgttgtgcccccagaaacaggttctgtaagttcactgggaaagaagacaacgagagaagatccattaaagaaaaagaatcctggaactgtcaaaattagtccttggacattggcacgcttaaatgcagaagaaatttctaaggcagcttcagaagcaagaaaaaaatccaaagttctgcagcctgtaacaagacatggtgaggctatcagtttagaactggaaaacagttttggtagcagtggccgaagaatggttcccaggattgagggcaataagaaacgagcaagtaagcgggttcatcatcctgctgacttgtctatggagtccctgacaaaagtttcgtctagtaatactgataaagccttgagtgggatgtctaggttggctcctctccctattgaagcgtgcagcacatttcaaacaagtcaagcaatgtcaagctcagctgggattgttccttcatctcctgaaagtagtttagactctcctgatatccacccttttggggtgtcttcatcaagtgctgaaaaggcaagacagcttgcaggtccttcagctgctggtgctgcaactctgaaggaaattccgctgtcaagttcaactagtgatggatatgaggcttctggcggagaagacagtgaccgggttgacccaagtaggattgttcagagatctacaaattggactaatcttcttttcagagctgatcaggatgacaaggcttttaaaatgtctctttcatcaaccagtgttggttatagatag

SEQ ID NO: 54357 - DNA, 498 bp, Glycine max
  Peptide Sequence Number=SeqID_146042
atgaggctagagatgatacgcaatagaaggaacgcggtgcagaaatttctcaagaaagacattgccgaccttcttaggagtgcccttgattacaatgcatatgaaagggaaacaaatgtattaggttctcattcaaatttctcttatccaatcacaaggattgttggaagtagcgcaagaaaggattgccccgttgaatgcaaagaagctatacagtcgttgatacatgctgcagcaagattttctgatcttccggaactacgcgagctaagaacgttgttcacagggaaatttgggaattctcttgaactttacataagtaaagagtttgttgaaaagttgaggcaagatcttccttcgaaagaaatgaagatccagctgttgcatgatgtagcgcaagagttctctattgaatggaacagcaaggctttggagcagagacttcagtcaccgcctcagttacatgaacaaaaatatgaatcagaattggataattag

SEQ ID NO: 54358 - DNA, 270 bp, Glycine max
  Peptide Sequence Number=SeqID_146043
atgcaaatcgtacgattcggcacaggatttgaaaacgacggagaagagaacgtcgtcgtggggagtggggtggagggagaggtgcatgaagtggtggagcgaaacgacgacggagggggtgccgttggtgaggtcgtggatgaggaaggaggcgtggagttttttgagggaggggaggtttatgcagagcctggagaggtagaatgtgccggggagtggcggcggtggcggtggtggtgtactggtggtagtggtggtacaatgggatga

SEQ ID NO: 54359 - DNA, 498 bp, Glycine max
  Peptide Sequence Number=SeqID_146044
atgtgtcggattacttgtggtacattcctgggtgactctggctccttatcacgcccacttgggaatgcagtattagatggcattgactttgtcatagagaatgacgatccatcgttctacggggaccttgcacgtaacctcaaatcacattcaggcaaagtgtccacgcttggtatcaaagtttatgaagacgacaacaatggaacacagatatttgctatcattggtcatatatctcttgattcttcggaagcattttcattcaggtgccttcatactatgaaaattaagcatacatctggaattttccctctaaccctcatggcaccatctgatttttttagcgaccttttcaaagtagtaaattatcttcctatgagttacagtaaacaggtggtggatatggctcattgttggggtgggagtaacccttgcaatgcttgtgatcttctatttatgtcgtgccttgtccagaaaacacgaagcaaaaggtcttaa

SEQ ID NO: 54360 - DNA, 516 bp, Glycine max
  Peptide Sequence Number=SeqID_146045
atgggatcaagtcaaaagccttcgcttaaaaagaggttctatcaagtcaaaatcaagagcttagaggtcaccagtttacgaaagttggggcaattaatgggtcaacttcaacggcaagccttcgcaaagcctatgggttctacccctcattggccagaatttctaaaaagtccaaatctcagcgcaggaattagaccgccaaaggcaagtcgaaaatggggtggtcggaataccgagaaaatatttggagggagtcctctttccaaatgtggatgggttggtggacctggcagcgatcgacgttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttttccaagaaggtaggctcgtctatccgctacaaggttaccgctcgtgcgtcgaaaaaggatag

SEQ ID NO: 54361 - DNA, 747 bp, Glycine max
  Peptide Sequence Number=SeqID_146046
atgactcctgctgaagccagaaatttaattgagaagatggcctccaactctcagcagtttagcgccagaaatgatgccatagtcgttagaggagtgcatgaggtagctacaaacccatctgcatcatctgaaactaagaagcttgaaggcaaactggatgcattggttaatttggtaacccagctggccttgaatcagaaatctgtacctgtcgcaaggggttgtggtttgtgctcctctgctgaccaccatacagacctttgcccttccatgcagcaacctggagcaattgagcagcctgaagcttatgctgcaaatatttacaatagacctcctcaacctcagcagcaaaatcaaccacagcagaacaattatgacctttccagcaacagatacaaccctggatggaggaatcaccctaacctcagatggtccagccctcagcaacaacagcagcctgctccttccttccaaaatgctgctggcccaagcagaccatacattcctccaccaatccaacaacagcaacaaccccaaaaacagccaacagttgaggcccctccacaaccttccctcgaagaacttgtgaggcaaatgactatgcagaacatgcagtttcagcaagagaccagagcctccattcagagcttaaccaatcagatgggacaattggctacccaattgaatcaacaacagtcccagaattctgacaagttgccttctcaagctgtccaaaatcccaaaaat

SEQ ID NO: 54362 - DNA, 195 bp, Glycine max
  Peptide Sequence Number=SeqID_146047
atgagggttcactgtaatcaagcaagtcagagacctagcatgatcacagattcacctccactcctaaagttcccatggacccggtggagtcgccaactgtcgcaacctacccttcgacgggagggcaacgcagggctcgcgggtgcgtcttccaagaaaggaatatgcgcggagtcgccaccaacgtttatttga

SEQ ID NO: 54363 - DNA, 261 bp, Glycine max
  Peptide Sequence Number=SeqID_146048
atggcccaatgtcacatcctatcagagcattgtgtcccgacatccttcagcacaaggttccttaaagcaattaacctagtcatctgctcccccgaacacaaagttccagatcatcacaggatccaaacacaaacaacacacggggaggagactagtcagggtcatgctattttgcaaagaatgctccaaccatgtgggattgacacaagcttaaaggagcactcaaaccgagtgtatttacccccatggcctacactttga

SEQ ID NO: 54364 - DNA, 720 bp, Glycine max
  Peptide Sequence Number=SeqID_146049
atgggatcaaatcaagcacccttgtttaagaaaagattctatcacgtcaaaatcaaaagcctagaagttgccagtttgcaagagttagggcagttgatggatcaactccaacgtcaagcttttcgaaagacatatgggaagatctggcaaaggtgcttcatgtttggggactttcagttagtactaaccgtagaagaatttgaagagatattgggatgcccgctaggaggaagaaaaccatatctcttttctggggtctacccctccatggagagaatagccaaggtggtcaaaatatcagcacaagaattggaccgagtaaaacaaaatagaaatggggtggttggaataccaaggaagcacttggaggagaaagcgaaggctttggtagatcaagatgaatgggcattattcattgatgtcctagcgctattggtgttcagagtcgtcctcttcccaaatatggatgggctagtgtacctagcagcaatcaacgccttccttgcttatcaccatagcaaggaaagtctagtcgtggctgttttggtcgatgcctacaacacatttgaccggagatgcgagaagagcggcgcaaggattgtttattacacaccagctctttatgtatggctggtatctcacctctttcgtcatgaaggtagacccgtctgtcccctatatggtcaccgcatgtgccctgagaaagggaaggcaaattga

SEQ ID NO: 54365 - DNA, 930 bp, Glycine max
  Peptide Sequence Number=SeqID_146050
atgatgttgggcgcgattgggctggtgttctttatggccaacagtctgggatgggcggactcggcggtggccgccacctattcactgacgctgctgtttttgcgcacgccattactgcaagcggtcggagcgtttccgacgctggtcagcgccgaagtggcctttaacaagctgaagacgctgcgcctggccgagtatcaaccggcgtttcctgccgccgttggtcgctcctggcagacgctggagctgcgcgacgtggtttttcactatgcagatacggaacagcagcccggttttgccgtcgggccgctcaatctgacgctgcggcgtggtgagctggtctttctgatcggcggcaacggcagcggcaagtcaacgctggcgatgttgttgaccgggttgtaccggccggtgagcggccatatcgttctggatggcgtcgcacagagcgcagcggatatgccggactaccggcggctgttttcggcgattttcaccgattttcatcagttcgatcgcttgcaagggccggaaggcggcgaacccgatgcggatctggtcgccatctggctcgagcggttgaatatgaaaagcaaactgcagtttgacggcaccagggtgaccaatccgcaactgtcgcaggggcaacgcaaacgtctggctttgctgctggcggtggcggaacagcgcgatatcttgctgttggatgaatgggccgcggatcaggatccgcaatttcggcgcactttctatcgtgaactattgccggagctgcgcgcgatgggcaaaacggtgtttgccatcagccatgacgatcactatttcgaacacgccgatcggttgcttgagatgcgctcaggccatttacgtgagctgaccggcagcgagcgtgaacacgccagccgggattccgtcagcagaatcggttaa

SEQ ID NO: 54366 - DNA, 130 bp, Glycine max
  Peptide Sequence Number=SeqID_146051
atgtcggctttgaaagagcaaatggcttccatgatggatgccatgctaggaatgagaccactaatggagaatcatgcggccaccgcggtagctgttagttcggctgccgaagcactctcccagctaccgc

SEQ ID NO: 54367 - DNA, 96 bp, Glycine max
  Peptide Sequence Number=SeqID_146052
atgggtgccaagtacctcttagcggtcaagaaaaggttgtatgccatcaaacaatggtccccggaagaaattaggatttacaacctcaatagatag

SEQ ID NO: 54368 - DNA, 168 bp, Glycine max
  Peptide Sequence Number=SeqID_146053
atgaccaaattttgtctctgcgtttcatcgggcccgccgcctctggatgacacaagggtgcggataaccggtcagtatgacaaagattatggggcggccgacaaaagcaaggctcttgctcctacgtatcctccaatgaggaactcagacctacgtagttctagataa

SEQ ID NO: 54369 - DNA, 300 bp, Glycine max
  Peptide Sequence Number=SeqID_146054
atgggacaacatagatatacacatcatataaatgaaatacaacttactttaacacagctcatgtcattccaccacttatcgcgtaacatcacatctcaacattacatgtctcacacattttcacaacattcacgtactcaaggatcaaaacacaatatcactcaaccaatcaatatcgatcaatacgcaaacgttatgcaacaatatactaagactcaatcctatatgcaatgtggtatcatgtcaatgaaaaatctcatcggacgcctaggaatacatgacaacacaaaccacacactg

SEQ ID NO: 54370 - DNA, 582 bp, Glycine max
  Peptide Sequence Number=SeqID_146055
atggatgagcgtccatgtggcccaggtatgccaccgaccaggcaccctctagacccggataagtttaacagggccctgggatttccagcattgatcacgggcctctgccagtcgttcggggttctcgtcacccctagaaaggtgatccaatcaccgatcacccgggccttcatcgagaagtattgcacgcctagtctgttggtaattgctgacgccatctatttgtttgtaggtatgccacccaccaggcaccctctagacccgaataagtctaacagggccctaggatttccgacattgatcacgggcctctgccagtcgttcggggttcccgtcacccctagtaaggtgatccgaccaccgatcacccggaccttcatcgagaagtattgcacgcctaggcaggcgcagggtgatacacctcaagccatagacacactgccgccacctcatcagaccgatcccgctggatcactaggcatggagcgttatctacaacacttggttcgccagcaggcagccaaccaccaagtgcaggtgcagatacatgagtgtctctaccggttcagcctcagtcagtag

SEQ ID NO: 54371 - DNA, 367 bp, Glycine max
  Peptide Sequence Number=SeqID_146056
ggtacatcctttgtggtacaagtagagggtacatctacttgggttgttgtaactgagaacaagagagggtacacctcttgtggatcatttcaagtggaggatacatccacttggttgttcagagtgaacaagggagggtacatcccttgtggatctttgcttgtaaagacaaaagatcaagctgaatgttttgatgatgccaaagggttacatgtttctcaaagcttgccaaagggttacatgtttctcaaagctttatgcaagacaaagaaatcaaagatattcaagatggatgatcaagacagtttcaagagtcttaggaagagtatattaaataggaagggaattccaattgaagtagcaaaag

SEQ ID NO: 54372 - DNA, 408 bp, Glycine max
  Peptide Sequence Number=SeqID_146057
atgggtgaagtagaggaggtacaagagaagatgaaggccgacatggaggccacgaaagagcaaatggccatgatgatggaggccatgatgatcatgaagaagataatggaagccagtgcagttgcagttaccgctaccagcactgttgctaaggtgaatctgatgcccccatctggcctcaaccaaatgaatcatccaacctcagctatggtaggcaaagatttgggaagtatgggcagcccccatgatgtgcaaattcaaaacgagcacgccttcccgccatgtggctttcctctcaactatacgccacccaatgtggcgtacactcccaataagaatgtcaataactccactcctatacccattgagagccagcaaccccaagctgatcatgcacatgtctcttaa

SEQ ID NO: 54373 - DNA, 873 bp, Glycine max
  Peptide Sequence Number=SeqID_146058
atggcagaaccatcaaagaagcgcaaaggttctttgagtagaagccaacgacactctaaggctcaggatactccaattccttcctccatttcctcctcctcattgttctcatcggaagaacaacgtacacggtacactaacctcttctcctctcgttctatcattgaccctaagttcatagatatggatttcttttctgatgagagtttcgaatgcattcaaacatttcataactcaaatctcattccctttatgtctttaaaactgactgtgtattctgaattggtaaaagccttttattctaaccttgaaattcaagaaagtaacttgatttctgaggtctatgggataaagatggtcattgaccaatccctcttatatgatttgacccaattgtctagtgacggtgtaccatttgaaggtgcactggatgatgattggaagtttgatttttctgtgcatgatgcccgtcggttggtttgcaccaaccaagcggatatgatcggaaggctgctttccggtatcgcatgcatagaagcattgcgattaaatgctcctttgccctatcctcacttagttactttgttccttctacattttaacacccctcttgattctgaaccttatgttccaatcaagagatctttcttgatcggtgctgctgtggtttcctcctttggttaccgcaaagagcatagatggctctttggtaaaaaaatgagtattttggacaggtttgatggacttcaaacctatgttggtgagaggtttgactccttggaacgtcaagtgggtgcacgattcgaggagatgaactcaaggattgccaaggttgaagaagatgtcaccatcattcatgactgccttggttaa

SEQ ID NO: 54374 - DNA, 290 bp, Glycine max
  Peptide Sequence Number=SeqID_146059
gtgttgtgggtgcttcggatggttcgtggcggcgatgggcagcaacagcggcggtggaggatgatccctttctcttcttcgatggagtgaaaaagaggaagattgggctttacgggatgtgttttggtgaagatttgagtaggatacgaaggtttgaagatttagggatggaggaggcacgaggagaagccttggctgcgcagcaagactggtttcgcaggagtgataagccttatggtaatcgattacaggatgttgtaatcgattacaggctacctgttcttgtgtaa

SEQ ID NO: 54375 - DNA, 381 bp, Glycine max
  Peptide Sequence Number=SeqID_146060
atgcataaggcattatgggccaatgcacctcttccatatcctcaattggtcaccctttttctccgtcattttctaattcctcttgatgatgaacctttttttcaagtcaagcgttcctttcctataggtgctggtgcagtcacttcatttggttaccgtaaggatcgtgatggtcaatggctaaagaaggacgcgctacctccacaagacgagcatactccttctcctcctcctcagcgagatgattcctcagcccttatgactgaagttctttcggagttacgggatggtcgctttgaaggcatggatacccgcatcacccagcttgaagaggatgtcacttatcttcgtcggagctttgaccttccaccaccatcttag

SEQ ID NO: 54376 - DNA, 177 bp, Glycine max
  Peptide Sequence Number=SeqID_146061
ggttcctctcggtgtagggtttcaacggagaacaacggcggtttgtggtggctaatggtggctatgggtgatgaagaaagtgcttgggacgttagaaatggctttggaagaaagaaaggagaaggaatggcgtttttcctaagctacacgaaagcaaaggctgaaacgctcaaatga

SEQ ID NO: 54377 - DNA, 526 bp, Glycine max
  Peptide Sequence Number=SeqID_146062
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataaacactaaaagaggtgtgaaagataaggctcccaacacacttccaatgaaaggcctttttgttacaaaacttgaaagcgatgaag

SEQ ID NO: 54378 - DNA, 457 bp, Glycine max
  Peptide Sequence Number=SeqID_146063
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctagggaacttgttgattcgtacacaggacaactatcaacaggaatcagctgaggataatatgtacctggggatcctctag

SEQ ID NO: 54379 - DNA, 483 bp, Glycine max
  Peptide Sequence Number=SeqID_146064
atgtgggcctttcataaaggtttacaaattgattgggcacatcttgttagatatcgcatgcataacgcattgcgattgaatgccccatttccttatcctcaccttgttaccctcttccttcaacatttcaacatccctcttgattctgaaccttatgttccaatcaagagatcattccttataagcgcttcagtcatagcatcctttggttatattaaggagcatgatggctcatgggtaaagaagggtgctagaaatattggtgaagaaggacatgagggagaagattcatctcttcttttgaagattttggaaaggtttgatggtcttcaagcctttgttggtgagaagtttgataatttagaattgcaagtggatatgcgcttcaatgaaatggagtcaaggatgacaaaggttgaagaagatgtatcttacatccggtcaagcttcgatcttccaccaccgccgcctccatcatcttag

SEQ ID NO: 54380 - DNA, 300 bp, Glycine max
  Peptide Sequence Number=SeqID_146065
atgaccagaccgttgctgaggagtcggttcagatgcccgctggttgtcgaggctgctatgccagccactacgctcagttcggtcgctgtccatgcgcgcccgtccatcagcgcgcacagaatagtcacccttgacggaagctactgcccattttcgggttacttcggctgcccggacatcatcatccgtgatgagaatgagccggttacggtggtcgctgtactgtaccagaatattgatgccgttccgggcaagcgtgtcagcgatttcgcccagctctccgggacgttcctgcgctaa

SEQ ID NO: 54381 - DNA, 987 bp, Glycine max
  Peptide Sequence Number=SeqID_146066
cctcaccttcagagagactactcgtccccaccttcagaggaatacacgtgctcacctttagagaaactacgcgtcctcaacttcattgcactacaagccctcgccttcagaggactacacgccctcgcctttagaggactacatgtcctccaagtcagaggactacacgtcctcccctttacggaaaggaccacacgtgagcctcgccttcagaggacgttgcaacacgcatgcagagggctacccgtcctcgccttaagaggaactccaagtcgtcgccttcagatagctatttgtccctcaagccttcagagggctacacaccctcaccttcagaggactacacgccctcgccttcagagggctacacgccctcgccttcagagcagtacgcatcctccccttgagagggctaaacgcccttgccatcgtaggacttcacgcccttaccttcaaaggagtacacgtcctcaccttcagaggactacacatcgttgccatcagagggctacaagtcatcgccttcagtgggttacacgtcctacccttcaaaggactacaggccctcaccttcagaggactacacatcctcgcattcagagggctacacgccctcgccttcagaggactacacgtcctcgccttcagagggctgcacatcatcgccttaagaggactgcacggctacacgccctcaccttcagaggactactcgtcccttcagaggaatacacgtgctcacctttagagaactacgcgtcctcaacttcattgcactacaagccctcgccttcagaggactacacggccctcgctttagaggactacatgtcctccaagtcagaggactacacgtcctcccctttagaggaccacacgtccccgccttcagagagctacacaccctcaccttcagaggactacacgccctcgccatcagagaactacacgtcctcaccttcagaccactatatgtcctcgccttaa

SEQ ID NO: 54382 - DNA, 465 bp, Glycine max
  Peptide Sequence Number=SeqID_146067
atgtccaaatcttttgaatttgggatgaccggctctctcgatgaggatctcttgctttctcataaggatggaccctcgggtactagtaccctggtcttcagaggactacacgtcctcgccaacagagggctgcacgccctcaccttaagaggactgtgtgtcctcactttgagaggacttcatgtcctcaccttcagagggctacatgtcctcgccttgagagggctacatgtcctcaccttcagagggctgcacgccctcacctccagaggactacacgtcctcgccttgagagggctacacgccctcacctcgggtactagttaccctcaccgtcagaggactacacgtcctcgccttgagaggactacacgtcctcaccaccagagggctgcacgccctcacctccagaggactacaagtcctcgccttgagagggctacacgccctcaccttgggtactag

SEQ ID NO: 54383 - DNA, 284 bp, Glycine max
  Peptide Sequence Number=SeqID_146068
atggcaaaggagtgcggaatgaccaaattttgtctccgtatgtcatcgggcccgccgcctctggatgacaaagggtgcagaatgaccaagttttgtctcggcgcgacatcggacacggctgtgtctgaatgggcaaagggtctccaccggaagatgctgacatctccggaaagggcgcaaatgaccacacaggcctttgctcatcaatcacacttagggtcactgaatgacgaggtgcggataaccgtaaggtgtctccgcgggctaccagctcttgggtcatg

SEQ ID NO: 54384 - DNA, 240 bp, Glycine max
  Peptide Sequence Number=SeqID_146069
atgagtacgcgcagccctctaaaggagagggcgtgcaaccctctacaggcgaggatgtgcagtcctctggtggcgaggacatacagtcctctaaagattgactgtccttttgaaaaaggtgataattcatgcaaccctatcctatcttttgcaaatctctccgggaactccctcagagtgtatgttgtgttttatttagtcacttgtccattttggagtgacgacaatggagccgtttga

SEQ ID NO: 54385 - DNA, 173 bp, Glycine max
  Peptide Sequence Number=SeqID_146070
gcctaggatcttcttcatcaatggattcctttgcttcttggaagatgaatggcagtggaacagagaaggaacagagagaggagatgccacttcaaggagaagatgagtctagaagaagctcatcaccacaggaggccatggataagagcttgaagggagaaggagatgaatga

SEQ ID NO: 54386 - DNA, 430 bp, Glycine max
  Peptide Sequence Number=SeqID_146071
atatgagggaatcgattctttgagatcccctaacaacttgacgatcaatgtcaccgagatgttcaagcaaatgatgaacgcaagtttctggaagatggatcatgcgcgaggagtgtccctttcaccagaaaagttcgcggtgggtggatttggtgatcattatcggggaagaacggaaatgtggagggctatcgaacccgggaatgagacccggaggatgtcctttgtaagatcaaagaagaagtacagaaagcagtttgatgcgggtttcttagctgtggcgcaatttcacccggagtgggtggccaacattgcctggtcccgaaaaaggacggcaaggtggccgaatgtgtgtagactatcgggacttaaccgagccagtcctaaagacccgccaaattttacaactcatgccaccatgatcccatag

SEQ ID NO: 54387 - DNA, 219 bp, Glycine max
  Peptide Sequence Number=SeqID_146072
atggttgctgtcgcaacctacccttcggcgggagggcgatgcgtgactcgtgggatgcgtgttccacgaaaggaatacgcgcggagtcgccaccaacgtttatttgaggaaaacgtcggaaaaaccggaaaagacgcgatctatgaacttttaagtgaaaggttcgggagttgtatttacgcacggggaaggtttttctatggttatgctttcacttga

SEQ ID NO: 54388 - DNA, 546 bp, Glycine max
  Peptide Sequence Number=SeqID_146073
atgaaagagcaaatgaccacaatgatggaagtcatgatgagtatgagaaaaatgatggaggtcaacatggctacaatcattactgcaagtactgccacagaagtggacccaactcacccacctggcttcaatcaagaaggcaaagcattcggaagtacattattgatgcatttcttccaggaaagtcttactagggcagtcgtcacctggtggaaagatttggtagctcaagtagtgcccccaagctttgctgatttagttttcatcggcgaaaggatcaaagtgggtctgagaagaggcaaatttgattatcttgctttgatgaataggaagcctggggaaaatggaaagaacaagaaggatggaggaacccatgttgtgattgtcgttcctacatggccaaatttcccaccaactcaacaatatcagcccttctcattacccaccaccctatcagccaggaacacccaatcatccacaaaggccacccctaaattagccataaagcccgcctgccgcacatccgataccaaaaaccacccttaa

SEQ ID NO: 54389 - DNA, 639 bp, Glycine max
  Peptide Sequence Number=SeqID_146074
atggctccgagaaagctccctgcaaagagatccaggaaggacaaagcggctgaagggaccagtgccgctcctgagtatgacagtcatcgcttccggagtgctaaacaccagcaacgtttcgaggccatcaaaggatggtcattccaccgggagagacgcgtccagctcagggacgatgagtataccgacttccaggaaaagatagttcgtcggcggtgggcatcgctggttacccccatggccaagttcgacccagacatagtcctggaattttatgccaatgcttggcctacacaggagggcgtgcgggatatgcgatcttgggtgaggggtcagtggatccctttcgatgcggatgccctcagccagttcccgggatatcctttagtgctagaggagggccaggagtgtgagtatggccagaggaggaatcgggtcaatgggtttgatgaggaggccattgcccagttgctgtgtataccggggcaggattttgcccagactgctgttgggagacgggtgcggatcatgcacaccaacatgactaccctgacccagatatggatgacgttgctgctcagcaacatccagcccaacgatcataattccgacctcccctctgtcgaagtgtcagctggt

SEQ ID NO: 54390 - DNA, 390 bp, Glycine max
  Peptide Sequence Number=SeqID_146075
atgggtttaggaaaaaacaacggcggcataactagcctgataaatacccaaggaaatcgtgggaagtatggtttaggctataagcccacctcaggcggacatgaaaagaagcatcgcggggaagggaaagagccagtggtcaaagctctcgttggagacaagaaaagtcaagtggtcgcgatatacgaagatgatgttccgagtacattagattcggatctttcttcatctgttcctacgtctctacccattctcattcatttgcatgtttacttctttttctggaacggcggatccgatgacgagtcccccgaaggtactaatacctgggacccgcctattgacttcgagcaagaaatgaatcaaacggaagatgaaggaaacgaggat

SEQ ID NO: 54391 - DNA, 446 bp, Glycine max
  Peptide Sequence Number=SeqID_146076
gattgtatggtcctggaatatgggtgtccgatccttatggactaactggaaggatacaatccgtaaatcccgcgtggggcgtggaaggttttgatccttttgttccggggggggtagcttctcatcatattgcagcaggaacgttgggcatattagcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagttcaatggacaatggagatggaatagccgtcgatggggatggaattgttagggccgatgttccttttcgaagggcagaatctaaatatagtgtggaacaagtaggtgtaattgttgagttctatggtggcgagcttaatgga

SEQ ID NO: 54392 - DNA, 321 bp, Glycine max
  Peptide Sequence Number=SeqID_146077
gggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccttgaagctttaaagctgtacggacgggcttggcgacgtattgaagaacatgttggcacaaagactgctgttcagattcgaagtcatgcggggatcctctag

SEQ ID NO: 54393 - DNA, 265 bp, Glycine max
  Peptide Sequence Number=SeqID_146078
atgaagagagagaaagtcctctgcagtattgcgcggtcgaaggttcaagctcagaatatcacatatccacattctttgattcagcttatactgggcaatcaatttcatggttttcccaatgaagatccttatgcacatctagcaacttacattgaaatttgtaacacaactagaattgcgggagtgccagaagatgttgttaggctcaacttattttcattctcactatctggagaagccaaaaggaggctgcattcattcaaag

SEQ ID NO: 54394 - DNA, 219 bp, Glycine max
  Peptide Sequence Number=SeqID_146079
atggatatactacgggacataatcggacatctgagtaaaaagttattgtcgtttgaatttggcgtctacgaggttttcaattacgagagtctcgatatactacgggacacaatcggacatcggagtaaaaagttattgtcgtttgaatttgctcatagcttatgttttcaatgtcaagcttcacgatatactacgggacacaatcggacatccgagtaa

SEQ ID NO: 54395 - DNA, 246 bp, Glycine max
  Peptide Sequence Number=SeqID_146080
atggctacacaaatgagcactgcttgctatctagataaagatgaaatcggtcagtcaatagatgttaagcaatatcgaggcactatgaacataggtttatggtattctagaaattccagaacatgcaccttaattggatatccgattcagactttgccggttcttaaaacagatagaaagagcactagtggattgtttcaattcattggaaactgtctagtttctgatagaagaagatcaaaatag

SEQ ID NO: 54396 - DNA, 109 bp, Glycine max
  Peptide Sequence Number=SeqID_146081
gtcgactctagaggatccccgggccgacactgacactgagagacgaaagctaggggagcgaatgggattagataccccagtagtcctagccgtaaacgatggatactag

SEQ ID NO: 54397 - DNA, 336 bp, Glycine max
  Peptide Sequence Number=SeqID_146082
ctacagtttggactacaacaagatatccctgttgatcccatgaatcttgatctacttcaccaaattgacatgcgaggcaatcattacactgattggatggaataccttgcggattggattaatatctggaaaaacaaacacaacgatgttttagttgggcaatgggttgaaggaatagtgacacatacaccagcgtacatggaatggtataggaaaaacactactttgttcttgtttgttgcacaacaactacaggatccacgcacaacaattacccaaaatattacagggtcaggtgttgaacaaacacattttgaatttccacatcctcagtga

SEQ ID NO: 54398 - DNA, 924 bp, Glycine max
  Peptide Sequence Number=SeqID_146083
atgggattaataatcccacaagattatgctgaagaagttgcaaatcgctcgattgaaggccagagagcacttcgattaatgcccaagaccttggatccaagctcacaaaagttgttcctaaagtatatgaggattttcctgagctttgacaagtttcttccccaacatgctccattcattagtcgagaggttggcccagcctggttcactgactatttccctactgtcgatccggacaatgaagaagaggtgaacgaaatatggtcattttacttgaatccacagatcctgtcttgtcgtacaggtgttcaatcgaactatttaggcctggttggataccagcctaatttggtttcaagacaatttggcctctcgcaaattcgtcctaaaagcttgttcgaagatcctcaagacgtcataagaggggccaatctttcggaaaagaccttcaagaagtttttgaagatttctcttgatgaaaactatgacttgcatccttttgagttcaaccattcccacttctgcaccatggggtttattacctggtgggaaaaatattattcgactcgttcggttggagacactactaccatgatctccaggcttgagagtggctttgcgcaaccaacggtcgagaatattcgctcaagccttcaagctcgaagcaaagcacccatgacgaagaggagtgctgaaacgtctcgagctgacgtgagacccaagaaacccactggggtgaaaatccaggaagggaaacaagaagagaagagtcaaaagaaagatgatagcattgagactaccatgacttcaaaacgctcgaagcatgcgggcgtcgaattagacgaagagaaagatgcaagaagaagaggagagaagtcttataagaaaaagaaagttacctacgacttcgaccaaatctgctga

SEQ ID NO: 54399 - DNA, 177 bp, Glycine max
  Peptide Sequence Number=SeqID_146084
atgaaacatagctccaaactcgaaggtggaggacacatgaacagcgctaggcaattacattcatggggctccgaaaaagggggagaatggaggattgctttgagggaagctgggtgtttcggtcttttcctctttgttcaggtgcggtgggatatcgccagtcgagaacgaccttga

SEQ ID NO: 54400 - DNA, 103 bp, Glycine max
  Peptide Sequence Number=SeqID_146085
acgcacccgtgagcctcgcctcgctcgcccgcaaaagggtaggttgcgacagtacccaagggtccacccttatgagaaaccaagagatcgactcatcgagagg

SEQ ID NO: 54401 - DNA, 210 bp, Glycine max
  Peptide Sequence Number=SeqID_146086
atggaagaagatctcaagaagattctcaagttcttagattctacaaatgcaacccaacttggtcacatcaaagcaaattgtccttcaaatgaagaatggcctgagaaaagcgataagaaaaggtatgatgaaagaaggaccaagaagcgtgcattgcatgggatgacaatgactcattcgacggttccgagaaggagatcaaccttctaa

SEQ ID NO: 54402 - DNA, 375 bp, Glycine max
  Peptide Sequence Number=SeqID_146087
atgtccgttcgaagccctacgctcaatggcttcgattacatctattccccacatagagaagggccagggtgctgccaatacattcaaaggcatgggcgaagcattgacattgtttgtgaatgcctgacacttgtggcattttctcacatggatgcaacagtcattttccatggtgagccagtagtagcctgcccttcgaatcttcctagccatggcatgcccattagcatgcgtcccaaaggaccctttatgcatctccacgagcattcactcggcttccttagcgtctgtcgcaacctacccttcggcaggagggcgacgcgtgactcgcgggtgcgtgttccaagaaaggaatacgcgcggagtcgccactaa

SEQ ID NO: 54403 - DNA, 486 bp, Glycine max
  Peptide Sequence Number=SeqID_146088
atgtctttttgggttattctcgtcttgaaaagggttacaagtgttactctccaaccagaagacgatactatatgtctacggatgacacgacaagttggttctatagtgcctgaattttctcctcgtgattctcatcctcctccaaccaatcctcaaaccatggatccttcttctcatcactctgattcagattggcccattgacatcaggaaagctataattgatgaaatacaggctcttgaaaataatggtacttgggaacttattccccttcctcctggcaagacaactctaaaatcactaccgttcgtctgtttcttgctatggctgccatgcgtcactggcccctccattagcttgatattaaaaatgccttccttcatggtgaccttgaggaggagatttatatggagcaacctcctgggtttgttgctcaggaggagtatggtcttgtgtgtaagctacatcgatctctctatgggttga

SEQ ID NO: 54404 - DNA, 639 bp, Glycine max
  Peptide Sequence Number=SeqID_146089
atggaaaaacgccagcaacgcggcctttttacggttcctggccttttgctggcttttgctcacatgttctttctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtacctagctgggtgcagaacttcaagatcgcaattgggaaaattgagaagcatgtgatcaacaatgtggacatcaacatagagccctatcagttgggggagagtaacccggacaatgttccttcattttggatcggcctagatgggaagaagaagaacaaggggtgcaaggacaaagtggactgtgaaatccaagaagttgtgaggaccttgctttgcctcaaacaagacccttcaggatgggttgttcttggtagagggcgtaacttgaagattctgggtcatgctgagcccatgtatcaaaccgtgcttgggggatcctctagagtcgacctgcaggcatgcaagcttggcactggccgtcgttttacaacgtcgtga

SEQ ID NO: 54405 - DNA, 96 bp, Glycine max
  Peptide Sequence Number=SeqID_146090
tgcttccgtaacgccttcataagcgattatgtggaaattcttcatccttcttcgtcgttcttccacgttcttcgttcgttcttcgttcttcaatgg

SEQ ID NO: 54406 - DNA, 422 bp, Glycine max
  Peptide Sequence Number=SeqID_146091
atgaatgacaaagaggaagtacaggaacagatgaaagtcgacatgtcggctttgaaagagcaaatggcttccatgatggatgccatgctaggaatgaggcaactaatggagaataacgtggccaccgctgccgctgttagtttggctgccgaagcatacccaactctcccagctaccacacaccatcctatcccaaacgtggtaggacgcaaaggagcacactggggcacatcagcaacccctatccgggatacaaccgagtggcttacccctatggattaccacctaattacacgccaccagtcatacgtgatgacacgggtcatgtccctccccccatccttaaaggggagcctcctcgacagtcggacgaggctcacgaggatcgttgagagcatgcccaaggagacatcgattcctac

SEQ ID NO: 54407 - DNA, 593 bp, Glycine max
  Peptide Sequence Number=SeqID_146092
gatttgttctgaatgctgagggcctggcatggaagctattgaggaaggacctcactactctggcacagacttggagcattctatcttatttcaaccttgcccctacattatacacttctaatctgaacttggacaggacaaggttggtatatggattagtgatgaagatggacatgaatgttggagccctaatctctgaacagatcactcttatggctcagtccaactccatgaggcttggatttccagccctcatcactgccttatgcatggcccgagtagtcacctcagattccttgactttgagtcctttagcggttagaggatctgagggtccatcttctgttgctccccagacatctactgcactagctcctattccttcaacaccagtttccactatttccgcatcagccaattatgagcatggaggagttttctttgtaggtggcctagctaggagttcagccttcttctcatggaggagtgcacctcctgctcaggaggatgattcaaaggtcactcccccagagtcatttgtaccagaaactgatccagaggcagatccaatgattgcggaggccagtccatag

SEQ ID NO: 54408 - DNA, 498 bp, Glycine max
  Peptide Sequence Number=SeqID_146093
atgaacattggagcactgatctctggccagatgacctctatagcccagtctaacacttctaggcttgggttcccttctctaatcaccgaattatgtaaagccagaggggttgtctctgatagcctcagttttgagcgcctaagcccggtcattaacttggcctacatcaggaagaactattggaaccctgaggatctaatagtttctatccgaggggctaggagggcgagggcaaggccagctaagctttcttctacttctacagctcctactccagcacccacttcagcagccccttctgtcccagctcagatagattctcaacactttgaagccatgcttcagaacattcatcaggaacagatcattctattacagagtttacaggtggtggcgcctccaggatctattccttcagtggagcagttcactaagatggtagcctggcccgggacccaaccttctcttcacagggaagatggaggtcccacagcccag

SEQ ID NO: 54409 - DNA, 303 bp, Glycine max
  Peptide Sequence Number=SeqID_146094
atggctccaaagaaactatccacgaagaggtctagaagagatgccacaggagaaggatctagtgctgcctcagagtttgatagtcaccgtttccagagtgccaagcaccagcagcgcttcgaggtcatcaagggatggtcatttcacagggagaggcgtgtccagctcagggaagatgagcacacggacttccaggaggagatagctcgcaggcattgcacacctctagtgactcccatggccaagttcgaccctgagatagtcctagagttctacgttaatgcctggcccacagaggagaga

SEQ ID NO: 54410 - DNA, 296 bp, Glycine max
  Peptide Sequence Number=SeqID_146095
cttcctacaacgaagagaagaaagagatgaaagattgtggaaatacaagtagtagggatgtctcctccatctccaggcctcacaatcactcacaaactcatctcaagctctcaggatggcttcctcttccaactctggtcaagcttcctcgaagcggtcaaaaggtgcatcatcaaacaagtccccggagaaatctaggaattcctcttgttggactaacttgcgccaggaccacaataagacaaacggatggacaacgaagcggtaggttaccgggtgaccccgattcctcatga

SEQ ID NO: 54411 - DNA, 570 bp, Glycine max
  Peptide Sequence Number=SeqID_146096
atggtctcccgtggcggagatgaaagggacgaatgtttgtttcacctcggggagtcacacgacatggaaacctgtcccgcggtggaagaattgcttcaacggctcatggactgggagcagctagaagtgtccaaaggagggagggaagaaccacagatttgcatgcagtcggaagaaaagaaggttcccccaacccccaaagccctagtaatatgttttactaggaaagggaccggctccacgcccatatacccccagacagcgcccaagctgacgtcgtttgcatatcaaaccaataaggccattccgtggaagtatacccctcccacatttggagaaagagttgcaaccgaagttgactccctgtcagccaaggtgaccaacatcaccggcctcagtggcgtaacccgcagtggccgggtgttcgctccccctcactcggcggaattgccctccaaggggaaagcgcccatggtccaagagcccacagacgtagccaccccctcaaaagaagtggatcccccgatgttaaaaggggctgaaaagaaagagggtcttcaaggaaagacg

SEQ ID NO: 54412 - DNA, 603 bp, Glycine max
  Peptide Sequence Number=SeqID_146097
atgaggggcaagttactgcgcgggtgcagcgtattttgtggcctactgttgctctggcagctggcgagctacagcggcattcccacttttttgttgccttctcctgcggcggtcgctgaagcgctgtggaataaccgtagctatctggccagccatacccttgtcaccctgagcgaaattctcagcggaatggcgctcggcgtcgcgctcggtatggtgctggcgctttgtatgaccatgtcgccgcgattacagcggtgggtaatgccgctggtactgaccagccaagccattccggtcttcgccctcgcgccgctactggtgctgtggtttggttttggtatgagcgccaaggtcatgatggcggtgctggttattttcttccccgttacctcggctttctttgatggtctgcaacgggtcaatcgcgactatctcgatctggctcgtaccatgggctcctcctttggtgctcaattgcgccatgtccgactcatggcggcgctacccgcgctcggttccggcctgcggatggccgccgccgtcgcccccattggcgcgattattggcgaatgggtcggctccgccgaggggcttggctac

SEQ ID NO: 54413 - DNA, 520 bp, Glycine max
  Peptide Sequence Number=SeqID_146098
acttatcaaggtaatccttgtggcgtctaccctgacttatcttccttcaccggaagtggcgtcatccaaaaattctacagcctgtatcaagcgatccgctcctactcaggttcacatcaagaaacaatatcagtgggctttacaactcgatgtcgagtgttgggttatgggtacacctgagaaggagagtcccaaaacacaggaagtccaagcttcaccgttagaggagaggacattccagtgttgtagaagatcaacgacaatgtcgctacaaaatgattgcctagtgagtataattaagtcaactttcaatgtcggtactgatctatctctttttgatgcagatggcggagccttggatttgaggacaaatccttttcaagaaggagggagtgatgaggacataaccaaggaccatgaagcacttgaaggtcccatgaccagaggcagacttaaacaagcccaacacgtcatagagacaaggctggtcatttgtatagctgccattgatgatgattga

SEQ ID NO: 54414 - DNA, 521 bp, Glycine max
  Peptide Sequence Number=SeqID_146099
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaaccaacaagaggggtattgagattgagattcaagtaatggggaagagcaaggttcttgtggtggggggaactgggtacatagggaggaggataggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 54415 - DNA, 183 bp, Glycine max
  Peptide Sequence Number=SeqID_146100
atggtagtcgatgtcggcccgaaagatgaccaatccaggaaagatgaccgatccaggtctaaaaatgaagaatcaccggaagacgccgatcgaacatttcctaatagacatcgtctaaatattattgggggattgaatagaagaaacaatagtggacattggtcgttaaatagccccgattga

SEQ ID NO: 54416 - DNA, 76 bp, Glycine max
  Peptide Sequence Number=SeqID_146101
agttcagataagaatcaagaagaattcaagactcaagataaagttaagagtcaagaatcaagattcaaggttcaag

SEQ ID NO: 54417 - DNA, 333 bp, Glycine max
  Peptide Sequence Number=SeqID_146102
atgttggtgcgcatgatccgcactcgtctctttgcagcggcacgggtgaaatcttgccccggtatgcatagtagctgtgtgatagcctccctttctggttgtgcttgcacagttggccctcctccaatatcagggggtggcctaggaaccgtgtggatgtggagcacactgaaaatgaggacacgtagccctctaaaggtgagggcgtgcagccctctcaaggcgaggatgtgtagtcctttggaggtgagggcgtgcagccctctgttggcgaggatgtgtagtcctcttcaaggtgagggaatgcagccctttgttggcgaggacgtgtag

SEQ ID NO: 54418 - DNA, 246 bp, Glycine max
  Peptide Sequence Number=SeqID_146103
atggctcctaataaagtatttcctctagttatgccatttgggcaaaacaatgcattgaaatgtgagaatatggatgagtccatactgtggcacttgagatgcacaggataccatttccaaaaacatcttggagagctaaagctccacttcaattggtgcatgttgatatctggggaccatcaagtacccccagctttggtggaagaagatattttctcctcttcgttgatgactacactcgaatga

SEQ ID NO: 54419 - DNA, 126 bp, Glycine max
  Peptide Sequence Number=SeqID_146104
atggcgccaaaaacttggtcgaaccaggcaagtgcatcggatcgcgcaagtagtataaaacggtgcctgatgttaaaaggatattctctacttaacaatgctcatgtgtgctatggtgtctcctga

SEQ ID NO: 54420 - DNA, 462 bp, Glycine max
  Peptide Sequence Number=SeqID_146105
atgactagaggcaatccatctaacttacaaccctttgatcctgaaatagatagaacatttcatagattagttaggcatagtgtgcatcctactttccctaaacattttgtgccttttgaacatcctgagcattttgttactggtgagtctgtgcattttgtggttggtgattttgaacatcctgattttgagcattctaattttgagcattttgactttgaacattctgaaaatatggctcaacctccacctcgtgagaggactctaagggaaatggctgcacctgatttcacttatgaaagcttgtgcattcaataccctgatgaggatgtcccatatgttcttaaaactggactgatccacatgttgcccaagtttcatggtcttgaaagtgaagaacctcataaacttcttaaagaattccatattgtctgctccaccatgaaatctccaaatgtctaa

SEQ ID NO: 54421 - DNA, 189 bp, Glycine max
  Peptide Sequence Number=SeqID_146106
atgaccataatttatctctgcatgtcatcgggctcaccgcctctggatgacaaaaaggcacagaatgaccataacttgtctctgcgtgccatcggacacgattgtgtctggatggcgaaaaggcgaaaaggtgtgtggaatgaccataatttgtctccggatgtcatcgggctcgccgcctctggatga

SEQ ID NO: 54422 - DNA, 456 bp, Glycine max
  Peptide Sequence Number=SeqID_146107
atgtcacgaaaccttacggatgacgcaattgtcccctctttggcttccggaatgttacggaactttacggattgcgcattaacacttcctttcaactcccgacatgtcgcggaacttcacggattgcctaacgatgggtgtcaagtacctcaaagtggtcaagtgaaggtcgcatcccaccaaatagatggtcctcggacgaaattaggcaccgaacgaccaacatcatccaaatactgccgaattcgttcctctcggttgacgaaaggcatgaatgaccataagactcaattgtccctggatggcaaaaaggtgtgcggaatgaccataatttgtctttgcatgtcatctggctcgccgcctctggatgacaaaagggcgcagaatgaccataatttgtctctacgtgccatcggacacgatcgtctctggatggcgaaaaggtacgcggaatga

SEQ ID NO: 54423 - DNA, 414 bp, Glycine max
  Peptide Sequence Number=SeqID_146108
atgaagcagaaagaggaaacaactaaatcaactcaacgagcactccaaagtgtagaaatccaggttggtaagctggcaaaagaagtgactcaatttatgttcagacgagaaaaatatgttgtaaaggttgaagctcaaaaggaaagccctgcaaaagagcatgagtcaagagaaaaagatgaggaacaagcacaacaacaatgggagaagtactcaacagtagaaaaccaacaagaaaatattctccaaatcaataaccttcctcatcaactgattgtcaagaaaggaaggcaaggagagcatgaggaaaccttaagtgccattctttctttaatcactaacacctttcttgaaatgatttggaatgtacttccaaactatatgaagttcatggaatttctagctaaaaggtga

SEQ ID NO: 54424 - DNA, 400 bp, Glycine max
  Peptide Sequence Number=SeqID_146109
atgacggtgaaaacctgtctgacacactgcagcttaatccggagatcggcacaacgcttgtctgtgggagaggcggttatgccgtattggagcagacaagtcttccgcttcagggctcgcgcggtggaaataccggttatccacagaatcagggtaacgcaggaaagaacatgtgaccgcaaacaggcgccattcgccattcaaaggctgcagcaacctgtgggaaaaaggcgcgatcggtgctgggcgtttttcgctattagtccgccagctgcagcgacaaaaagggatcgtgctgcaagggattcaagtcctatgtctccactccatagccaagagcttacggaacctgttttctcccttcgggaagcgtggcgctttctcatagctcacgctgtag

SEQ ID NO: 54425 - DNA, 751 bp, Glycine max
  Peptide Sequence Number=SeqID_146110
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccagatggcatgtagggggtgctgggagtgccttttgaagctgtttaacttcatactgaccctcactggtctggccattgtgggctacggaatctatctttttgttgaattctctaaagcttcggatgatgacaacacgcctgcaatttctcccgtcagtgatgattctgctctgattcaacttggccggcctgtgcttatggccgtgtctctatccaacggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggaaccgtaaaaaggccgcgttgctggcgtttttccataggctccgcccccctgacgagcatcacaaaatcgacgctcaagtcagag

SEQ ID NO: 54426 - DNA, 588 bp, Glycine max
  Peptide Sequence Number=SeqID_146111
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 54427 - DNA, 493 bp, Glycine max
  Peptide Sequence Number=SeqID_146112
ggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccacatgggcatgttagcttggcactggacgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 54428 - DNA, 211 bp, Glycine max
  Peptide Sequence Number=SeqID_146113
tggagtcgccaactgccgcaatgtgcctttttgcgggcgagcgaaggcgaggctcacgggtgcgctttccaaaggaggaaagatgcacggagtcgccaccaacgaaggtattagcacctctcatgtcgacaaaagcggggctcttgctcctacgtaccctccatcaaagaggaaatcagacctacgtagttcttccttatgcgtgaatcaa

SEQ ID NO: 54429 - DNA, 276 bp, Glycine max
  Peptide Sequence Number=SeqID_146114
atgtataatagtataataacctatattggtctcctctatagtgcacattggcaaatggtcatcattttgcctaaggaaaatgtcatcatctggttttgtttgttgcataataggtcagataactacctcaaaggaataattagcagtgctttgaaagaacttgacgatactccacaaagtaaatccaaggttgctactaggtggattgttgttaaatgtaacaaaaaggaagcactgagtgtgagtattacgtcatgcactggatgtcaactataa

SEQ ID NO: 54430 - DNA, 423 bp, Glycine max
  Peptide Sequence Number=SeqID_146115
atggccccgaggaagcttgcctcaaagagatctaggaaggataaagcggctgaaggaactagttccgctcccgaatatgacagccaccgctttaggagcgctgaacaccagcagcgctttgaggccatcaagggatggtcatttctctgggagcgacgcgtccagctcagggacgacgagtataccgatttccaggaagagatagttcgccggcggtgggcatcactggtcacccccatggccaagttcgatccagacatagtcctcgaattttatgccaatgcttggccaacagaggagggcgtgcgagatatgagatcctgggtgaggggtcaatggatcccgtttgatgcagatgctatcggccagctcctgggatatcctttagtgctggaagagggtcaggagtgcgagtatggctag

SEQ ID NO: 54431 - DNA, 245 bp, Glycine max
  Peptide Sequence Number=SeqID_146116
ggatcgcgctcgcaagacacccagtggacccggagaagtccaacagggtcttggggtttctagctctgattacgggcctttgtcagttctacgaagcacccatcgcccccaacaaggtcattaggccccccattaatcaggctttcatcaagaagtactgtgcccccggaaggcgcagggcgagacaccacagcagcctggggatggctgacagcaggcaacaggcacaccgccaccacctctag

SEQ ID NO: 54432 - DNA, 228 bp, Glycine max
  Peptide Sequence Number=SeqID_146117
atgtcttcctcccccgacacaatgaccaaatgcccctctactacgaacttcagtttttggtggagtgtagagggaatgactcccaccgagtggatccacgggcgtcccaaaagacagctgtatgggggcctatctatacagggaggtcgatctctaccctcacctctcggcggctgccgtcgaaggcatggaccaccatggaacttggccttagatgggaagcgttaa

SEQ ID NO: 54433 - DNA, 431 bp, Glycine max
  Peptide Sequence Number=SeqID_146118
ggatcgcgcccgcaagacacccagtggacccggagaagtccaacagggtcttaggattttcagctctgattacgggcctctgtcagttctacagagtgctcatcgcccccaacaaggtcctcaggcccctattaacggggctttcatcgagaagtactgtgcccccaggtaggtgtagggcaaggcatcacggcagcgggcaacagacgcaccgccaccacctctggagttcacctcagctcatccataaaaaggtagcaagataccttagatatgcatatgtgatctcgggtgtcgcaacgtgcccttcgcgggcgagcgagggcgaggctcacgggtgcgctttccaaaggaggaaagatgcacggagtcgccaccaatgtttatttttggaaaacgtcggaaaaactgaaggaaaccggtcaagatga

SEQ ID NO: 54434 - DNA, 498 bp, Glycine max
  Peptide Sequence Number=SeqID_146119
atggcgcctaccaggcaccctctggacccagataagtccaacagggccctgggatttcccgccttgatcacaggactctgtcagtcgttcggcgtccccatcacacctagcaaggtgatttggccgcccatcacccgagcttttattgagaagtactgcacgcagagacaggtcccgggtgatgcaccacaggccgcggacgcgccgccacctcatcaggctggtccagccggattgtttgatacagagcagtatttgcggcatttggttcgccagcaggcggctaaccaccgggcacatcctgcagagccagggctttacttcttttccgtgccctactccggaccagttcagggcagaggtcgcatgcctggagattggcctgaggcccaggcaggagaggcaccagcagaggctcccgacgaggcagatgaggcccgcgaggacgaggagatgaccgatttactggatttcttaggaggaagcagggccacgtga

SEQ ID NO: 54435 - DNA, 288 bp, Glycine max
  Peptide Sequence Number=SeqID_146120
ctttcgaagaagtttacggaaactcacggattgcgcaaaaacacctcttttcgatttccgccacattacggaatttcacggatcgcgcaagcctgcttccttttgatttctgagacgtctcgggacttcatttattgcatgtcatcaattgagatcaaaagtgaatccacagataagagcttcaaggtcaatggacatcggctgaaaccattcctcacaaatccctccttagtggatgtagtggtggaggagacctctatactttatcctacttctcttccgccatga

SEQ ID NO: 54436 - DNA, 502 bp, Glycine max
  Peptide Sequence Number=SeqID_146121
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggacccattccatccaggcctctttgttggggacgctggaggatttcaaagtcccacacgtgaaccac

SEQ ID NO: 54437 - DNA, 474 bp, Glycine max
  Peptide Sequence Number=SeqID_146122
atgaccgaccctctcaatgagtcaatctcttgctttctcataaagaggactacacgtcctcaccttcaaagggctacacgtcctcaccttcaaagggctacacgtcctcaccttcagagggctacacatcctcgccttcagagggatacacgtcctcaccttcagaggactacacgtcctccccttcagaggactacatgtcctcaccttcagaggactacacgtcctcaccttcaaagaattacatgccctcgccttcagagggctgcgtaccctcatgatgaggacatgaccaagagcaagggcaaggatcaacttgaaggagttggaggacctatgacaagggctagagcaaggaaagcaaaggaagctcttcaacaagtgttgtccatactatttgaatacaagcccaagtttcaaggagaaaagtccaaggttgtgagttgtatcatggcccaaatggaggaggactaa

SEQ ID NO: 54438 - DNA, 120 bp, Glycine max
  Peptide Sequence Number=SeqID_146123
atggcaataactcaagctacatggctccaaatgaggttattccaaaacgagaacaaggttgaagatgaaaggaaggaaagaatcactctttccggcgagggcaacacacaaatgttgtga

SEQ ID NO: 54439 - DNA, 660 bp, Glycine max
  Peptide Sequence Number=SeqID_146124
atgaaaacaaaaccactcgccaatcatggaggggcagcagttaatgtcgtagaatcggataggccgcgcaggtctaagcctttaaaggatgtgacgacccccatgaggtttatctacaaggccctacaaaaggggggcgtaattccccacggtgggcatgaagaggattcttgtttgttgcatcccgacaagctacataacatggaaacatgtttagcagtggaggaccttttgcagcagatgatagatcaaggccgattggaagtcggcgataaggggagggaagagcagcatatatctccacaaaagccccgatacccctcggtagttaaacctgttcctttcccataccgaaacagccacgcagtcccgtggaggtatgcacctccaagtgaaaggaaagaagaggccaccgacatcagctcgttgtcagctaaggtgaccaatatcacggggttgagcggtgtgacccgcagtggtcacgtgtttgcgccccccgacctgtcgacacaacccacaaacgttaaagggaaggcaaagatggtggaagaacaaaatgacaaaacgaccctcactccgaacgaggatactccagtgaaaggtcttccggagaaaagggatggttgtggcaagaaggaagtgtcgctggggatcctctag

SEQ ID NO: 54440 - DNA, 240 bp, Glycine max
  Peptide Sequence Number=SeqID_146125
atggctcaacctccacctcgtgagaggactcttagggagatggctgcacctgatttcacttatgaaagcttgtgcattcaatatcctgacaggggagtggcgaaaaattggctatactaccttgctccccggtccattttcagctgggatgaccttaagagggtgttcttggagaaattcttccctgcatcaaggaccactgccatcagaaaaagacatttcaggcatcaggcaacttag

SEQ ID NO: 54441 - DNA, 455 bp, Glycine max
  Peptide Sequence Number=SeqID_146126
gggtcacgcccacaagacacccagtggacccggagaaatccaacagggccctggggtttccagctctggttacgggcctctatcagtcctatagggttcccatccccctagcaaggtcacgccatcatgacataggtaagtttgcagggatcgcgcccgcaagacacccagtggacccggagaagtccaacagggtcctagggtttccagctctgattacgagtctctgtcagttctacggagtgcccgtcacccccagcaaggtaatcaggcctcctactaaccgagttttcatcaagaagtattgcgcccccatgcaggcagagggcgagacaccacaacagcctggggatggccagcaacaggcagcaaatgcaccgccgccacctccagagcccctcagctcatccacaaaaaggttagagtattgcctacgacacatggccgaccaatag

SEQ ID NO: 54442 - DNA, 264 bp, Glycine max
  Peptide Sequence Number=SeqID_146127
gcgtatcacgaggcccttcgtctcgcgcgtttcggtgatgacggtgaaaactctgacacatgcagctcccggagacggtcacagctgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 54443 - DNA, 1023 bp, Glycine max
  Peptide Sequence Number=SeqID_146128
atggctacctcaccaaaagaaacttccgcttctggttcacccgctgtaccatcatctccgcaccaggaacaaccggaattcaacattcaacccatacaaataattcctggtcaagcttcagtccctgagaaactgattcccagaagacaacagggggtgaagattgctgaaaaccctagccctgcaacaagtcctagggaagtagacacggagatggacaagaaaatccgcggtattgtgagtagcattctgaaggatgcttctgtgcctgatgctgagaaagatgttccaacatcgtccaccccaaatgtttctgtgcctgatgtcaataaagatgttccaacatccggcgcgcgaaatgctgaagccctcccttcacccagtgaagaggaatcaacagaagaagaggatcaagcctcagaggagacccctgcaccaagggcaccagaacctgctccaggtaacctcattgacttggaagaagtcgaatctgatgaagaacccattgccaacaggttggcacctggcattgcggaaagacttcaaaagagaaagggaaaaaccccccttaagaggtctggacgaatcaagactatggcacagaagaagagtactccaatcactcctgcaacatccagaagaagcaaggttgctatcccctccaagaagaggaaagaaatttcctcatccgattctgatgatgatgtcgaactagatgtcgcgacatcaaagaaggccaagacttcagggagaaaggtgcctggaaatgttcctgatgcaccattggacaacatctctttccactccattggcaatgttgaaaagtggaaatatgtgtatcaacgcagacttgcggttgaaagagagctgggaagaaatgccttggattgcaacgagatcatggacctcatcaaggctgctggactgctgaagactgtcagcaagttaggagattgctatgaaggcttagtcagggaattcattgtcaacattccctctgacatatcaaaccagaaaaagtga

SEQ ID NO: 54444 - DNA, 267 bp, Glycine max
  Peptide Sequence Number=SeqID_146129
atgaccgatcgaggtcgacgaggtttttttgtgcgagctcaatcgacgttttgttgcggccgaaactggcatattcgcatttatgcggccaggaaagcattagcccatctcggcaaaaaaatatttttcaccgataatgatcgaaaaaaatgccagtcgacgtcggccaggaaagatagaccgatcgaggttaaaaaggaaacatcacccatgacgccgatcgaacatttcctttccgacatcatgcatatttcattaagggattga

SEQ ID NO: 54445 - DNA, 510 bp, Glycine max
  Peptide Sequence Number=SeqID_146130
atggaggccatgaaagagcaaatggccgcaatgatggaggccatgatgagcgtgaagaagataatggaagccaatgcggttgcaattgccgctaccagcgttgttgctaaggtgaacctgatgtccccatccggcatcaaccaaatgaatcatccaacctcatatatggtaggcaaagatctaggatccgacttcgagccttgcctcggatatgccactgaagggcaagcagttggtggtatacccctgcaaaacactttgaagggccctcagtatcacccccagctacacctcttgccttctacaacaagtaaaaaccctcatcctatggcaaaagtggaaaagttggatcatttagaggaaaggcttagggccattgaagaaggtgaagattatgcctttgctaacctagaagagttgttcctagtacccaacatcatcacccctcccaagttcaacgagccagaatttgacgagtacaagggactacttgccccaagaaccatctaa

SEQ ID NO: 54446 - DNA, 207 bp, Glycine max
  Peptide Sequence Number=SeqID_146131
gacttagaggcaacaacaattccagaggaagaacctcaatcttctgaggcatgttctagttttgctattgcagaacattctcatttagatcctactgaagactacatcatggctgaagagcctagaagagttactctggaatattattcaagttctaatgtgccacaatttttcaccagcattgcacaaccagaagttcaagcataa

SEQ ID NO: 54447 - DNA, 827 bp, Glycine max
  Peptide Sequence Number=SeqID_146132
gattgtatggtcctggaatatgggtgtccgatccttatggactaactggaaggatacaatccgtaaatcccgcgtggggcgtggaaggtcttttccatcttagtgtgcgtccaccccaacgtctatataaaggattacggatgggaaatattgaaactgtcctttccagcagtattgctgctgtcttttttgcagcttttgtcgttgctggaactatgtggtatggttcagcaacaacccctattgaattattcggtcctactcgttatcaatgggatcagggatactttcagcaagaaatatatcgaagagttggtgctggactagccgaaaatcaaagttcaatggacaatggagatggaatagccgtcggttggttaggacatcctgtctttagagataaagaggggcatgaactttttgtacgtcgtatgcctactttttttgaaacatttccggttgttttggtagatggggatggaattgttagggccgatgttccttttcgaagggcagaatctaaatatagtgtggaacaagtaggtgtaattgttgagttctatggtggcgagcttaatggagtcagttatagcgatcccgctactgatcgtgctactttgaaatcagatggtgtttttcgtagcagtccgaggggttggtttacttttggacatgcttcttttgctctgctattctttttcgggcacatttggcatggtgctagaactttattcagagatgtttttgctggtatcgacccagatttagacgctcaagtagaatttggagcattccaaaaacttggagatccaactacaaaaaaacag

SEQ ID NO: 54448 - DNA, 1050 bp, Glycine max
  Peptide Sequence Number=SeqID_146133
atgaaagatcctaatgctttaggggttatgctaatagaagatgtccctgagttgacagaaactaaaccaagggttgcgaattctcaaatttttgcattaattgatgcggatgtcgcctttgcagaaagtaatttgacaaccagtggtgattattacaggattacgaaaaattttttaaatgcctttaaagcaaggtattatttatacagaggtatgtatcctcaagctaaagctgcggcacaggcggtgttaaatacttctggtttatcacttacggtggcaagtcctcctaatccagatactggtaatccgagagaattaatattttctttaaacaggccgcaacttcaaagctggggaaatattgtaactctgtttgcaaccaatgcgtcgcaggctaatggatctattttgtatgatatgggtagaaaaacttttaacctgtatgctagtactcctggagatattaggaggtttgcctatattgatcctactgctgtaattaattccaattacgcggctatagataattacagagctctggatgtgcttgtgatagataaatatcctggcagagcaactttggcgcctgatccaattcctacagaccctacacgagaaaaggttttaagtcagaatgtattaagaaacgatattccaattttcaggttatctgagatgtattttattttagctgaatgcgctgttgaagaaggtagtttcactacggctgcaacacttataaagaatgttagggatgcgcgtaactacctgggtcctgtggatttaccggtgtattcaagtaaacagcaggcatatgttgatatccttttggagagaaggaaagagctctatttggaagggcatagatatttagacttaaagagattgggggcaattgctggagtggctattgatagggatcccacagacgatgtgaaaacgatcccggtgactataccaattaatgattatcgtatgaggtcgctgcctattccaagagctgagctgcaaggaaatccaacaattcaacagaatcctgggtattaa

SEQ ID NO: 54449 - DNA, 582 bp, Glycine max
  Peptide Sequence Number=SeqID_146134
atgattcctggttcagcccctgttcctgaaaaactgatccccaaacgacaacagggtgtgaagattgctgaaaaccctagccttgcaacaagtcctagggaagtagacacggagatggacaagaagatccgcagcattgtgagtaacattctgaaaaatgcctctgttcctgatgctgatgaagatgtcccaacatcttccaccccgaatgtttctgtgcctgatgttgagaaagatgttccaacatcttccggcccaaatgctgaagtactctcttcccccagcaaagagagatcaacagaggaagatgatcaagccacagaggagacccttgcaccaagggcaccagaacctgctccaggtgacctcattgacctagaagaggtagaatctgatgaggaacccattgccaacaggcagaaagggaaaacccccattaagaggtctggacgaatcaagactatggcccagaagaaaagcactccaatcactcctaccacatctagacggagcaaagttgcaatcccctccaagaagaggaaagaatttcctcatctgattctgatgatgatgtcgaactag

SEQ ID NO: 54450 - DNA, 291 bp, Glycine max
  Peptide Sequence Number=SeqID_146135
atgtcgtacaggatgtcacgacatcacgcttcagaacatgcagattgtatgtgtccgtatgaacagattaaacaagtaaataacacaagagaattgttaacccagttcggtgcacctcacctacatctgggggctaccaagccagggaggaaatccactctcaatagtgttagttcaagcctccatgattatatagccgtgtacgattctgggctgcaagttcttgatgctggaggagatctatcttcttctgaaaaatctgcagttaaagaactaaaagataacttttga

SEQ ID NO: 54451 - DNA, 558 bp, Glycine max
  Peptide Sequence Number=SeqID_146136
atgacaggcgccgtcgatgctattcagacagagggagtggctactgatgggagcttggggtcacctgccgcagatgagggtttccccggtggaccacgcgacccatcgattttgaccgattttgctgtgcatgtcgcacacagcatctggagtggacaggaacaacccgatctgaagttggtctcccacggtagaaaagtagataaaattgggagaccagcgcctgagatcgaagggttgattgctggcaccgaattgagtccactgatcaggtgttctattatcaccactgattctggacttatatccgccttcatcgagaggtggcatcgcaagactagcacgttccacctgccagtaggcgagttgacgatcatgctggatgacgtggcgtcactcctacaccttcccatcactggcgcgctgcatacgttcgagccgcttgttacttcagacgcgattggtctactgacggagcttcttgaggtcagtcatgaggaggttacatttgagacccgacaggctggtgggcctcatgtccggttggggtggctttag

SEQ ID NO: 54452 - DNA, 246 bp, Glycine max
  Peptide Sequence Number=SeqID_146137
atgcggggttaccctatggttacccgcaccattggtccaccaggggcaaacgaatccgttggcgcgcggagactaacatcgtcttctgcaccttttgtcgtcctgacccgtgaatcaagtgacatgcggggttaccttatggttactcgcacctttcgtcaacccggggcaaagaatcccgttgatgtgcgaaaactaacatcgtcttctgcaccttttgtcgtcttgacccgtgaagtcaagtga

SEQ ID NO: 54453 - DNA, 558 bp, Glycine max
  Peptide Sequence Number=SeqID_146138
atgaaagataagagggatgaggaagaaaaactagaaaaacaaaagaaaaagaaggatagtaaggccttgtcttcaaaggccaaggggaaggaaaaagaggaaaaggattcctccaagaagattgtaaagaaggaaaaccattttgcaacaaaaggtgatatcaaaagagcactccttcttaaacaatccttctaccttctcctatcaagggaaacatcccttagcactgtcatacctcttgagcttgaagttattactcaagtaaaggagttgttggatgagggtttggttcataagagcttaaatccttgtgctttgttggtgcccaaaataggtattatgaggcaccaaatccctatgataggtgcaccactcattgagttggtgaggaaccatgttccctcatggaagatgcccaggaaatggggggatggaatgatgcaatcctacccctcaagggcattgaatagaagactccaagaagattgggctagagatgcaagagaaggcgctatggttctcatgagccttagggtagatttcgggcccgtgggctaa

SEQ ID NO: 54454 - DNA, 526 bp, Glycine max
  Peptide Sequence Number=SeqID_146139
atggtgaactaggcctgagcggggcgaagccagaggaaactctggtggaggcccgcagcgatactgacgtgcaaatcgttcgtctgacttgggtaggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtggtagtagcaaatattcaactgagaactttgaaggccgaagaggggaaagggacgggggaagcccgtctgatagcgctctgtgcgcgtactccgaaagggaatcgggtaaaattcctgaaccggacgtggcggctgacggcaacgttaggagtccagagac

SEQ ID NO: 54455 - DNA, 624 bp, Glycine max
  Peptide Sequence Number=SeqID_146140
atgggtcaacttcaacagcaagccttccgcaaagcctatggtaagatttgggacttagctacgatagaagtctctgtggaagtgattgcatcccttacccagtattatgaccaacccctgaggtgcttcacatttgaggatttccaactagtgccgactatggaagagtttgaagaaatcctgggatgtccactgggaggaaggaagccatatcttttctctgggttctatccctccatcgctagagctaccaaggcaaaggccttggaaaatcaaggggaatggacttcttttattgacatcttggcgcttttgatcttcgggtttatcctctttccaaatgtggaagggttagtggacctagcactattgacgctttcctcgcctttcaccatagcaaggaaagcccggtcatcgccattttggccgacatggatgacacgtttgaccggaggcccgtttgttcgctacaaggtcatcgctcgtgcgccgagaaaggaaaggcgaattgggaccaactcttacctagcatggagggggcgtccgttaattggttccctcgctggaaggaaggaagaaccgggattatgtcctcgtgcgaaggatttccaaatgttcccttga

SEQ ID NO: 54456 - DNA, 462 bp, Glycine max
  Peptide Sequence Number=SeqID_146141
atggcgcctaccaggcaccctttggatccagataagtccaacagggccctgggatttcccacactgatcacaggactctgccagtcgttcggggtccccgtggcacctaccaaggccgcgggcgcgccaccaccacctcatcaggctggcccggctaggtcatttgacatggagcagtatttacggcatttggttcgccagcaggcagccaaccaccgggcacatgtgcagacccatgattgtctgtaccagatgagcctcgacatgcagagtcagggcttcgcttctttttcatgccctactccagaccagttcagggcagaggtcgcatggcccggggattggcccgaggcccaggcaggagaggcgcccccagaagctcccggcgatggagaggaggcccacgaggacgaggagacggccgatttgcttgacttcttgggagggagtggagctacatga

SEQ ID NO: 54457 - DNA, 579 bp, Glycine max
  Peptide Sequence Number=SeqID_146142
atgacccaagagctggtagcccgcggagacaccttacggttatccgcacctcgtcattcagtcaccccaagtgtgattgacgagcagaggccaatatggtcatctgcgcccttttcggagatgtcagcattttccgatggagacttttcaagtctcacaaattatctagaactacaggcggcgggcccgatgatacacggagataccttacggttatccgcacccttgtgtcatccagaggcggcgggcccgatgatacgcggagataccttacggttatccgcacccttttgtcatccagaggcggcgggcccgatgatacgcggagataccttacggttatccgcacccttttgtcatccagaggcggcgggcccgatgacaagcagagacacaatttggtcattctgcacccttgtgtcatccagaggcggcgggcccgatgatacgcggagataccttacggttatccgcacccttgtgtcatccagaggcggcgggcccgatgatacgcggaaatacccgagtggttatccgtataaacattcttttgctatctgtcagacagaacgcttatag

SEQ ID NO: 54458 - DNA, 276 bp, Glycine max
  Peptide Sequence Number=SeqID_146143
atgcgtcttctcgctcagcggatggactcaagtggtgcgctcagcgggatgaaccctcgctcagcgaacatgcacatctcatccttcttccaagctcttccttgcgctccaccgagaagtgttgcgcttagtggatggctcgctaagctagcagattggcttagcgagtggatgaaaatcagcacttcacaaacttgcctaattaacctgaaattgagaggaattgatattaaaacacacaaaatgaaagtgtcgaagcaaagactttgcccttga

SEQ ID NO: 54459 - DNA, 387 bp, Glycine max
  Peptide Sequence Number=SeqID_146144
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggatcgtgcccacaagacacccagtggacccggagaagtccaacagggccctggggtttccaactctggttacgggcctctgtcagtcctacagggtgcccgttccccccaacaaggtcacgccatcatgacatag

SEQ ID NO: 54460 - DNA, 184 bp, Glycine max
  Peptide Sequence Number=SeqID_146145
atgatggtggcccgggtgatgttggggaatggctacgagcccggaatgggtttaggcaagaacaatggcggtagaaccagcctggtaagcactagaggaaaccacgggaagtttggattaggctataaacccacgcaagcagacctacggaacagtgtcgcgggacggaagagcagaagccaag

SEQ ID NO: 54461 - DNA, 2385 bp, Glycine max
  Peptide Sequence Number=SeqID_146146
atgattcgtgcaactaaagctactcgtattgacgatctcatgttgatcggatacaggtcttctctggatgaggctcatgagcatcatttaggtcacgttagtgttttactgcgaaagtggcacaagctgggctatcccggtgttagcaagaacgtggtgtgtttgctggaggggtggaggttaaaggggggacgtaagggggatgcggttaagcgattggatcctctaaagggtccgttgacggataatgaacttcaagcgtttaacgagtcggttgtacgagcttatgaaaatagcttaattaccatcgctgagttggctatggctcttagtgtcagtcatacagggcgtcgttcaatccagatctcgcacttgcgcgtggttgatattctttgcggagaaaatgaaaagggtgaaccattctatgtgttgaatgtaccgcgagccaagcaacgtaacagcttttttcgcgaaagcttcaagccttatgcgatgactctcgaactatgggcagttctaagtgctcaggcaaagaatgctattactttggttgagaatcgtctcgggattgaattacaggaagctgaccggcagcagattcctctgtttcctgatcttgatgttctagcgaccatcaaatccccttatgaactccgtcaactgcttgccactgacaaactcaacatcgccgcttcagttataactaaaacactccatttaatcgtagaagaaacagatattcgatcagaacgtactggtgagctattgcatatcaatgctagccgctttcggtataccacgggcacacgagctgcccgtgaaggttttggcgagttggtaatagcggaactgctcgaccatacggacactcaaaacgcaggcgtttatataaaaaatatccccgaacatgtgaaaaagctggatgaagcggttggcttccaattggcaccatacgctcaggcctttgtcggggtacttgtcgattcagagagggacgcgcatcgaggtaacgaccctactagtcgtattcggaccgaaatgggacagggcgttggtacttgtggagaacatggcttttgtggtgccaatgttcctattccttgttacacctgcatgcatttccagccttggctggatggcccacatgaggatgtctatcagggactactcaacgagcgtgaacgggtgaaagagataactggcgacatccagattgctgctgtacttgatcgcagcattatcgcggttgcagattttaagccaaaggctacgctgacagcagcagaaaaccttaaagcattcatttccaagtgccgggatcaattgactgtattcggctccgatatagattgggaagaacctgtttggccaaacataactgtgtttgccaagttaggcgttatcacgcgaaaacccgttcagggagaggtacaagaccctgagttcatcgatttcgctaaagcttatttccgttaccagcaggggcatcatcccacggggacaaaaaatgaaagtaaggccctccgtgcggttgaggcgtctttgcttcaactgaattggcaaggcagccactactcagatggcgcagcatatagttgcggccgtgagattgagcggctggctaagtttgtagttgaaaaccagcttgtaccaaacgctatacaagactgggtcaatccaattcagcgtgctgaggacaagaacaaaacaggcaaggaggcgaagaaaaatagggaagagaaacttccaagtgatactgccctcaatgcgttggcagaaatttttgccaacgacccaattcatgagcgagacatatttacaacatcggtatttgccatgttgatgtcagcaccatcacgcattagcgaggtgttagctctacctgttgattgcgaggtatttgaaactgatcgtgaaggtatagagcgctatggttggcgtttttttgcggggaaaggctatgagggtgatatcaaatggatacccaccgtgatggttggaatcgctaaaacagccgtaactagagtcagactgctctctgaaaatgcccgacaactggccaagtggatagagaagcacccggataaattttaccgccatgctaactgtcctgatgttgctgatgatgtgccgttgacgatggttcagacttgtatggcgctcggttttgcacatgactctcaaaaaacgtgcaggtcatgtcttggtagccggggcctagctaagggagatggtgtgcatacgctaaatagcttgtggcaacacactatggaacgtttgccagaaggcttcccgtggtttgataaaaacaaggggattaagtatagcaatgccttgtttgcactgaatgttaatcagttccacggaaaccgaggatgccttccg

SEQ ID NO: 54462 - DNA, 348 bp, Glycine max
  Peptide Sequence Number=SeqID_146147
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtggagaagttaagggaaatgagtccactttatgaatttatcaaggaaggtatcaacatcaaggacattcaatgggcacaggactga

SEQ ID NO: 54463 - DNA, 233 bp, Glycine max
  Peptide Sequence Number=SeqID_146148
gtgaatggacagatgaacctaataaggtgaaggaagaaatcaaaaccttcttctccaacacattccaagatgtagatgttcagagacctaagattgatggtatcagtttcaaaaccatagaccaaccgcagaattccatgcttgtgaccccttttcaggagattgaaattcagaatgttgtttgggaatgtggcaatgacaagagcccaggtcctcatggcattaatttctag

SEQ ID NO: 54464 - DNA, 348 bp, Glycine max
  Peptide Sequence Number=SeqID_146149
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggctgtgtttaatgagaagctttataagtatgctcaggtggatcagatggaacccgggtgtgatgatgatggggtggaagtgcagcatttgacttga

SEQ ID NO: 54465 - DNA, 737 bp, Glycine max
  Peptide Sequence Number=SeqID_146150
atgctccagttcctgtacccactgatgaggtttccttagtgggccaggcacttcacaccttccttgcttggccgacacatctggtcaagtctttatcacagcaggtagccgtgtctccggcaaaaccacctccaaagcccgatccggaggtcgatgatccgctttatttgatgacattgaccatcccagagcttttcttgaggccttatcaggttagatgggatgccaccgtgttcggggtctttaatccaaatttccccctctacataaagcatgaagacctctccaaaatcgcacacggtggtcaatgtctcagcatatcagtgttacagttgtggattctccatctcactgaaacatgtatgcgagcgggaattatgatatctatggattcctcgagccacagtccattcaaagagttcaaaatgggatgtctatcttggagcctacctaaatggcggacactggcagatggtggtcattgtgcccaaggaacacctagttgtctgttgttactcgcatggaacaatgctttaaaatatcttgatgatgttccacagcctaaatcaaaggctcctgctaggtggattgtcgtcaaaagtaatagacaaaaaggaagtactgagtgcgactactatgtcatgcactggatgtccaccatcattttaggaagttttagcaataacttggaagcgtattttaacgatcctaaaccattagagccaaagagattaaag

SEQ ID NO: 54466 - DNA, 723 bp, Glycine max
  Peptide Sequence Number=SeqID_146151
atggcctcaacaaacttcttatttccagaaggaaattcaatcaatagacttccaatctttaatggagagggttaccactactggaaaacccgaatgcaaatttttattgaggcaataaacttaaatatttggggagccatagaaatagggccttatatacccaccacagtagaaagaatcacaatagatgggagcacaacaagtgaaagcataacattagaaaaacctagagatagatggatgaatgcaaatgaaagcattcaagacatgcaaaagaggttcacacatatagtaaatcatcttgcagccttaaggaaagagtttcaaaatgaagatctcataaacaaagaacacgaaatggaattgttgagattaaatcaacatgaagaaaatgacaagaaaaagaagggaatttctcttaaagcctcatcttcaatccaagaagaaagtgataaggaaattgatctagatgaagatgatgatcttagcctttttgtaaaaaggttcaacaagtttcttaaagtaagaggaaatcaaaggcgacccaattttaaatctaaaagaaggacagaaacttcatcctctactccaaaatgttttgaatgcaatcaacctggacatctgagggttgattgtcctatcttcaagaaaaagatggagaagcctgaaaagaaaaattttagtgaaaagaaattgaagaaagcatacatcacattgggatga

SEQ ID NO: 54467 - DNA, 221 bp, Glycine max
  Peptide Sequence Number=SeqID_146152
gcgcagcagaaggaaagaaagatacattttgccttagtaggaggatggaattagcttatgggctaaggtttgaaataaactatcccattccttcagataaatcaaactataccctctccctttggcctgagaaaggcagtgaaatagctgaacccgaaccaaagcttctaaggtggaatggcatggcgaatattttgccaactgacatgggcaatttgtga

SEQ ID NO: 54468 - DNA, 414 bp, Glycine max
  Peptide Sequence Number=SeqID_146153
atggagagaagtatgatagatgctgccagtggtggagcccttggagacatgatccctgttgaagacagaaatttaattgagaagatggctaccaactcccaacaatttagcgccaaaaatgatgctatagtcattagaggagtgcatgaagtagccacaaactcatctgcatcatctgaaactaagaatcttgaaggtaaactagatgccttggttagcctggtaacccagctggccttgaatcaaaaatctacacctgtcaccaaactctgtggtttatgctcctctgccgaccaccacacaaacctttgcccttctgtacaacaatctgaagcaattgaacagcctaaagcttatgctgcaaacatctacaatagacctcctcaacctcagcagcaaaatcagccacaatag

SEQ ID NO: 54469 - DNA, 463 bp, Glycine max
  Peptide Sequence Number=SeqID_146154
atgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaaggcggcgggcccgatgacaagcagagaccaagtttggtcattctgcacccttgtatcatccagaggcggcgggccctatgatacgcggagataccttacggttatccgcacccttttgtcatccagaggcggcgggctcgatgacaagcagagaccaa

SEQ ID NO: 54470 - DNA, 606 bp, Glycine max
  Peptide Sequence Number=SeqID_146155
atgttcaagtcatcaactattaggatccgaaaagagaacgccaaactgagagatgtgaatatagccaccaccaaggccttagaacaagagactaagagggcccgtagggaaaaacatggccggaacaaattccgaggggctttgtggggcactaacagcgagcttaagctccgaagagaggaaagggaccaatcacgagtagatagtttgatcttgaaagatgaattgaggatttgcctaaggtccaagaggaacttgtctcagcggttatgcgagaccgagaccaacatgttagccatcatcagcaagtaccaagaagaattaaatctagccacggcccacgagcacaaagtggtggacgaatatgcccgagtgtacgcggaaaaggaggctagaggaagggtgattgacttgttacatcaagaggcaacgatgtggatggaccgatttgctcttactttgaacgggagtcaagaacttccccgattgctggccaaggccaaagcaatggcagacgcctactccgcccccgaggagatccacggactcctcagctatttttcgcatatgatagacttaatggcccatataattaggaacctctag

SEQ ID NO: 54471 - DNA, 438 bp, Glycine max
  Peptide Sequence Number=SeqID_146156
atgcaaaggatcgacgtgctgaatgtgagcattacttacaagcatggcttaaggaatcgcaatgagaggggccattggcaactagtagtactgtgtcctgcgaccaatgttgttgcatggttttgttcgttacatgttgatcatgctattattataagcagtgcaatgaagtcaacaaacacaactgcggatggtacaaataatccagcaactcctaagtggattgaagtcaagagccatgttcaaagcagagggtatgagtgtggctactacgtgatgcattggatgtggaacatcatcagtgggggtttaaagaatgattggagcatgtggtttcttgatggaacggtgctagacaatgaaacaattacaacgattcgccagaaatgggcagaatattttcttaaagttcaaagcaatcaatgtacaaagtcttag

SEQ ID NO: 54472 - DNA, 291 bp, Glycine max
  Peptide Sequence Number=SeqID_146157
atgaacaagattagaaatggtcaagataaaggaaagtggataacaactaaagttcgagcagccttggacgaacattggggttctacatatttcctaaataagagctccactgccaaggcgaatcgatctattgatagaggagcctcaacatactgtggtggttccatatctactgcaactcactttgaaaagctgtcaaaggagtttcaaagactaccaactgcttgggaggtgatggagaaaactaagaaattgaagtcgagagaatgggtcaatgacaggtctcgctaa

SEQ ID NO: 54473 - DNA, 282 bp, Glycine max
  Peptide Sequence Number=SeqID_146158
atgtaccctccactagaactgatccacaagagatgtaccctctcttgttctcagtcaacaactcaagtagatgtaccctctacttgtaccacaaaggatggatgcaaaagaattctcaggcggttagtctttggcgaattctttttggcaaagggagaagagatgaaaagaaagaatagcacaagttttcaaggtttagaaaaaccagaaaactttggaaagcttttggcacaaagaagaagaagaagttcaaagagattcaaggcttgtaaaggattgtaa

SEQ ID NO: 54474 - DNA, 321 bp, Glycine max
  Peptide Sequence Number=SeqID_146159
aagacacccagtggacctggagaagtccaacagggccctagggtttccagctcaggttacgggcctctgtcagtcctacagggtgcccgtccccccaggatcacgcccgcaagacacccagtggacccggagaagcccaacagggtcttggggtttctagctctgattacgggcctttgtcagttctacgaagcgcccgtcaccccaacaaggtcattaggccccccattaacccgggctttcatcaagaagtactgtgccccagacgggcgtagggcgagacaccacagtagcattgggatggccggtagcgggcaatag

SEQ ID NO: 54475 - DNA, 432 bp, Glycine max
  Peptide Sequence Number=SeqID_146160
atgaggttaggtcgtgcgataggtagagttgtaggcagagatagacctgctgacgaggatgctgctgatgttcctgagaggcgaaggcctactgcctcagcctgtaggcaacgcgttcatcagatgactacggagggacgtgatatggctgaggatgtcgctgacatgattgacgatgtccctgagcaggctgcggaggcacctgagatgcgtgcggacgcagagggtgctgatagtggtgaggggtcagatggtgatgatgctgctgagggattccctggtggtccacgtgacccgtcagtgctcacatcatttgccgagcatgttgcatatgccgtttggagtggacaggaacgtcctgatttgaagttagtgtcacatgggaggaaggtgacactgattgggaggccagtgcctgagattaaaggcctg

SEQ ID NO: 54476 - DNA, 159 bp, Glycine max
  Peptide Sequence Number=SeqID_146161
atggaggtttttataacgttttccacaaataaacgttggtggcgactccgcgcattttcctcctttggaagacgcacccgtgagccttgccttgctcgcccgcaaaagggtaggttgcgacagttggcgactccactggggactatttttgtgagttag

SEQ ID NO: 54477 - DNA, 210 bp, Glycine max
  Peptide Sequence Number=SeqID_146162
atgtgttttgggcagagtttttctacctctgccctgttttcttggtttaggcttggaggggttgatcacccggtgatgagaggaacgaggataagggctacatgggggtacgtgagcttagttgaaagtgggcaactggtgatggtgggttcatgtttgatttgtggatgtgggagagttgatttgcaccatcgcccgatcgccacctag

SEQ ID NO: 54478 - DNA, 612 bp, Glycine max
  Peptide Sequence Number=SeqID_146163
atgggaacaaatcaaaccggcaagaggttttaccaagtcaaggttaaaagcctagataccaccagcatcaaggaattagggcggttgatggaacctctccaaatgcaagccttccgcaagacttacgaaaagatcttagagttgaccatagcagagactcggaacagcatagcaggcctaccacggaagtacctagaagacaaggcaaggggtatggccaatcaaggagattgggtcccgtttatggatgtgttagctttgctaatttttggggttgtcctctttccaaacatagatggtttggtggacctagcagcaatcgacgctttccttgcataccaccatagcaaggaaagtccggtggcggctgtcttggcagatttatttgacacatttaaccgaaggtgcgagaagagtagcgcacggatcatctgttgcttgcccaccctctgtgtttggttggtctcacacttgttccaacaagacacaaggcatccatgtccgctccagagccatcgctcgtgtactgaaaagagaagaatagattgggaccagcttttggctgggataggaggtagaacaatcaattggttcccccgatggaaggaatga

SEQ ID NO: 54479 - DNA, 762 bp, Glycine max
  Peptide Sequence Number=SeqID_146164
atgtggcaattgaaggaattctatgcaaatctttatgtaccagacgacaagtttcccaagcaagttagagttcgagggcacttgataaaatttgatgttgattccctcaacaccttcttggagactccagtggttgtggagcaaggagagagcttaccttgttactccaggtttgctagactgaggcctgatcctcaggagcttgcagcccgactatgtatccctgggaggggatttgttcttaatgccgagggtctgctgtggaagctcttgaggaaagatcttaccactctagcccaaacctggagtgttttatcttattctaacttggccccgacatcccatacttctgatcttaatctggatagggccaagttagtttacaggcttgtcatgaagatgaatatgaacttaggttcacttatttctggtcagatttcacttattgctcagtctaactcctcgcggcttggatttctagccctgattactgccttgtgcaagggtcaaggagtcacctcaaattctctttcattcgagtcactcaacccaaccattaatttggcttatattaagaagaattgttggaacctggatgacccttcagtcacttttccagggatccagaaatccaaggctagaagatatgaggccccatctacatcagctgcccctgcccctactccctctacatcagctccatctacttctgctcttccttcaccagtagcagcttcgattcttccaggtccctccgcttag

SEQ ID NO: 54480 - DNA, 276 bp, Glycine max
  Peptide Sequence Number=SeqID_146165
atgggtaaggctcacaccaccaagtcacccagtgaccctgaagaagtccacagggccctgaggtttccagttctggttacgggcctctatcagtcctacggggtgcccgtacccccccggcaaggtcacgtcatcatagggatcgcgactgcaagacccctagtggatccgaagaagtccaccagggtcttggaattgtcaagctctaattacgggtttctatcagttctacggtgtacctgtcacctccaccaagggcatcaggccccctactaa

SEQ ID NO: 54481 - DNA, 420 bp, Glycine max
  Peptide Sequence Number=SeqID_146166
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccatgcgggccctcaaggcagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 54482 - DNA, 171 bp, Glycine max
  Peptide Sequence Number=SeqID_146167
gggtaagagggctatgaaagaaagggttagaggggctcaaagagtgtttgagggctatgatgcgatcaaggaacaagccagagtgagtttgctatgtgcccctaattcaggaaccaaattgaaagtatccaaaagtccacttctagtgataattcccaagggtactttcat

SEQ ID NO: 54483 - DNA, 549 bp, Glycine max
  Peptide Sequence Number=SeqID_146168
atggcatccaggaaaaggaaaagcaccgcttccaggcctcaagctcagattgtttcggaatggaatgctaagatttattatactaaatttgacaagtttaaggcaaagttggagaggcgtaacttacaaaaacgcctcgccaatctccaagatggaagcatagatgtagctgtggtgaaggagttttatgctaacttatatagcccggaagaccagagccctaagaaagtgagggtaagagggcatttaattaagattgatgctgacagcctgaacaccttcttagagaccccagtagttttggaggagggtgagacactgcctacctattctagatttacgaggatgaggattgatcctcaagagtttgctgcccgtctctgcatccctggtaggggttttgttttgaatgcagagggccacccttggaagcttctgaggaaagatctcaccactcatgcaccgacatggagtgtcttctcctacagcaacctgaaaaccacttcccacacctctgatcttaatatggacaaagccaggttggtttag

SEQ ID NO: 54484 - DNA, 189 bp, Glycine max
  Peptide Sequence Number=SeqID_146169
atgggactcgtcgtctgcttgtcgcagactagccaaggcagccaaggtcatgcgataagacctactagtggcgtattgcgcactgaatcgttcaataagggtgtcgaagctttctatggacataggtggaagtctatcgtacctggtcaatgctgcccccttgagggacatagggaagacacaacatag

SEQ ID NO: 54485 - DNA, 279 bp, Glycine max
  Peptide Sequence Number=SeqID_146170
ggatcgcgcctacaagacacccagtggacccgaagaagtccaacagggtcttggagttaccaagctctaattacgggcctctctcagttctacagagtgcctgtcgcccccgacaaggtcatcaggccccctactaatcgagttttcatcaagaagtactgtgtcccctggcaagcacagggcgaaataccacaacagcctggggatggccggcagcgggcaacagacgcaccgccatcacctctagagttcacctcagctcatccacaaaaaggttag

SEQ ID NO: 54486 - DNA, 561 bp, Glycine max
  Peptide Sequence Number=SeqID_146171
atggcctctggtaatcgattaccaagggaagctagggaagtctctggtaatcgattaccaaggggtgtaatcgattaccaggcttcaaaaagggttcagtctggaagactatggaggcctctgatcgtgatggcggcgcagctaattcatgatcgagtagagatggagtgcctagagggagcctgggagacccttgaaggcaacacgaggtgccgatttcggggcatgattcgatttacggctacttcattggtgcatccagatgaacccgtgcgcacgcttcagcgtactgtgaagtggatactacccacgcctacaccataccgtctagtggagccagtccaagtgatcgaggtgacgtcatccgaggaagaccctgaggaggatcccgaggagctacctcctgagcctgctgtggatgctcttgactttctagagggtgatgaggacccacttcctaaggtggattctcccgatgaagtcatgtcggcatctgaggcagactctacggaggatagtggcccgagagagatggcgaccagtggaggctcttcaccatag

SEQ ID NO: 54487 - DNA, 184 bp, Glycine max
  Peptide Sequence Number=SeqID_146172
tcctttcactaagcgcaagcctcgtgctaagcacatctttggtcatgtgctaagccgcgagtctcaagtgcttagcgctcaacccttgcatcctaggctgatttggtctgctaagctggccaaggctgagctaagccaatgtcaattcgatctgaattcggctaagcgatggcctgaccgctaa

SEQ ID NO: 54488 - DNA, 504 bp, Glycine max
  Peptide Sequence Number=SeqID_146173
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggaaaaaggcacaagcctcccagaagcaaaacactgccccccacgtattgtcttgtgggggttatgaatatttagaagaaaagctcatggctgagaagacaaagaaaagactagaagaaactgcccagtctggaagcactgagggcatcattgaccctccatctcccatcagacgccacgtgaaatggaagatggcccgcacgaagaaaactggacagatgacgtctgaggcagcaaaggaaatagctgactag

SEQ ID NO: 54489 - DNA, 96 bp, Glycine max
  Peptide Sequence Number=SeqID_146174
atggcattaagaagagatgttgttgatgttgaaaatgtcattgtgatgatgtgctatttccttgatgaatggtaccacattgcatttgagagttga

SEQ ID NO: 54490 - DNA, 180 bp, Glycine max
  Peptide Sequence Number=SeqID_146175
atggccgccatgagctgtcgttgcttgccgttggacccccacaccaagagaaacactttaatcagagcggaatcctcagaatcctcctcgaagattcgatggagaaaatccttcaatcctccatttcatagtttctctgagggtgtttttacactttctttgaaaaaccctggagaatga

SEQ ID NO: 54491 - DNA, 334 bp, Glycine max
  Peptide Sequence Number=SeqID_146176
tatagcacttaaagcctcctcatcaaggcaagaagaaaatgaaaaagaagaatcagaagatgaagaagacttctcactctttgtgaagaagtttcaaaaatttgtcaagaaaagaagaatcgagaggcgtcagaacttcaacaatggaagaagatctgaagaagactctcaagaatggcctgagaaaagtgataagaaaaggtatgatgaaagaaggaccaagaaggcctacattgcatgggatgacaatgagtcatccgacggtttagagaaggagatcaaccttctaaccaaggactatgagagtgatgagaacatctctcaagaagattaa

SEQ ID NO: 54492 - DNA, 231 bp, Glycine max
  Peptide Sequence Number=SeqID_146177
atggaagcattggtttatacattcctcttagtctcgactttaggaattatttttttcgctatcttttttagagaaccccctaaagttccgacgaaaaaagtaatgagcccccaatatggagggctcattacttcaactagtccccatgttcttcaaatggatctcttagttgttgcgagggttgcccaaaggcaatatataaaggcatacccagtaaaaacttacaagtaa

SEQ ID NO: 54493 - DNA, 297 bp, Glycine max
  Peptide Sequence Number=SeqID_146178
gatcccacgtaaaaaggcacttgctagcattgccacacctcttgggcttgagtttattcctcaagtaaggaagttgttggatgagggtttggttcgcaagagcttaaatccttgtgctttgttggtgcccaaaataggggttcccatgaaccctaagagaataaaggtcattcctgagtggcccactccaccaagtgttgagggaaggagcccagagtatgaagaacctcgggatttgaggtcaaatcctttccaaggtggagggaatgatgcaatcctatcccgcaagggcattgg

SEQ ID NO: 54494 - DNA, 101 bp, Glycine max
  Peptide Sequence Number=SeqID_146179
atggcggaaccatcaaagaagcacaagggttctacgagtagaagccaacggtactccgaggctcatgatactccagttccttcttccatttcctcctcctg

SEQ ID NO: 54495 - DNA, 540 bp, Glycine max
  Peptide Sequence Number=SeqID_146180
atgcagaggagtataattgatgctaccagtggtgaagctcttggtgatatgacccctgctgaggctaggaatttgattgagaagatggcttccaactcccaacaattcagtgcaagaaatgatgctattgttcttagaggagtccatgaggtggccacaaattcatcttcatctactgaaaataaaaagcttgaaggaaaacttgatgccttggtcaacctaatcaccatacagatctttgtccttctttgcagcaatctggagtcaatgagcaacctgaagcttatgctgcaaacatttataatagacctcctcagtagcaaaaccaacaacaacagaataattatgacttttcaagcaatagatacaatccaggttggaggaatcatccaaacagaagatgaacaagtcctccacaacaacaacaatttgtccctcctttccagaatgctactggtccaagcaagccatatgttcctcctccaatgcagcaacaacaaagacaacaagcaattgaggctcctcctcaaccttccttag

SEQ ID NO: 54496 - DNA, 201 bp, Glycine max
  Peptide Sequence Number=SeqID_146181
atgggtgatcaagaggagacacaggaacagatgaaagccgacatgtcgactttgaaagagcaaatggcttccatgatggaggccatgttaggaatgagacaactcatggagaaaaacgtggccaccactgccattgttagttcggctgccaaagcagacccaactctcctagcaactgcgcaccatcctcccctaaacgcg

SEQ ID NO: 54497 - DNA, 945 bp, Glycine max
  Peptide Sequence Number=SeqID_146182
atgttgagagatctcccaaaagaagttagagacattacagatgaacttgaaagctttcaagatttcatcaatgatgctgataaagtggctgaagccgaagaagatgatggaaggcgtcatagaataaaagaaagggtgatgcggctgagagaaacagcttttcacatggaagatgccatcgatgaatatcacatctcctgtgaggataagcaacctgatgatcctcgatgtgcagctttactatgtgaggctgttgccttcaccaaaactcaaatccttctccttcaaagtgcgtataagattcaggatgttaaatcccttgttcgtgctgaaagagatggtttccaaagccattttcctttagagcaaagaccaaccagttctagaggaaatcaagatgtcacctggcagaaacttcgaatggatcctctctttatcgaggaagatgatgttgtggggcttgatggccctagagatacattgaaaaattggttgacaaagggaagaaaaaaacgcactgtcatctttgtggtgggaattcctggggtgggaaaaacaactcttgccaagcaagtttatgaccaggtgcgtaacaatttcgagtgccatgcattgatcacagtttctcaatcctactctgtagaaggattgctgaggcatatgctgaatgagatttgcaaagaaaaaaaggaggaccctcccaaggatgtttctaccatcgagtcgttgaccgaagaagtcagaaactgcttgcgcaacaagaggtatgttgtcttgtttgatgacgtatggaatggaaaattttgggatcacattgaatctgctgtaattgataataaaaatggaagtagggtattaatcacaaccagggatgagaaggttgcagcatattgtaggaaatcatcatttgttaaggtgcataagctagaaaaaacctttaactga

SEQ ID NO: 54498 - DNA, 393 bp, Glycine max
  Peptide Sequence Number=SeqID_146183
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccctccggaggggccctggtgcttaccaacatggatggcgaagagctaccttcacccgtgaactctga

SEQ ID NO: 54499 - DNA, 390 bp, Glycine max
  Peptide Sequence Number=SeqID_146184
atggctgagaagacaaagaaaagactggaagaagctgcccagtctggaagcactgagggcatcattgaccctccatctcccatcagacgccacgtgaaatggaagatggcccgcacgaagaaaactggacagatgacgtctgagacagcaaaggaaataactgacaggattggatcgttcgtcccccatggacgtcaggatatcctgactgctgccattgggcgaccagaacaccctggccgtgtttgtgctgttggagccggtgtcaccataaagcaatactttggatcagcttcacgaacatcccgtagttcttcctccatgcctcttgaagacctagaacaactgacccaacaaatcagagaccaactagaggagtcaattacataa

SEQ ID NO: 54500 - DNA, 673 bp, Glycine max
  Peptide Sequence Number=SeqID_146185
aatggaatcaaagaattgggaggactttcaaatcttcgtggtcaacttgaaattaggaacttggagaatgtttcccaaagtgatgaagcgtgggaggcaaggataatggataaaaaacacattaatagtttatggttggaatggtctggatgtaacaacaacatttccaacttccaacttgaaatagatgtgctttgcaagttacagcctcactttaacattgaatcgttggaaataaaaggttataaaggaaccagatttcctgattggataggaaattcttcctactgcaatatgattagtctaaaattgcgtgattgtgacaactgtagtatgcttccttcacttgggcaactaccttctctcaaggtccttgaaatttcaagattgaataggctgaagactattgatgcaggtttttacaagaatgaagattgtcgttctgggacgtcctttccctctcttgaatctctggccatttatgacatgccttgttgggaggtgtggagttccttcgattcagaagcttttcctgtgcttaaaagtctttacatacgtgactgccccaaactagagggaagtttgccgaatcagcttcctgctctgaaaacacttgagattagaaattgcgagctgcttgtctcttctctcccaacgtctcccgccattcaaa

SEQ ID NO: 54501 - DNA, 638 bp, Glycine max
  Peptide Sequence Number=SeqID_146186
ccaacaaggacagtgtggatgacactgtttgcgaaaaatatggcattagcaaggaggacgtgtggaaaaaggcacaggccatccaaaagcaaaacactgtcccccacgtgttgtctcgtaggggttatgaatatttaaaacagaagctgatggctaagaagacaaagaaaaaactggaggaagttgctcaatccagaagcactgaggccatgattgaccctccatctcccatcagacgacacgtgaagtggaaaatggtctgcaccaagaaaactggccaaatgacgtctaaggcagcaaaggaaattgttgagaagattgattcgttggaggagcaggcaccacagggttcctttgtcccccatggacgtcaggatgtcttgactgttgccattgggcgaccagaacaccctggtcgtgtgcgtgctgctggagccggtgtgaccatcaagcaacactatggatcagctccacgaaccgcccgcacttcttcctccatgactcccaaagaactagagcagttgactcaacaaatcagggaccaactggaggagtcaatcatagaaaaagtgactcggcagctgatgttatccttcagccaaatgcagtcccagtttcaatcacagatgcaatcatag

SEQ ID NO: 54502 - DNA, 449 bp, Glycine max
  Peptide Sequence Number=SeqID_146187
atgggatcaagtcaaaagccttcgcttaaaaagaggttctatcaagtcaaaatcaagagcttagaggtcactagtttacgagagttggggcaattaatgggtcaacttcaacagcaagccttccgcaaagcctatggacttccagctagtgccgacttgaaagagtttgaagaaatcctgggatgcccactgggaggaaggaagccatatcttttctttgggttctatccctccatgacaagagttgccaaggaagtgtttggaggaaaagggcaaaggccttggcaaaatcaaggcgaatgggcttcttttattgacatcttggcgcttttgatctttggagttgtcctctttccgaatatggaagggttggtggacctagcagtgatcgacgcttttctcgcctatcataaccacaaagaaagcccggtcgtcgccattttggccat

SEQ ID NO: 54503 - DNA, 678 bp, Glycine max
  Peptide Sequence Number=SeqID_146188
atgaggggagcggttaatgcagttgagtccgataggccgcacaggtctaaacctttaagggatgtggcaacccctaggaggtttatctttgaggccctacaaaaaagaggtgtgattccccatagtgggtgtaaggaggattcctgtctgctacactccggcgagatgcatgacatggagacgtgtttggaagtagaggaattattacagcggatgatagatcaaggtcgactggaagtcggcattgaaggaaaagaagagcagcatatatgcatgcaatctacggaggggagtggtgttgtgaagcccaaacccttggtgatatacttcactaaaagcgcagcttcgcaaaagcccggacaccccttaatagccaaacctgttcctttcccgtaccaaaatagtcacgcggtcccgtggagatatacacctccggggaagaaggaagaagaagccactgacgtcagctcgctgtcagctaaagtaacaaatatcacgggactgagtggtgtgacccgtagtggtcgtgtgttcgcacctccggacctaccagtccaacccgccgacgtcaagggaaaaggaaaagtggtggaggaacaagatggcgaagcaccccacgcttcgaataaagatattccagcaaagggtcccccggagaaaaaagatggtagaaaggag

SEQ ID NO: 54504 - DNA, 314 bp, Glycine max
  Peptide Sequence Number=SeqID_146189
tcaagcggtcttttgccattggtgttggtgcagtaacttcatttggttaccgtaaggatcgtgatggacaatggctgaagaaggacgcgctacctccgcaagatgagcgtactccctctcctcctcctcagcgagatgattcctcagcccttatgaatgaagttctttcggaattacggggcctccgcacctatgttggtgaacgctttgattctttggatggtcgctttgaaggaatggatacctgtatcacacagcttgaagaggatgtgacttatcttcgtcagtgcttcgaccttccaccaccttcctag

SEQ ID NO: 54505 - DNA, 63 bp, Glycine max
  Peptide Sequence Number=SeqID_146190
atggagatgcagcggaagacaaaggagaagagactaggtagcttccttgagaagctttcttaa

SEQ ID NO: 54506 - DNA, 171 bp, Glycine max
  Peptide Sequence Number=SeqID_146191
atgagctcgcttagcacatgtgaagacggtgtgcttagcgagttggcctttgctcagcgcctctatacaacccaacctccttctagaattgtccatgcgcttagccatcagattgggtgcttagcgaatgatgcgcttagccagaagataagtggcttagcgagttcatga

SEQ ID NO: 54507 - DNA, 225 bp, Glycine max
  Peptide Sequence Number=SeqID_146192
atgtcttccaaggttattttgataatgccaaagaatcaagagttaagcgaattccaaagattcaagaatcaagtcctcaagaatcaagattcaagaatcaagattcaagaatcaagtttcaagaatcaagattcaaggataatcaagatcaagatcaagattcaagaatcaagagaagacttaatcaagatatgtactaaaaaagtttttcaaaacattgagtag

SEQ ID NO: 54508 - DNA, 156 bp, Glycine max
  Peptide Sequence Number=SeqID_146193
atgggggtgcaaatagcacccaggcccacttgggccctccggaatattcctccagaaggcggggaggaagtgaagaaggaaggggaatgtcgcaaaggtttcaaccgttcttcgacgttcttcattcgttcttcatcgttcttcgatcttcaacgg

SEQ ID NO: 54509 - DNA, 490 bp, Glycine max
  Peptide Sequence Number=SeqID_146194
atgtcagccagcgatcatgccattttgtgcgacagagttcatcaacccacaaagaaaagcttgttgcaggttgtaccatctgtggtgaggctcatgaaagaggccaatgtattcctagtgaagaacacactcaagaagttcactatatgggaaatcaacaaagacaaggatatactcaaggaggattttcaggcttccagcaaggaggagactttgactcagtttatgcaactaacaatgtcaaatcataaaagcactaagtcagcactgaaaaaccttgaggttcaggtgggacaactggccaagcagatagctgataactcatccaatagttttatggcgaatacaaaaaagaatcctaaggaggaatacaaagttgtgatgacaaggagtaagaggtttgtggaggcagaggatgaggatagtgtcatgatcaagaagaaagttgctgaaaaaaaaggtattgatgataagaaagatgatgtgaggg

SEQ ID NO: 54510 - DNA, 541 bp, Glycine max
  Peptide Sequence Number=SeqID_146195
cactggggccagatggtaagccctcccgtatcgtagtaatctacacgacggggagtcaggcaactatggatgaacgaaatagacagatcgctgagataggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaat

SEQ ID NO: 54511 - DNA, 228 bp, Glycine max
  Peptide Sequence Number=SeqID_146196
atgggataccatatagaagagatgattcacgatctggggcaagacggatttcaacaagcacatgcccctttgtatgacaaaatagaaaatgattcgaagatgccttttgtggaagcaatgacttccaagattattttgatgatgccaaagaatcaagagttaagcaagttccaaagaatcaggcttcaagaatcaagtctcaaagaatcaagattcaagaacaattaa

SEQ ID NO: 54512 - DNA, 273 bp, Glycine max
  Peptide Sequence Number=SeqID_146197
atgaggaagtgtagaagggtgaaacttcctgcttttattgttgaccacagagtggtacctggagatatgtcgcgggggtcaggagaccttggggacgttaggcgagctcctggcagtcaacagataaaaggaacaaagaccacaaagcaaggaggcttgtggtggctggccagctgtgaatttttgtgtgatatatgggttgtggcctctggtaatcgattaccaagggtgggtaatcgattacaaggcttaaaaatgaagacaggaggctaa

SEQ ID NO: 54513 - DNA, 264 bp, Glycine max
  Peptide Sequence Number=SeqID_146198
atgtggtatcaaaagcatcttcatctaggtgatactacatcatgtggtactacatcatgtgagctacaagctctgataccaaatgatgtagctccatgtggagcttgtaagccttggatcttcttcatcaatagagtcctttgcttcttgaagataatggcagtggaatggagaaggaagaaagatgattggagatgccacttcaaggaaaaaatgagtcaagaagaagctcaccaccataggaagccatggataagagcttga

SEQ ID NO: 54514 - DNA, 165 bp, Glycine max
  Peptide Sequence Number=SeqID_146199
atggaggttaaagatttgatttgggcaagattggatgaggggaagtgtggttttcgaaatctgcactttatgcagaattttgctgtgaaattgtgcagtagaattttgcataagtgcagaaaaatgctatgttttgctggttgtggaaagagtagtgcagaatga

SEQ ID NO: 54515 - DNA, 547 bp, Glycine max
  Peptide Sequence Number=SeqID_146200
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccccgccgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 54516 - DNA, 212 bp, Glycine max
  Peptide Sequence Number=SeqID_146201
acggataaccactcgggtatttccgtccgtcagcgtgactcaaatgtcagtatgacagatcttgtgagcgcggaagatgacgctttctgtcctacagatagcaaaagaatgtttatgaaagtgcggacaaccacttgggtatctccgcatgtcaccgaggctcttgctcctatgtatcctcaaatgaggaattcagacctacgtagtcctgg

SEQ ID NO: 54517 - DNA, 651 bp, Glycine max
  Peptide Sequence Number=SeqID_146202
atggccagaacacgaggtttaggttgtgccataggtagagttgtaggcagagataaagctgctgacgaggatgctgacgatgttcccgagaggcgtaggcctactgcctcagcccgtaggctacgcattcatcagatgactacggagggacgtgatatggctgaggacgtcgctgatatgactgatgatgtccctgagcagcctacgaaggcacctgagatgcgtgtggacgcacagggtgctgatagtggtgagaggtcagacggtgatgatgctgcagagggattccctggtggtccacgtgacccgtcagtgctcacatcatttgccgagcatgttgcacatgccgtgtggagtggacaagaacgtcctgatttgaagttagtgtcacatgggaggaaggtgacactgattgggaggccagtgcctgagattgaaggcctgttattactgggcgatcctggacttatatccgcatttgtggagaggtggcacagtgagactagcaccttccaccttccttttccacgctctttctacggaggaggccagattcttgctcacggagttgctggaagtgtctgcggaggaggccagagccgagacagcactcacacgtggagcatatgtacgattaggatgggttcgtga

SEQ ID NO: 54518 - DNA, 516 bp, Glycine max
  Peptide Sequence Number=SeqID_146203
atggcatccttcagccagcttcagtcgcagatgcaatctcagggacttgcagtgcctcctaagcctctggttggtcctggtccctccggtcctcgagtgagcacaaaggggagttgtgttgatccctcaggaaacgatcctgagacgggtgactctgacaggtgcggcttgtacatagaagcagatcctgcccgcttggttgccatggggagagtttatgatggatcgattgttgttcataacactcctttgttgcctggccaagtaaaggtgagtgtggaggaggttacagatgcagatgctccagttcctatacccactgatgaggtttccttagttgggcaggcacttcacaccttccttgcttggccgacacatctggtcaagtctttatcacagcaggtagctgtgtccccgccaaaaccacctctgaagcccgatccggaggtcgatgatccgctttatctgatgacattgaccatcccagagcttttcttgaggccttatctaggttag

SEQ ID NO: 54519 - DNA, 87 bp, Glycine max
  Peptide Sequence Number=SeqID_146204
atgagcaagaggctccaaaaggattgggctagggctgctgaagaaggccccagggttctcatgaaccttaggggctccataacgtag

SEQ ID NO: 54520 - DNA, 357 bp, Glycine max
  Peptide Sequence Number=SeqID_146205
atgttattgccttgcgctgttcatgtgtcctccactttccagtttggagttgtatttcatgattgcctaagtgcggaccctcaaggcaatcctccattctccccgctttttcggagctccatgaattacgtttacgttcatgtgtcctccactttccagtttggagttgtgtttcatgattgcctaagtgcggaccctcaaggcaatcctccattctccccgttttttcggagctccatgaattacatttacgttcatgtgtcctccactttcgagtttggagctgtgtttcatgatttcctaagtgcggaccctcaaggcaatcctccattctccccctatttcggagctcgatga

SEQ ID NO: 54521 - DNA, 442 bp, Glycine max
  Peptide Sequence Number=SeqID_146206
atggtacataacagttggaaggatgtaccggacacactaaaggagctattatggaatgagattttggccaagtttgatatcccagaagccctacatgcaaagaaaaaggtgatgtcaactgtggccactagatggaggcagtttaaatcatccctgacaagtaaatttgtgtttagtatttctgaggaccaacataaagaagatccttccgtcaaatatggctttgatgcacagatatgggaggaatttgcggcaacccgcaaagtccctaattggcaggactcgttggaagaacaagtgacacagggtgagtttgtcccccagggtcgtcaagatatacttaacatggccataggaagaccagatcatggaggttgtgttcgtgcagctgggtctggggtcacaattagtcaatactatgggaggacatcacgtgcctcaa

SEQ ID NO: 54522 - DNA, 323 bp, Glycine max
  Peptide Sequence Number=SeqID_146207
atggcatctcaaaaaaaaaatccattgcttcttcatcttctcagatcaggtacgacaaatacaaatattcttcccctgaagcatgggatcactacaccaacaacatctttggcataaagatcattcctgaaagaaatgtgcagctgtcgcttaatgactttgaggaatttcaaggggagttaaacaggtggaactggcataagaaaatcgctaacttggaagagggaaacatagatgtagcacttgtaagggagttctatgcaaatgtttatgatcctgaagacaagtcaccaaaacaggtcaagaaacaccagtggttataa

SEQ ID NO: 54523 - DNA, 414 bp, Glycine max
  Peptide Sequence Number=SeqID_146208
atgaaactggccaaatacaggctaaaggcccaagtggagaaggacggaggcctaagtggagaaggacaaagcccccaagtggagaaggatgaaggctcaagtaatccttgtggcgtctaccctgacttatcttcgttcaccggaagtggcgtctaccctgacttatcttccttcattggaagtggcgtctaccctgacttatcttccttcaccggaagtggcgtcatccaaaccttcgtagcctgtatcaaacgatccgccccacttatcaaggtaatccttgtggcgtctaccttgacttatcttctttcactggaagtggcgtctacccggacttatcttccttcaccggaagtggcgtctaccctgacttatcttccttcaccggaagtggcgtcatccaaatatccgtag

SEQ ID NO: 54524 - DNA, 471 bp, Glycine max
  Peptide Sequence Number=SeqID_146209
atgctctattccctgtcgcgtcgtcaggatgcgccagcagcggcctcgcgcaccacgcgcagcggcacgccgtgggtcgcagtgctgatgtctaccgccgcagcatttctggcggtgatcgccaactatctggcgccgagcgcggtgtttgagttcctgctggccagctccggcgccattgcgctactggtttatctggtcattgccgcttcgcatctggtgctgcggaaaaagcgcgaggcgcgcggcgagcagctcagctatcgcatgtggctgttcccgggtctgacgtgggccaccatggtgttcattgttggcgtactgacgtcaatgctgttcaatgcacagcatcgttcagaaattatcgccaccgggctgttgacgctgctggtgctggttgccagccagatagtgcaccgcaagcgcgcggcgcgtaaaaacagcgaggagatggtagcgctgcgttcgtaa

SEQ ID NO: 54525 - DNA, 216 bp, Glycine max
  Peptide Sequence Number=SeqID_146210
atgacagggttgactcaccgttgtggctacctcactggcttagcttcatcctctaaaagtatcctatgcatgcaagtagatgggctaatactaggaatgtttgctaaagtccatccaatggctttcttgtgcttcttaagcactagcaacaacttctcctcttgctcaacagcaaaggaggcagagatgatcactggaaaatttccttgtcctcca

SEQ ID NO: 54526 - DNA, 162 bp, Glycine max
  Peptide Sequence Number=SeqID_146211
atgagggagaaggagagagggaggaggaagatgacggaaagggccaggaagtggcgagagtgggcgttgattatgcgttttgattcggagaggattccccataggatgatggaggaggaaagaggaagaggtagaggcgtgtggattgcaaatgaatcctga

SEQ ID NO: 54527 - DNA, 201 bp, Glycine max
  Peptide Sequence Number=SeqID_146212
atggcgtttggggttggggtgcttcgaggaacagaggtggaaggcggctggacttatcaaggtaatccttgtggcgtctacccagacttatcttccttcaccggaagtggcgtctacccagacttatcttccttcactggaagtggcgtctaccctgacttatcttccttcaccggaagtggcgtcatccaaactctataa

SEQ ID NO: 54528 - DNA, 117 bp, Glycine max
  Peptide Sequence Number=SeqID_146213
atgtcacacatcctatcagagcattgtcttctcgtgtcctctagcatgagggagaccagtcaggatcacgttgttttgcgagaatgctccaaccatgtgggatcagcacaaacttaa

SEQ ID NO: 54529 - DNA, 936 bp, Glycine max
  Peptide Sequence Number=SeqID_146214
atggtttatttcttggctggtttttgcaaacttctggttgtctatctttatagtcacggatcaaacaccaatctcatcaacattacttggaaaaagctgataaagcaaggaggcaaagactatcatccagttctgcttctgccaaatcaggaagtagataatttgaccagagaaaagatagaagatgaactcaatgaacttaaagaagcacacgctgcatatgaggtggatacaccattggatgttcctgctaggaagaggtttgcaaaatacaggggactcaagtcctttaggacttcttcatgggatcctaaagactgtattccagttggctcatatgctaggttgcatatcatgggagtgcccagtgctattgcttcaaagttatctttgcttgcaaagacaatcccaattacagcatgtggcctattgaaacatgagtccaaagtatctgtccttcatttcagtgtgaagaagcatgaagcatatgatgcacccatcaaatccaaggaagagttaattttccatgttgggtttcagcaatttgttggctggccaattttctctagcgagttcataaatacagacaagaacaagatggagaggtttctccatgctgggcgtttttcagttgcttcaatctatgcaccagtttcctttcctcctcttcctatgataatcctaaagagaaatggagagaatgctacccctgtagtggcagctgttggctcactgaaaactgttgatgcagataggataatccttaagcgagttattttgacaggttatccccaaagagtgtcgaaacgtaaagcttctgtgagacacatgttttataatccggaggatgttaaatggtttgaggtgaaaatacattacccattgtctggattctttaaattatacttgttggatggtagtgaagtttacatataa

SEQ ID NO: 54530 - DNA, 264 bp, Glycine max
  Peptide Sequence Number=SeqID_146215
atgaaaagtgcggatttttcacttcgtggctgtgttgtttgtatctggggtacttgtggtaatgaggtggcaatgaagtgtgtggcagtggaatggagggtggtgatgagaatcctgaaattagccaaatacaggctgaatgtccaagtggagaaggacgaatgcccaagtggagaaggacaaagcccccgagtggagaaggatgaaggcctagagacagagacactaccaagacaattaattgttgctgaaggcccagattaa

SEQ ID NO: 54531 - DNA, 1497 bp, Glycine max
  Peptide Sequence Number=SeqID_146216
atggctagtgtcttttctgcatgttcaggttctgctgttcttttctacagcagaaactcctttccctcaaaaggatctttcattcacctcaaaaggcctctctctgccaactgtgtagcttctttggggactgaggtatcagtgtctccagcagtagacactttctggcagtggcttaaagaagagggtgttgtctctgccaagaccccagtgaagcctagtgtggtgccagaaggcctaggattggttgcactcaaagacatttctaggaatgaggttgtcttgcaggttcctaagaggctgtggattaaccctgatgctgtggctgcttcagagattgggaaggtgtgcattggattgaagccttggttggctgttgcattgtttctgataagagagaggtcaaggagtaattctctttggaagcattacttcagcgttctgcctaaggaaactgactctactatatattggtgggtttcttttgctttgcttgttaggtgcaggtcagaggaggagctctcagagctacaagggactcaacttctgaacacaactaggagtgtgaaacaatatgtggagaatgaatataggagattggaggaagaaattatactccctaacaagaagcttttcccttctcctcttacacttgatgacttcttctgggcatttggaattctaagatcaagggcattttcccgccttcgcaacgaaaatctagttgtgattccatttgctgacttcataaatcatagtgccagagtaacaacagaagatcatgcttatgaaattaaaggagcagcaggtcttttctcctgggactacctattttcccttaggagccctctttctctcaaggctggggatcaggtatatatccaatatgatttgaataaaagcaatgccgagttggctctggactacggtttcatcgaaccaaatgcagatcggaacgcatacaccttgacactgcagatatctgagtcagaccctttttttggtgacaaacttgatattgctgagtccaatggttttggtgagacagcatactttgacatcttctacagccgccctcttccaccagggttgcttccatatctgagactggtagctctagggggcactgatgcattcctgttggagtcaatatttagaaactccatctggggtcatcttgaattgcctgtgagccgcgacaatgaggagctaatatgcagagtggttagagagacctgcaaaactgcccttgctggttatcatacaaccattgaagaggatcaaaagttgaaagaagcaaagctagattcaaggcatgcaatagcagttggaattcgagaaggggagaagcagctcctgcagcaaattgatgagaccttcaaggagaaagaattggaattggaccagttagaatattatcaagaaaggaggctcaaggaccttggactttgtggggaaaatggtgatatccttggagaccttggaaaattcttctag

SEQ ID NO: 54532 - DNA, 345 bp, Glycine max
  Peptide Sequence Number=SeqID_146217
atgtctggctttttcctattggggattgtagaaacatttgacctggatattagcatcacaaagaacactactagaaataacgcatgctacatcgatggtcgcgaagaccgtcttagaatgggtacatttctaagacgatcacctgtgagggaccgtcttagaatgaccgatgtagaatggtacgcattctacgatggtcaatgggcagagatcgatgttgaattggaagcattctacgacgatcaaacagtaaagaccgatgtagaatggtaccccattctaagacggtcctccacacgtattcacaaacttcaaacattcaaatacccgcaatattacacatga

SEQ ID NO: 54533 - DNA, 171 bp, Glycine max
  Peptide Sequence Number=SeqID_146218
atgatcaacatttttgcccacttagagatcattcttcgtggcatgttgaacttgtttagattaaggacagcggaatggagaaggaggaaaggtgattggagatgtcacttcaaggagaagatgagtcaagaacaagctcaccaccataggaagccatggataagagcttga

SEQ ID NO: 54534 - DNA, 189 bp, Glycine max
  Peptide Sequence Number=SeqID_146219
atgggggagggctatcatggggacacatcagccattgggttgccttatttttatctaagtccagctagctacactgaatggtgcactggcaaatccaaaggctatggctttgtgactttcagggaggctgaggctgccaagaaggcttgtgaggattcaacaactctcattatcaatggccattgttga

SEQ ID NO: 54535 - DNA, 543 bp, Glycine max
  Peptide Sequence Number=SeqID_146220
atgattttcaacaacactgaatctaatacagttctagagatggtttttccaaaaccgtcattgtccaaaatgcgatgtaattgtaaaccgaggactaatgagccatatgtattggccagtcaagctcaacaagtatattatgttaaagataccaaagatcctaattggttagtttttgtgaaaacaaagcctcgagatttgtatgatgtgtctgagaaagctacacctgaggcttgtcaagaaaatgatgatattggctcaatctcttttacatctaatgccctggataatgatcaaggattgtctttggatagaaatgatttagcccgacccatagttgatggaaaacaagtagtacctttagaagttgttgaccgcgaaaaagaacaaagtgatgaagaaattattgatttagcaaaagacgaagaaagtggaaagatgaagaataagaaggttgcagcagctagtatctcgctaagcgaggcatatgcgtttagcgagcaacatccgttaagcgagacatcagctcgcttagcgagttag

SEQ ID NO: 54536 - DNA, 1020 bp, Glycine max
  Peptide Sequence Number=SeqID_146221
atggttcaagcaatagctatgttctacgaacctccagaaaaacagcagaaagattctagtttctgggcacttctatatgtgggtttgggtatagttactctagtgattataccagtgcaaaattacttctttggcattgttggtggaaaattaatagaaagaattcgtttaccgacatttgaaaaggttgtgcaccaagaaatcagttggtttgatgattctgcaaattcaaggtcacatgttaacatgacattcactgctaattggattcttgctttaataattgtagctatgtcacccttgatctttatacaacgatttcttcagatgaagtttcttaaaggattcaatggagatgccaaggcaaagtatgaagaggcaagtcaagtggcaaatgatgttgttagtagcatcagaaccattgcatcattctgtgccgaatcaaaggtgatggataggtacaagaagaaatgtgatattgaatttatactggctttggggcttgtgagtggtacaggatttgatttctcttttctggctttatactgcacaaatgctttctatttctacataggatctgttcttgtgcaacattcagcaacttttccagaggttttcaaggtcttattttgtttaacaatcacagccataggcatttcccagactagtgtcttagcaccagacactaacaaggccaaagattccgcagcttcaatatttaaaattcttgacagtaaacctaccattgactccagcagcaatgggggtagaacactagaagccgtttttggtgatattgaacttcaacatgtcagttttaattacccaactaggcctcatattcaaattttcaaagatttgtgtctaagcattccagctggaaagactgttgcattggttggaaaaagtggcagtggaaaatcaacagtgatcagcctcttggagagatcaatggacatagcgagcatgatatcctctcagcctttcctatattttaaaaatcaacctagaaatagataa

SEQ ID NO: 54537 - DNA, 99 bp, Glycine max
  Peptide Sequence Number=SeqID_146222
atggagaaaggttccaagatcctgttgtttcttataattgatagtctaggaaaccccttaaagttttacaagttctacacctatggagatggatggtag

SEQ ID NO: 54538 - DNA, 219 bp, Glycine max
  Peptide Sequence Number=SeqID_146223
atgtggaggccgtcagaaattgctttcgacgacaagacatggtggtacatagtggtttgtgatggagctagcggtggaaaatacgctcaaggtgacgaatcatcgtttatccgaatgggtagaatctcaactaggtttccaaacatcatctctgtggatgatggtgaaggggttggactctttgcaaggttgagggaaaaagagaacgattatgcttaa

SEQ ID NO: 54539 - DNA, 1115 bp, Glycine max
  Peptide Sequence Number=SeqID_146224
gaggtagctccgcttccaaacgcggcctagccggtggtagtactgcttcgacttcaggaactgatccagatcggacttcaccttgttcttcagctccgcgtccatcgccactcaccggcgtcggagttcacaacgagcgcgtcgccggaggcgttggtctaggagagcctggcgccaaggaaggtgtcatgaacggtgtggttatggttgaggtggaggaagatgtcggagggattggggtaatcagaatcttcaacagagggaagagaatcgagagttatgatgataaagggcctgccatagatgctgttgtctggtatgatggagaggtttggagggttgctcttgacacacacagtcttgatgatgatccagattgtgggaagcttgctaactttatacccttaaccaattatagtgctcttggtccatggcatggagtgattgcaaatgatgcttgtgtgcgtctttgccttcatgcttgggcaatgcagtgcatggaagctcctatgtttttggaaaatgaatgtgctttactgagggatgcatttggatggtattgctttacgctactgtgtataatccatgagtataaacaagtgttgtacacggagccacccctttctactaccgaaagatccgtagtggaggctgggccaaatgcttcttacctaaccaaaaaggaagagtcagcattcaaagacggtgcttacctcaacaacgtctttgaaagtggacattcaaagacggtgtttacatcagcaacgtctttgaaagtcagcattctaagacggtgcttacgtcagcaacgtcttagaatgcctacattcaaagacggtgctgaggcgtttccgggatacatgagtttcatggaatctctagctaagaagcgaaaatgcaaggaagatgtgttctatgaggtgaagaaaactgtaggaatgtcttgcatgagtcaagtgataagaagtgagcaaattcctatacaagtgtcttgcccaggagtccaatttccttttgtagggggtgatacctttggtactgataatgatgctgctgcagagagtagagttaatgatgattacattgtggatatcactgctacccaggaagcttag

SEQ ID NO: 54540 - DNA, 501 bp, Glycine max
  Peptide Sequence Number=SeqID_146225
atgcccaacattgtgaatttaatgtgtttcaacttcagtttcaggcactcagcctgcttagcaacttgggagaatctggaggagaatctgagaagcatctacgcgctcaacgagtcatcaacttgctcaatgaggcgtttgtctcttcccgcgctaagcgcgcccagcttgctcagcgaatattcactaattcgtgctaagcgcgaaattggcgctaagagatcctttgaggacagaaaaccctttttaaggctgaagttggaaaaatcaagcatatggaggcttgcagctggtgtctcgctaagcgaggcttgtgtgcttagcgagaatcatgcgctaagcgaggcactcagcccgcgtagcgagttgggagaatctggaggagaatctgagaagcatatgcgcgctcaatgcgtcatcagcttgctcagcgaggcgtttgtctcttcccatgctaagcacgcccagctcgctcagtggatattcactaacttgcgctaa

SEQ ID NO: 54541 - DNA, 216 bp, Glycine max
  Peptide Sequence Number=SeqID_146226
atggtggtggcgaggaggggcaagaaggaagtggagatggacttggtgattgtggatttgaggttcaaattcaatgattggtcattgaagaagtggaaaacgctaagaataattataaggataagggataatgttggtatagaaatggttgaagaggttggagagggtgggagagaagatttgaagggttcccacaaaagcctgctcggaaagtaa

SEQ ID NO: 54542 - DNA, 339 bp, Glycine max
  Peptide Sequence Number=SeqID_146227
atgaagacggcttgggagatgaatgtggtcgtgaggaagggaaagaaggaagccgggatggacttgatggcggatcggaggttcatcatggcaggttggtcgttgatgaagaagtggaagacgctgttggtgatgctgatgactccacaggtggaagagggtgggagagaggatgaaggaggaggatatggggaagaggaagaggagggagagggtgtagaagtgaagaaggtgtgctttcatgatgtgctgagattgagaaatgaaaccacagaggttttggggggccatgtctgggaggagaataacgggaaagtgaaattttgtaaggatgattga

SEQ ID NO: 54543 - DNA, 180 bp, Glycine max
  Peptide Sequence Number=SeqID_146228
atgacctttcctccaaaaggcactggtatagcaaacttagaatgtgttgttctacctccgggcagcagtaatgaagctatcccacttgaagaaactgttaaaacaatgtcaccattagaccgtatagcaaatgataaagttttccagacaaaggtcttgccggtgccaccatatccatag

SEQ ID NO: 54544 - DNA, 351 bp, Glycine max
  Peptide Sequence Number=SeqID_146229
atggagttgaaggatgggtggttgatccgaatgatcacctcattgaattcgaacatacattgttgtaaaaagtcaattgattcttggattgatctaaggaaaaaattacgtgataccttcgttgctagtcaagcaagaccaaaaaccgagattgatctaaagaaaatcagacatggagaccaagagcctttaagagagtacataaactggttcaatcaggaggctagggcagcatggaatttacagctaggagtggttcttatgttagctaaggacggagcgagagagggatcacctttcttcactttgatggctaaaacacccaacaacaaactaatgaagaatttgtaa

SEQ ID NO: 54545 - DNA, 489 bp, Glycine max
  Peptide Sequence Number=SeqID_146230
atggatcttgaagtcctcagacaacgtgcaaactcaccagccacctacacaagagggttgattctaggtgatgtagttacgatatctgaggcctcagggaatgatcggggcaggctagggcatgacgggacgcgcacgccacagaacaatgttgatgcggcacaggcaaccatggcagggcaggctagggcacgacagatgtcagcttcgaggttcaagtgcttcgcttcgtgcagaacaccatcccggatccatagaaaaacggcgttgtatccaccatgcccaaaaggcctacccctaataggtaacatgaacatcatgaagcagctcacacacaaaggcttagcgaatttagttgtggtgggagacaagaacctcaagaatgcggttaaggtgtttgtggataggcttgcaattaaagtggagaatggggtagaaggtttcgagggctttgtcgggcaaatcggcttcaacgtaggctttgattag

SEQ ID NO: 54546 - DNA, 549 bp, Glycine max
  Peptide Sequence Number=SeqID_146231
atgacagaagaaaatggtgattggaagccaaaaattggtttagagtttgaagatgtagaagaaacatgggaattttggagtaaatatggtgaggaagtaggttttggagttagaaagcaattcaaaaacaaggaaaaggaagatggtgttataaggaagggattagaaagccgaataaaagagattgacaagctaccaagcatagagctgagaccagaactaattgtaaaacgtgctacaaatttcatgaactcgctaagccactcatcttctgcgagcgtgaactcgctaagcgcaccgcttttaacccttaggctaagcaagaagactagcgataagccagaaactgagagagaactgagcttgaagaggaagccatcctgcagagctttgaaggagatcctgagagtttgtgaggtttctagaggtggaggagacatccccactacttgctcatatctttcatcttctcttttcattgttgtaaatgaatcttccctattatggagagctaaatcctcagttggttcttcctatggggtacttgat

SEQ ID NO: 54547 - DNA, 68 bp, Glycine max
  Peptide Sequence Number=SeqID_146232
atgtggaaattcttcatcgttcttcaccgttcttcgttcgttcttcgtcgttcttcggtcttcaaccg

SEQ ID NO: 54548 - DNA, 603 bp, Glycine max
  Peptide Sequence Number=SeqID_146233
atgcgggggtaccgtatggttatccgcacctttggtcatctagagatggcaagtccgatgacatgcgggggaatcacggcaagtccgatgacatgcgggggtaccgtatggttatccgcaccttttgtcatcccgagcggcaagtccgatgaaatgcgggggtaccgtatggttatccgcacctttcgtcaaccaggagcaaacaagcccgttgacgcgcagaaactagtgttgtcatctgtaccctttgtcaaccaggggcaagcaagcccagacgggaagtccgatgacatgtgggggtaccatatggttatccgcaccttttgtcatctagagacgtcgagtccgatgacatgcggggacggcaagtctgatgacatgcgggggtaccgtatggttatccgcaccttttgtcatcccgagacagcgagtccggcggagataccttatggtcatccgcacctttcgtcaaccgaggcgaacgaatttgacgacattcaagcccaacgacgcacgggattcttctctgctgggccgggacgatcaagtgcgatagcacgtggaaacgtcgtggttccgttggttgggatattgatcggctga

SEQ ID NO: 54549 - DNA, 174 bp, Glycine max
  Peptide Sequence Number=SeqID_146234
atggttgtcactgcattgtgggttgaacacaatgatgatattggcatgcctattgatgttgctttgggatctttggtcaaatctcaaaaccctgccactttccctgacagtgtatcacaggcatctaattcttctgaagttggatcgcaagctaccttaaaagatttgaactag

SEQ ID NO: 54550 - DNA, 810 bp, Glycine max
  Peptide Sequence Number=SeqID_146235
atggcatccaggaagtggaagagcactgtttctaggcccacaactcagtatgataccaggcgattccaatctttggaagcttcgaatagatacactgacaacattgtcggttggaatatccttccagagagaaatgtgaagctttatcatattgagttcgacaagttcaaggtggagttggagaggcgtaatctacacaaatgcctcgccaacctccgggatggaagcatagatgtggctctggttaaggaattctatgctaatttatacaccatagaggaccaagctccaaagcaagccagagtaagacgatacctgattaaaatagatgcagacaggctgaatgaatttcttcaaactccagtggtgttagaggagggggaatctttacccacctactctaggttttgcagattaaagacaaaccaccaggagattgaagccaggctttgtattccccgcaaggggtttgttttgaatgctgaggaccagccatggaaacttctcagaaaggatctgacaacactggcccagacatggagtgtcttctcttactccaacctagctcccacatcccataccttagatttgaatatggatagagctaggttggtctatggcttggtgactaacatggacatgaacatcagagcctttatctcagttaacttcagaggggctaggaaggcaagggctcgaccagctgatgttccattttcttctgcatcacccgctccttcttctgctactccaccagctcttccaagcccatcttctcaggactctcagtgctttgaagccatgcgttag

SEQ ID NO: 54551 - DNA, 234 bp, Glycine max
  Peptide Sequence Number=SeqID_146236
atgtttatcttcccaatcccttcatcaattgacacacataacattgttgtggttgggttaaaccttggtttgaccataataggtgatggatggaggtttcggttaaggtggctgataagtctgatggtggatggaggttttgatcatggtgagctatggtgggtgactaagtttaggtatggtgaaggagtggggcaaatatcaatgggttcggacatggtgaacaattactag

SEQ ID NO: 54552 - DNA, 243 bp, Glycine max
  Peptide Sequence Number=SeqID_146237
atggaggatttcatggcacaggtggcctggccaagagtccagccttctcctttggggggggggggaggtgaggctttcgcagcccaggagcctcagccagaacctcagccggaggtagttccagaggccactccagaggctactccacaggcttcaccagttgcttcacctgttttggaggtctctgaggaggaggatggcactgttgatgcagattatgcagctgatatgaatgcagcatag

SEQ ID NO: 54553 - DNA, 612 bp, Glycine max
  Peptide Sequence Number=SeqID_146238
atggaggaaaaacaaaagaaacagttggagcaagtagcccaatctgggagctttgaaacaatcattggtccttcatctcctattagacgacacatgaagttgaagatggttcgcacaaaaatatcaggtcagatgaaatatgaggtgaaacaccaaattgctgataggattgattccctagaagagcaatccgcacagggtagctttgtagcctatggacgtcaagatgtactgactgctgtcattgggcgactagagcaccctagctgtgtttgtgctgttggagccggtggaaatgtacttcctgttgagcctaaggtagctcattccgatgcccgtgtcagcataaagggaagctatgttgatccctcagggcaggacccagacatggatgcatcaaacagttcgaatgttgatgttcacattgttgtacccactgaagagattcaattagtggggcatgctcttaacatcttccttaattggacagcacatcttgataaacaactaccaaagggatcagtgaagcctattgataggtcggaacttgatgatgatcccatataccagatgacattgatgaccctgcaacttttcctcaagcctatgtag

SEQ ID NO: 54554 - DNA, 480 bp, Glycine max
  Peptide Sequence Number=SeqID_146239
atgaacgaagatcaatggatgtatgacggtataatgtctgaagaagttgatatgaatgatgaaaatgaagacgaagttggtgtgaataaagaagaacatgttgattgttctaaggcgttcaatacttctcagtgggctcaatcagtcgcttatgaaattagatttgtggcagtaattatgaggtcaagcataaacaatggtatgagagaaaggacttcatttgtgttaattggttgtgaaatgactagtcaatataggtctaagaagaaagattttgttagaagagataccgatagtgggaaatgtgagtgtcccttcaagtttcgtgggaaaccaatggttggagggcaaggttggatggtgaagttaatgtgcgggagtcacaatcatgaattggtcaagtcattagttggacatccatacgttagtcgattgactaaggatgaaaagacaattattgttgatatgataaggtcaatg

SEQ ID NO: 54555 - DNA, 261 bp, Glycine max
  Peptide Sequence Number=SeqID_146240
atggggcaaaaagaagaggaaaaatgtaccgacactgcaagaggttggagggtctttctggaggatgatgattatggtgatgtcaaaactcctccgacaaggtctcttgcgtcgcttgcgactgttgcttcaccagagcatggatgtggcacatgtgttggttgtgataatggttggaagaagatgttttggtgcagggagcttacagagtactacaataatagtggtgcaggtgtgggagatgttgttgataaaggatag

SEQ ID NO: 54556 - DNA, 60 bp, Glycine max
  Peptide Sequence Number=SeqID_146241
atgccaccatggaagacgtgcaactattcaaactgcaagaacaaggaggaatccaagaag

SEQ ID NO: 54557 - DNA, 507 bp, Glycine max
  Peptide Sequence Number=SeqID_146242
atgggagcgttgaaatctcgctactgctctggagaagctcgtcttcgtcattatcgcaggtggaaggagaagacggaaacaaaaatggtgttcctcgtggaaggagatattttgaactcacgttggactgttcacccggctaaggaaaagctaaaggaaatggcaaagaaagaaggcttgtggaacttatggaatcctgggaaaactgacttcaacgcagcaaagcataaacaacaatctatgatcttagtggatgtcaacactcttggaatccacatgaagagaccaatgacagtgtttggctttgatgatgcttcgcatgggcatgcaaaaactgcgattgcattgggttttttcactatggtccaagaacgtctctttgcattccctccattttccagtcgtggtctccgtcggtctcatcatcaacccttccctccgccggtagcgaacgttcatcgacattcgttggtcattgccactcttcatgcttcgctcttgacttag

SEQ ID NO: 54558 - DNA, 161 bp, Glycine max
  Peptide Sequence Number=SeqID_146243
atggaactagctaccggggtgttgattaacaaaacacaactattttccaaaataatcccaacgtcatcacgtcggcttggcggctccacaaaagaatctcacttcacgtactatactgctgtcattctgctcccacgaacaaaggttcacgatcatcacag

SEQ ID NO: 54559 - DNA, 375 bp, Glycine max
  Peptide Sequence Number=SeqID_146244
atggatgctaaattatatgattattgctttatgggtgatttgtgtgtatcattgattttatttatatactcaaagcaagtccaatttcacctcagtgtattggatcttgatcttgttatattggaaaagaagtctgttactattactgatgctagtagcaataaagagaaaactcattataaagctcgcgaaagatctaacagattcaacttaatgttcatgagaatgattgttgtagatggtactaagacaactctccctaagatcgatagagctaaagagtttatggggttagtgggagagcgctctcaaacagctgataagtctcttgcaggaacattaatgagtatactgaccaccatgaagtttgtttga

SEQ ID NO: 54560 - DNA, 201 bp, Glycine max
  Peptide Sequence Number=SeqID_146245
atggaggatttgaaggaggttaagttttggaaggagtgggagggcgccttatttcagcagagagtgattccagttcaactagcacttgctcaagctaacaacagactttgtttgcaaaataacatagccattgcagaagctaacacgagggaacaatgctggaagcaactaaagatgacgttggctcgggcttgggaataa

SEQ ID NO: 54561 - DNA, 237 bp, Glycine max
  Peptide Sequence Number=SeqID_146246
atgcttactgatgagaatcctgaaactggccaaatacaggctaaaggcccaagcccaaactatcaaggtaatccttgtgacgtctaccctgacttatcttccttcaccggaagtggcgtctaccctgacttatcttccttcactggaagtggcgtcatccaaatctctgtagcctgtatcaagcgatctgctcctagtcaggatcacatcatctggcatcagagcttcaactcttga

SEQ ID NO: 54562 - DNA, 207 bp, Glycine max
  Peptide Sequence Number=SeqID_146247
atgttgtttcttctctcttcttccaaaaccctctctttttcccgcaggccacctaacctgtctcagaaaaacgacgatctcggacttgttcaccgttggatcgtcatgaaatttgagcaccacgttcgcaacccaaatatgagaattctcactgttgggaattttgatattatgtctaagctaagagaaatattcctcgcattgtag

SEQ ID NO: 54563 - DNA, 123 bp, Glycine max
  Peptide Sequence Number=SeqID_146248
atgtctgctggtctacaaatcactggctggcctgcacatgattcttccatcagttcaattctgtttggaccagatgagactagcatttttagcctgggctctgatgggaaggcaaatttttga

SEQ ID NO: 54564 - DNA, 1061 bp, Glycine max
  Peptide Sequence Number=SeqID_146249
ttttcaagagacagtttacttggttgaaacactgaacacaaaggaccaacgttccttgggttcattgcaagaagtgagatttgcttcttggttgatcactggacacaaaagaccaacgtcttttgggttcattgcaagaagtgggtataacttcttggttgttatcactggacacatgggaacaacatcctttggggttcattgcaagaagattttacaaggagtggaaactctcaagtgggatttactagaggactggacccaaaacttcttcaaacttttccttaagcttcaagctttagccttaggctgttccatgttgtttttccctctatctctaacacaagatcctcaattgtcttacaagaacttgggagccaaagatcacagcgatcaaagaatccaaggacttagcatcaaagtcgatggaagctttcttcgaaaatttcctgcatatgaacatgagttgattcaacaatctcatgcagaagaaacaaaaaagaaaagaaagggaattgcacttaaagttaactcttcaatggaagattacaaagaaatttccagtgatgacgaagatgcagagaattttaacttgatggataaaaaacaaaaagaaaaggcctacatagcttgggatgacaatgcatccacatcctctgactcttctagtgaagaagaagttgcaaatgtaggcttggtgacagatttaatggaaggctcatcaaccattgaagaatctaagctgagaagcgatctaaaactgcatatcactaaattggcttcaacacaaagtgtcctggatagattgaggcaagaaaatgaaaaacttgtttcaagttacaaagctactggttgtgtttgtgcatctatctctcttaacatggaggattacaaatatttacaaactgagtttgaaaagttcaaagaggattactgtgcagaacgtatgaagttgcaaactgagttttcctatcttaaagatctttctagaaaaatgaacaaaggaaagagtgatcttagtcacttgctcagtgtgcaaaatcatacctctaataaaactg

SEQ ID NO: 54565 - DNA, 319 bp, Glycine max
  Peptide Sequence Number=SeqID_146250
atgtcgtcttctgcacttctgttaatcctgacccgtgaagtcaggcgggggtaccgtatggttatctgcacctttcgtcaaccaggggcaaaccagcccgttgacgcgcagagactaacgtcgtcttctgcaccttttatcatccagggacagcgagtcaggtggcaggcggagataccttatggtcgtctgcacctttcatcaaccaaggcaaaccaattcgacggtatcaggatgatacattcaagcccgacgatgcatgagattcttctctgctgggcggggacgatcaagttcgatagcgtgtggaaacgtcatg

SEQ ID NO: 54566 - DNA, 210 bp, Glycine max
  Peptide Sequence Number=SeqID_146251
atgaaggagaatgatggaagcttgcttgtggggcttctatggaggctggatctttcagcttcaatgaggtccttcaatggtgatttttcaccatggagatgcagcggaaggcaaaggagaagaggagaggggaggcaccatccactagggaataaggagcttcatcaccaagaattgccttggataagaagcttgaagaggatgctttaa

SEQ ID NO: 54567 - DNA, 762 bp, Glycine max
  Peptide Sequence Number=SeqID_146252
atggagtacgaagcgctgctggcggcgcagccggatttcctgccggcccgcctcgagctggcacgtgtctatgcggaagaccagcgcgatcgcgatgcggccgcgctgttcacagccatcgctgcaggcatcaatgccgatgatccggccacggccggcgtccgcgcgcgcgtggacggttacctgagtgccctgcaggcgcgccagcgctggaaaggcgcgctgtccgccggcccggcatggagtgacaacatcaaccgcagttcggccagtcgcacctgcctgttcggcgtgggcgacgcctgcatcatcgaacggaaactgccggacgcccagcgcgcggcgggcctcgactacgacgccagcctggaacggcgctgggtgctcggcgggcatcatgggctgtacgtgcgcggtctcgccttcggccaggcatggcgcgggcacagtgcgtacaacgagctcaatgccaacgtgcaggcgggttacagctggcgtaatgcacggcagaccgtgatgctcgcccccagctatgactaccaggccctgggcaaccatgcgctgcagggcggcagcggcgtgcacgcggaatggcagtacgccctggatgcacgcagcctgctcaagctggaggctgactggaagcgccagcgctatcgccagcagggccttgccagcaactacgacggcgagctggcatcgctgtacgccacctggttccgcgcgctcaatccacgctggacggtcttcgccgggctggat

SEQ ID NO: 54568 - DNA, 237 bp, Glycine max
  Peptide Sequence Number=SeqID_146253
atgaggggcaaaagggtctttttattgagtttcctagaccctagctcgcccaagctagcctctggcttgtctgggcccccaaatgacttcagggtgaaggaatcagctcgcctaggtgatccagttacttcaggagtaagtcttagctcgcttgggcgagctgcctttgccccaagtgcccattttcctataaataggtgtgctagggaggctgaggaagggttccaaggttcataa

SEQ ID NO: 54569 - DNA, 374 bp, Glycine max
  Peptide Sequence Number=SeqID_146254
atgacagatcctgtgagcgcggaagatgacataacaaaaaagaatgtttatacggataaccactcgggtatttccgcccgtcagcgtgactcaaaagtcagtatgacagatcttgtgagcgcggaagatgacgtaaatctctgcgtgtcaacgggcttgtcggccgcgattgacgaaggcgcagaggacgaccgtgactcaaaagtcagtatgacagatcttgtgagcgcggaagatgacgtaaatctccgcgtgtcaacgggcttgtcggccgcgatgacgaagggcgcagaagacgacgttagtctctgcgtgctatcaggctttgtcttacagatagcaaaaaagaatgtttatacggataaacactcggg

SEQ ID NO: 54570 - DNA, 327 bp, Glycine max
  Peptide Sequence Number=SeqID_146255
atgattatgaggggtcaagagatttatagtagtcaagagaagaatactttttccccttcgtctagtggaagtgaagatgaagtaaggggtgaagagtctagtgaggaagtctaccccgatgaagaaggtgacctcctaattgttagaaggctccttggagcaaatatttccaagtttattttgatgatgccaaagactcaagtcaagaatcaagagtcaaacaagtttcaagaatcaaagagtcgttcaattaagaagcaagattcaagtgaagattcaagagaagactcaagatatgcaagaacttcaagaaaatcatcaagataa

SEQ ID NO: 54571 - DNA, 324 bp, Glycine max
  Peptide Sequence Number=SeqID_146256
atgtcgtttgaatggctcagagcttcaacattcaatttcgaggcgtctcgatatatacgggactcaatcagacatccgaaggttcaacattcaatttcgagcgtctcgatatattacgtcactcaatcggacatccgagtaaaaagttattgtcgtttgaattggctcagagcttcaacattcaatttcgagcgtctcgatatattacgggactcaatcagacatccgagtaaaaagttattgtcgtttgaattggctcagaggttcaacattcaatttcgagcgtctcgttatattacgggtctcaatcagacatccgagtaa

SEQ ID NO: 54572 - DNA, 186 bp, Glycine max
  Peptide Sequence Number=SeqID_146257
atggctggtgctggcagcttggacatacaaacttggaattggaaggaggattggtgccatcacttgaagaatttgagtcaagaaaaaagggccaaccaccttaagagctattggactaagaagaattccaaattgagtgaatcaccaaagagagaacaaccaccaaaattgaggaccgttttgtaa

SEQ ID NO: 54573 - DNA, 462 bp, Glycine max
  Peptide Sequence Number=SeqID_146258
atgtcctcgccttcagaggctacacgccctcaccttaagagggctacacatcctcaccttcgtagggcttcacgccctcaccttcagaggactatacgtcctcaccttcagaggactacacagtcctcgcccttagaggactacactcctcgccatcagagggttgcacgccctcaccttcagaggactacacggctacacgccctcaccttcagaggactacacgtcctcgcttttagagggctacatgcgttcgccatcagaggactacacgtcctcgccatcagaggactacacgtcctcgccttcagaggactacacgtcctcgccttcgaagggttacacaccctcgccatcagaggactgcacgtcctcgccttcgtagggctacatgttcttgccctcacctttagaggactgcacgtcttcgccttcatggggctacacgccctcaccttttga

SEQ ID NO: 54574 - DNA, 741 bp, Glycine max
  Peptide Sequence Number=SeqID_146259
atgaccgcaggcaaacgtcgtatgttgcatgaactggaagccacactgagcgaagtcgaaaacagcgagccggcgcaactgctggaagaggagcgattgcgcaaggagattgcggaactgcgggcacgcattgagcgcgtgccgtttatcgacacctttgacctgcgctacaagaatttcgagaagcggcctgaaccgtccagccaggcggtaatgttctgcttaatggacgtttccggttcgatggaccaggcaaccaaggatatggcgaaacgcttttatattctgctctatcttttcctcagccggacttacaaaaacgtcgatgtggtgtatatccgtcaccatactcaggcgaaagaagtcgatgaacaggagttcttctactcgcaggagaccggcggcactatcgtctccagcgcgcttaagctgatggacgaagtggtgaaagagcgttatgacccgtcgcagtggaatatctatgcggcccaggcctcggacggcgataactgggcggatgactcaccgttgtgtcatgaaattctggcgaagcatattctgccggtggtgcgctactacagctacattgagattacccgacgggcgcaccagaccctgtggcgcgagtatgagcatctgcaggcgatgtttgataactttgccattcagcacatccgcgagccggaagacatctacccggtatttcgtgagcttttccataaacaggtcgctgaagcctga

SEQ ID NO: 54575 - DNA, 853 bp, Glycine max
  Peptide Sequence Number=SeqID_146260
atgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctg

SEQ ID NO: 54576 - DNA, 476 bp, Glycine max
  Peptide Sequence Number=SeqID_146261
gactctgccagtcgttcggcatccccgtcacacctagcaaggtgattcggccgcccatcacccgagcttttattgagaagtactgcacgcagagacaggtccagggtgatacaccacaggccgcagacgcgccgccacctcatcaggctggtccagccggattgtttgatacggagcagtattggcgacatttggttcgccaacaggcggccaaccaccgggcacatgtacagacccatgattgtctttatcagatgagtctcagcctgcagagccagggatttacttattttccttgccttactccggaccagttcagggcagaggtcgcatggcctggagattggcctgaggcccaggcaggagaggcaccagcaagggcaccagcagaggctctcgacggggcatatgaggcctgcgaggacgaagagatgatcgatttacttgatttcttaggagggagcggggccacatga

SEQ ID NO: 54577 - DNA, 492 bp, Glycine max
  Peptide Sequence Number=SeqID_146262
atggcatctcagaaaataaaatccattgctttttcatcttctcatatcagatatgatagatacaaattttcttcccctgaagcatgggatcgctacaccaacaacatcttcggcagaaagatcattcttgaaagaaatgtgcaactgctatttaatgactttgaggaatttcaaggggagttaaataggaggaactggcataagaaaatcacgaatttggaagagggaagcatagatgtggcacttgtaaaagagttttatgaaaatgtttatgatcctaaagacaagtcaccaaacacaggtcaagaaacaccagtggccatagagaaaggagaaagtcttccggcatatgcaagatttgtgttgctaaggccaaaccagcaagagttagcagcctgtttgtgtatcccaggcaagggatttgaattgaattcagacggactacctttgaagattttaaggaaaaatttgactactcttgctcaaacttag

SEQ ID NO: 54578 - DNA, 288 bp, Glycine max
  Peptide Sequence Number=SeqID_146263
atggctccgagaaagctttccgcaaagagatctaggaaggacgccgcggctgaagggaccagtgccgatcccgattttgacaaccatcgtttcaggagcgctgagcaccaacagcgtttcgaggccatcaaagaatggtcattccaccgagagagacacgtccagctcagggacgatgagtacacagatttccaggaagagatagctcatcggtgttggacgtcgctggtcactcccatggccaattttgatccggatatagttctagagttttacgctaatgcttag

SEQ ID NO: 54579 - DNA, 321 bp, Glycine max
  Peptide Sequence Number=SeqID_146264
atgcttgccgcccagctcgcccaggcgagccaggttgcttcctctagaagcaacagccttctggaggaatcttctggagggcccaagtgggcctgggtgctatttgcacccccatttttactaaaatgttacggaacctcacttaattatgcaacgatgcttccatttgatttccggtgtgtcacggaaacttacggattgtgcatcaatatattttttttcttggttttccgatatgtccttgaatttcacaaattgcctaatgatgggtgccaagcacctcacaaggaccaaagaaaggtcgcatgtcatcaagcaaag

SEQ ID NO: 54580 - DNA, 201 bp, Glycine max
  Peptide Sequence Number=SeqID_146265
atgggtatggagtatcagaagattcatgcttgccctaatgactgcatactatacagacatgagttcaagaaatgcacaaatgccctaggtgaggggtttaagcatctgtttgctaatggagatgacgcaaaagacgttacatggcatgcagatgggagaaactgcgatggaaagatccgtcaactggctgattcctcctag

SEQ ID NO: 54581 - DNA, 77 bp, Glycine max
  Peptide Sequence Number=SeqID_146266
atgaagaagatccaaggcctacaagctccacatggatcggagctacaccatgtggtatcaagagcatcttcgtctag

SEQ ID NO: 54582 - DNA, 58 bp, Glycine max
  Peptide Sequence Number=SeqID_146267
atgccggaaaatataaaaaatattgatgcacaatccgtaagtttccgtgacacaccgg

SEQ ID NO: 54583 - DNA, 132 bp, Glycine max
  Peptide Sequence Number=SeqID_146268
atggaacacttacttgttggtgatgaacaaaagcgcaaaacggaatcaaaaaaagcgaaaaagggtgaccctagggctgcaaattcgtcaatcccgtggaggtggctcgcccagctcgcccaggcgagctaa

SEQ ID NO: 54584 - DNA, 312 bp, Glycine max
  Peptide Sequence Number=SeqID_146269
atggggatcgcacccacaaagacacccagtggacctcaagaagtccaacagggtcctgggtttccagctctgattacgggcctctgtcagttctacagagtgcccgtccccccagcaagggcatcaggccccctactaatcgagctttcatcaaaaaagtgtgcccccaggcaggcacagggcgagacaccacaacagtctggggatggccgacagcgggcaatagacgcaccgccgccacctccagagcccctcagctcatctaaaaagattggagcgtggcctacgaccccgtggccgaccaacaggtga

SEQ ID NO: 54585 - DNA, 806 bp, Glycine max
  Peptide Sequence Number=SeqID_146270
gattcgttggaggagcaggcctcacagggttcgtttgtcgcccatggacgtcaggatgtactaactgctaccattgggcgactagaacaccctggtcgtgtgcgtgctgttggagttggtgtcacgatcaagcaatactttagaccggctccaaggacttcccgcacgtcttcctccatagctcccaaagacctggagcagctgacgcaacaaatcagggaccagctggaggagtcaatcacagaaaaaatgcagtcccagtttcaatcacaaatgcaatcacagggacttgcactacctcttgagcttgaggttggtccttcagctgcttgtgtcagtacaaaggagagttgtgttgatccctcagggaacgatccagacacgggtgactcagacaaatgcaggttgtacatcgaagaaaatcctccctgcctggtttccctaggaagactttatgaggaatccacaaccgttcacaagattcctttattgcatgatcaagtcaaggttggtgttgaggaggttagagatgcagatgcttccattcttgtacccactgaagaggttcagttagtggggcagacacttaacaccttccttgctttgctgacacatcttctcaagcatttatcagaacagggagctgtgggacccgcgaaacctacagatgggttggattatgatgtcgatgatccattatatctgatgaccttgaccatcgcacaactatttctgaagtcattgccggttatgtgggatgctaccgtggttggggtgtttaatgagaacttccccttgtacataaa

SEQ ID NO: 54586 - DNA, 269 bp, Glycine max
  Peptide Sequence Number=SeqID_146271
gaaaatatattgccttgcaaatttgtgatgacgaagacgttgaaacgatgctggaaagttttaaactcgcaacaagaaatgtcagttctagaattgtacatagaaaaggatgtgactggtggttcaatgtttcattatgcaaattcgcttacatcatgtgaaaattatttatctaatgatgagacacaaccgccaacaaatatgagcaatttacatcttgacgaagatgatgatgatgattatcttgtgtctaactcatacgttgaaga

SEQ ID NO: 54587 - DNA, 231 bp, Glycine max
  Peptide Sequence Number=SeqID_146272
atggctttctggaagagagagggtgctacttttagaccaaaaggccaagttgccaaaatcctgattttaaatcaaacttggaaactcttttttctacgtaaaaagcttggcatgcccggtttgaatgggttggctcaatcagaccttgcctcagtagatcttggcattcttgtcttgctgcttgtagatctgaaggtgtcatccctggatgggttgcttttgttggattga

SEQ ID NO: 54588 - DNA, 90 bp, Glycine max
  Peptide Sequence Number=SeqID_146273
gcttgtaatgagcttcaaaacaaagaaaggggaatgatcgaggccgtacccgaatcaaataaacatgaaaatgcagtaactaggaagtga

SEQ ID NO: 54589 - DNA, 1396 bp, Glycine max
  Peptide Sequence Number=SeqID_146274
ttgaccatagcagaggtgtccatagaagccattgcatcacttacccaatactacgaccagcctttgagatgcttcacattcggggacttccaattagtaccaaccattgaagaatttgaggaaattctaggatgtcctctcgggggaagaaagccatatctttcctccgggtgtctcccctctttgagcagaattgcaactgtggtcaaggattcagcaagaggtttggaccgcataaaacagactcggaacggcatagcgggcctaccacaaaagtacctagaagacaaggcgaggggtatggcccatcaaggagactggatcccgtttatggatgtgttagctttgctaatttttggggtcgtcctctttccaaacgtggatggtttggtagacctagcggcaatcgacgctttccttgcctaccaccatagcaaggaaagtccggtggtggctgtcttggcagatctatttgacacgtttgaccgaagaatagattgggaccagctcttggccgggataggaggtagaacaatcagttggttcccccgatggaaggaaggaaaagaaggagtccttttctcatgtggaagatacccaaacattccgttggtaccccatgagggagcaccgacggaagaaagcatgtctcctttcgttgtgagggatttcggcgcacaagatttcaaggctatacaagcaatccataaggcatgggaaaccccgttaaggaaagatcaagaacttaggggcattcgtaatggcatcattggtgggtaccatgaatggctgaaagttcatatacgaggtttagattggctcgccaagttaaaagtcatcagcgaagagagttttgaagcaccggaagaggacgaagaagtccaagctctcaaaagcaagttaggaaaggcaaaacttgccaaggagaagttcaagttggccgctacacacatccggaaggagtgtgccggattacgggaagagaatgcaactaccgcacgagcccttgaacaagagaccaagagggctcgcaaggaagagtatggccggaacaaatttcgcggagctctgtggggtagcaacaatgaactcaagctgcgaagggaagagagggaccagtcgcgagcacatagcatggttttgaaagaggagttagttgcctgttcaaggtccaaaagaagcttgtctcagcggttatgcgagacagagaccaacatgctagctatcatcgccaagtaccaagaagagttaggtccagccacggcccacgagcataggatcgcggacgagtatgcccaagtatacgcggaaaaagaggctagaggaagggtgatcgactctttacaccaagaggcaaccatgtggatggatcggttcgctcttaccttgaacggga

SEQ ID NO: 54590 - DNA, 240 bp, Glycine max
  Peptide Sequence Number=SeqID_146275
atgtcctcacttgagaggctacacgtcctcaccaccagagggctgcacgccctcaccatccagaggactatcagtcctcgccttgagagggctacacgccctcaccttggggctacatgccctcaccttcagaggactacacgttcctcacctttagaggactacacgtcctcgccatcagaggactacatgttccccattttcaaaggggggcatgccctcaccttcagaggattgcac

SEQ ID NO: 54591 - DNA, 174 bp, Glycine max
  Peptide Sequence Number=SeqID_146276
atgaacactaaaagaggtgtgaaagataagtgtttcactcaatttggagtgcttcttagtccaatagctcttaaggtggttggccccttgcttcttgactcaaattcttcaagatatggcaccaatcctcctttccaattccctacatggcaactcacaagcaaggaaacatag

SEQ ID NO: 54592 - DNA, 282 bp, Glycine max
  Peptide Sequence Number=SeqID_146277
atgaggatcacacaagttggcagaaaaattagtgtccgggaaaaaaaagtgaaagggaagtgtgcttgttgttttggctcaaaatttgttctatatataattggtgcctattttataccaatcttagttctgaaatttcaattgaaaattattgtgaaaacaagtgccaaaactagaggaaattggaaaggaggtttggtgccatcccttgaagaatttgagtcaagaagcaaggggccaacaaccttaagagctattggactaagaagcactccaaattaa

SEQ ID NO: 54593 - DNA, 183 bp, Glycine max
  Peptide Sequence Number=SeqID_146278
atgattttgagggggagactgctgctgctgatgatgactgatatttttcaggagaatgatagatctcatccagcgcaagttgttgcagcccagatacgcacactgctatataaacatgaaggctgcacgagttttctaccaagtccgagattgaagagttattttgtgagttttgggacttga

SEQ ID NO: 54594 - DNA, 717 bp, Glycine max
  Peptide Sequence Number=SeqID_146279
atgtttgtcgacccaaacaatgcaaacacggctacattgggtgaagttgccgagacattgcagtatatggtgtcaccacaagggcgaaacacatggacagttgatgatctcgtgccatatgtggaaaagttagcgattttatcccaagagcaagagaggatcactgagcctatgacacatggttcagcatcaaagcgtcgatttcccccacaacagtttcacatgcttcagtcaagtgttgaaactcgaggttttgacagacgaagggagattgttcaagtggaagatttttcccaacaaatggagcagcgtggccatggaatgtattacacgccaccaacatttgctcagtatccttcgcagatgtatcagtatcctttcgagggccatgacactgatatgtctgcaagcgaacattcatttggtggtgttgccgaaacacagcctcatttttcatggccgaccatgaccccttcgcagcaacatgatgccccaatggcaacacctaatgccccattaggtcagcaatgggatgtacctggagcaatccctcctatgggtgatttattaggtgttgatttgcgtcacgagttttctgcagaggctgaggaacaagggcggagacagcgcgcaagaagaaatccggatcgtcaagcccgaaggtgggatcgaccatgtggcacatcctcgcgccatcacgaacaccatgatgactga

SEQ ID NO: 54595 - DNA, 228 bp, Glycine max
  Peptide Sequence Number=SeqID_146280
atgacagaaaccgtttgtacggataaccgcatgggtatctccgcacgtcacttgacttcacgggtcaggatggcagaaaccatttgtacggataatcacttgggcatctccgtacgtcacttgacttcatgggtcaggatgacaaaaagcacggaagacgacgtaaatctccgcgtgtcaacgagttcgttggccccgattgacaaagggtgcagaagacgacgttag

SEQ ID NO: 54596 - DNA, 234 bp, Glycine max
  Peptide Sequence Number=SeqID_146281
acttatcaaggtaatccttgtggtgtctacccagacttatcttccttcaccggaagtggcgtctacccggacttatcttccttcaccggaagtggcgtctaccctgacttatcttccttcaccggaagtggcatcatccaaaaactctacagcctgtatcaagcgatccgccccgtaaggttcacatcatctggtatcagagccagactttgtgtcaaaaaaaaatctgtttga

SEQ ID NO: 54597 - DNA, 423 bp, Glycine max
  Peptide Sequence Number=SeqID_146282
gtatggcgcccaccaggcaccctaatggacccagataagtccaacggggccctgggatttcctgccttgatcacaagactctgccagtcattcggcgtccccgtcacacctagcaaggtgattcggccgcctatcacccgagcttttatcgagaagtactgcacgcagagacaggtccagtgtgatgcaccacaggtcgcggacgcgccgccacctcatcaggctggtccagtcggattgtttgatacggagcagtatttgcggcatttggttcgccagcaggcggccaaccaccgggcacatgtacagacccatgattgtctttatcagatgagtctcagcctgcagagccagggctttacttcttttccgtgccctactccggaccagttcagggcagaggtcgtatggcctggagattga

SEQ ID NO: 54598 - DNA, 56 bp, Glycine max
  Peptide Sequence Number=SeqID_146283
accaagggtttccaaatggtagaggactcaaccaaccgctacttcaaaccgttcag

SEQ ID NO: 54599 - DNA, 567 bp, Glycine max
  Peptide Sequence Number=SeqID_146284
atgagtgcacagagctgcaactctggttggtcctggtccctccggtcctcgagaaacgatcctgagacgggtgactctgacaagtgcggcttgtacatagaagcagatcctgcccgcctggttgccgtggggagagtttatgagggatccactcttgttcataacactcctttgttgcctggccaagtaaaggtgagtgtggatgaggttaaagatgcagatgctccagttcctatacccattgatgaggtttccttagtggggcagacacttcacaccttccttgcttggccgacacatctagtcaagtctttatcacaccaggtagatgtgtctccgccaaaaccacctccgaagcccgatccggaggtcgatgatctgctttatctgatgacattgaccatcccagagcttttcttgaggccttatcaggttagatgggatgccactgtgttcggggtcgttaatccagatttccccctgtacataaagcacgaagacctctccgaaatcacacacggtggtcaatgtctcaacatatcagtgttacagttgtggattctgtaa

SEQ ID NO: 54600 - DNA, 360 bp, Glycine max
  Peptide Sequence Number=SeqID_146285
atgcctagacaggcgcagggtggcgacccgcaggccccagacgcaccaccgctacctcatcaggttgatccagctgggtcatttgacacggagcgatatttacagcatttggttcgccaacaggcagccaaccacagggcgcacgtgcagacccatgactgtctctaccagctcagcctcagcctgcagagccagggtttcgctccttttccatgccctactccggatcagttcagggcagaggtcgcatggcccggagattggcctgaggcccaagtaggggaggcgcccgcagaggctcccgacgatgcagatgaggcctgcatggacgaggagatgatagatttactcgatttctag

SEQ ID NO: 54601 - DNA, 369 bp, Glycine max
  Peptide Sequence Number=SeqID_146286
atggatatctctgaagatactgacatccctataatcttggggaggccgttcatgttgactgcaagctgcatagttgacatggggaaaagaaagctggagttaggttttgaagaccagaaaattgattttgacttgtttgttgaagacaagcttgctccagaacacaatgttttcttgcaggtaatgggagaaggtcaagaggttctgaaggtgagaaccaaaacgaacttgctgtataatctaaacattggagcatatcaacctccctttgaatgtcctttcactaagcgtctatttctcgctaagcgcataatcatttatgcgctaagccacgagttcaagcacttagtgcacaaccctggcatctga

SEQ ID NO: 54602 - DNA, 327 bp, Glycine max
  Peptide Sequence Number=SeqID_146287
atgtcagaacttacacgtgattctcctcaaatttcagccagcccgcatcaactagaccttgtaccttacgcttcagggccctacaatgctcaatggaatgccccggggcttctccatgagaagcacacgttgcgttcgagtcgtattctcggagaaatggaggttgatgaaccttggctggggttatggctaccattgaattatcaagtggattttgtggttgattcagggatggcctttatggataactgggtggtgggtaaggagaatggttgttattggctgagtaacgacattgttgggctggtgggaagtttggccatgtag

SEQ ID NO: 54603 - DNA, 225 bp, Glycine max
  Peptide Sequence Number=SeqID_146288
atgaagtttgatggttcacatattatgcatgagcatgtcattgagatgacaaacactgcagcaagacttaagaccttgggaatggctgtgaatgagaacttccttgttcagtttattttgatctcattaccatctgagaagaaacaaagcttaagaatcaaggaagtcactcagtccgttatgcaagcgaccaagggaatcaatgagctggaaagaaatttgtga

SEQ ID NO: 54604 - DNA, 207 bp, Glycine max
  Peptide Sequence Number=SeqID_146289
atgactagaggcaacccatctgacttacaaccctttgatcctgagatagataggacatttcatagattagttaggcatcattttataccttttgatcatcctgagcattccattactggtgaatctgtgcattctgttattggtgattttgaacatcctgattttgagcattctgattttgaacattgcacaacctccaccccgtga

SEQ ID NO: 54605 - DNA, 166 bp, Glycine max
  Peptide Sequence Number=SeqID_146290
atggttggatggaatgatcgtgcaatagcggatgcccttcaagcattagctcaggctatagggaatccgaataggggagaagctggtggagctgttgagtaccagggcttggaccgcttccaacgaaacaaccctccttcattcaatggaggatacaaccctaatg

SEQ ID NO: 54606 - DNA, 91 bp, Glycine max
  Peptide Sequence Number=SeqID_146291
gggcattgcacaggccgaaaggcatcctcctataggcaaaagtgccgaaggggcaggttcatttgcggatgaggaagatgttgctggttga

SEQ ID NO: 54607 - DNA, 317 bp, Glycine max
  Peptide Sequence Number=SeqID_146292
atgaatccttgagtgaaacacttgaaagattccgtggcttgttgcggaaaacaccaactcttggattcttcgagccgattcagctgaacattttcatagatggattgagaccacagtccaagcaattattggacgcttctactggagtaaaaattaaattgaagactcctaaagaagctatggagcttattaaaaatatggctactagtgatgatgtcattctgcatgatcgaactcatgtgcctacaaagagaagcctacttgagctttcttcacaagatgcactattggcgcagaacaagctgctagctaagtag

SEQ ID NO: 54608 - DNA, 78 bp, Glycine max
  Peptide Sequence Number=SeqID_146293
atgccggatgtgtcataccctaatttcgtccggggacctttgcttgatgacatgcgacctttctttggtccttgtgag

SEQ ID NO: 54609 - DNA, 965 bp, Glycine max
  Peptide Sequence Number=SeqID_146294
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtagccctcccttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagcgagcttccagggggaaacgcctg

SEQ ID NO: 54610 - DNA, 609 bp, Glycine max
  Peptide Sequence Number=SeqID_146295
atggcggataagtttcacattttgcttctgaacggccccaatctcaatctgctggggacgcgtgagccggagaagtacggcagcacgacgctgacagagattgttaacggattggaaaaccaggcatccgcattggatattaccctgagccatctgcagtccaacgccgagcatcagctgatcgatcgcatccatcaggcgcgcggcaacaccgatttcattctgataaatccggcggcgttcacgcacaccagcgtggcgttgcgcgatgcgttgctggcggtgcagatcccgttcatcgagatccacctgtccaacgtgcacgcccgcgaacctttccgccatcactcttatctctcggacgtagcgcggttaaccgtctgtcgaaaacccactaatgctccacaaaaagagtacggaatcacactcatggatattcgtaaaatcaagaaactgatcgaactggttgaagaatcaggcatttctgaactggaaatctctgaaggcgaagaatcggttcgcatcagccgtgccgcaccggcgcaggcttatcccgtcatgcagcaggcctacgcgatgccggcacagcactcagccagccctggctaa

SEQ ID NO: 54611 - DNA, 255 bp, Glycine max
  Peptide Sequence Number=SeqID_146296
atggaaatcaaaaagaggttgtcgtcccttgggacggacgtgtggggtgctaataccttccccgtgtgtaaatacaactcccgaacctttcacttaaaagttcgtagatcgcgtcttttctggtttttccgacgttttcctcaaataaacgttggtggcgactccgcgcgtattcctttcgtggaacacgcatcccgcgagtctcgcgtcgccctcccgccgaagggtaggttgcgacagtcatatctctcttga

SEQ ID NO: 54612 - DNA, 476 bp, Glycine max
  Peptide Sequence Number=SeqID_146297
tgtctccgtctaccttgaagtggaaatgcaaagtcacacgactacgatccttggccactagactacctggggtagaaagaccagtggtccacgtcgatcctgcaattgggaaggccaacggtccccacaagaagaaattaagaacatatttggggattattgctcgtgataaggtcgacgtgacatacgagacttggaaggaagtccctgctgctcagaaggatttgatatgggaggatattcaggacagtgtggacgacactgtttctgaaaaatacgacattagcaaggagaaatgggcccagttttgtcagacccacagagacccctcgtgggagaaaaaaggcacaggccatccagaagcaaaacactgccctccacgtgttgtctcgtgggggggcgtcattgaccctccatctcccatcagacgacacgtgaagaggaagatggccgcaccaagaaaatttggcagatga

SEQ ID NO: 54613 - DNA, 423 bp, Glycine max
  Peptide Sequence Number=SeqID_146298
atgtgttatgagaaagtactcaggcggttagtccttcgaaactttgtgaagggggaaaacaaaagatatctcaggcaattagtccttcgaaatcttttgtttaagggaaagggaagaatcaaaagaattctcagactgtgtcattttgaattctttgacaagggagaagggagacacaaaagaattcaggaggttagtccttcattcttttggaaaagggagaagagagacaccaaaaagaattcaggcgaaaactttagaaagctttttgcaaaggaagaagaagaagaagaagaagaagaagaagaagaagaagttcaaagagattcaaaggttgtaaaagaatatgtggaaaagttgtttgtaaaggttgtaagtattactcttcaagtctggtcaagaaaaccattggaagagttataa

SEQ ID NO: 54614 - DNA, 351 bp, Glycine max
  Peptide Sequence Number=SeqID_146299
atgttggtgcgcatgatccgcactcgtctctttgcagcggcacgggtgaaatcttgccccgttatgcatagtagctgtgtgatagcctccctctcttgttgtgctcgcacagttggccctcctccaatatcagggggtggcccaggaaccattaaaaggaaactactggtgcggatgtggagcacactgaaaatgaggacacgtagccctctaaaggtgagggcgtgcagccctctcaaggcaaggatgtgtagtcctctggaggtgagggcgtgcagccctctattggcgaggacgtgtagtcctcttcaaggtgagggcgtgcagctctctgttggagagggcgtgtag

SEQ ID NO: 54615 - DNA, 363 bp, Glycine max
  Peptide Sequence Number=SeqID_146300
atggagagtctgagaaacttttaccttagcttaagtgggttcatgggattaatccctcatcaactaggaaacctctcaaacctgcaacaccttaatcttggatacaattatgctcttcagatagataaccttaattggatatcaaggctatcttccttagagtaccttgatttgagtggttcagaccttcataaacaagcttgttctaacttagagaaaatatggaaactttggaaagaagctgaattcctggaggcatcttttagagcaaaagctaattctctgcaagaggtacaccttccaaccctcaccaacctccttgatcaattctttggaacaatgcataatggatatctaccttga

SEQ ID NO: 54616 - DNA, 251 bp, Glycine max
  Peptide Sequence Number=SeqID_146301
atggaacacgcatcccgcgagtcacgcttcgcctcccgccgaaggaagaaaaaagaaggagtagagacgagagtcgtcatcacggaaagggcaggacggacgaaatcagtgtcctatctttgctttcctcttatctccgatgagagggtacatctacttgggttgttgactgagaacaagagagggtatctctcttgtggatcagttctagtagagggtacatccactaggttcaatgtgaacaagggagg

SEQ ID NO: 54617 - DNA, 489 bp, Glycine max
  Peptide Sequence Number=SeqID_146302
atgtcctcaccatcggaggactttacgtcctcacctttagaggactacacgtcctcaccttcaagaggactagacgtcctcgcctttagaggactgcacgtcctcgccttcagaggactgcacgtcctcgccttcagaggactacatgtcctcaccttcagaggactacacgtcctcgccatcagaggactagacgtcctcgcctttagaggactatatgtcctcacctttagaggactgcacgtcctcgccttcagaggattgcacgtcctccccttcagaggactgcatgtcctcacctttagaggactgcacgtcctcgccttcagaggactacacgtcctcgccttcagaggacaacatgtcctcgccctcaccttccgaggactacataggactgcacgtcctcaccttcagaggactacacgtcctcgccttcagagggctgcacgtcctcacattcagaggacttcacgtcctcacctttag

SEQ ID NO: 54618 - DNA, 477 bp, Glycine max
  Peptide Sequence Number=SeqID_146303
atgccatatgtggaagccacggaggagtcattggaaacagccttccaatcttttgaggtagtaagcattgcctccgtagattccttctctgggcaaccttgcgtgtccggtacggcaatgatggtggcccgggtgatgttggggaatggctacaagcccgagatgggcttaggcaaggacaacggcgggagaaccagtctagtaaacaccagaggaaaccgcgagaagtttggattatgctataaacccacacaagctgacataaggaaaagtgtcacgggaatgcagagcagaagccacggttcgcaattgggacgacaagtcgaagggggcccgccctgtcacatcagtaggagctttataagtgtgggtctaggacacgaaggccaagtcgttgcgatatgcgaggatgactctccgagtgggtcggatttggtacgaccatgccctcctggtttccgactaggaaattggtga

SEQ ID NO: 54619 - DNA, 248 bp, Glycine max
  Peptide Sequence Number=SeqID_146304
atggctgaagagccaagaagagtaaccctggaggattattcaagttctactacgacacaatttttcactagtattgcacgaccagaagttcaagctcggacaattacatatcctacttctatgatacagctgattcaaaataattggtttcatggtctacccaatgaagacctttatgctcacttggccacctatatagagatatgcaatactattaggttggcgggtgtgcttgcagatgcaatcag

SEQ ID NO: 54620 - DNA, 705 bp, Glycine max
  Peptide Sequence Number=SeqID_146305
tgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagtttcctcgggccagacggagattggccctcgagtgcaaaggcagaagggagcttgactgcaagacccacccgtcgagcagggacgaaagctgatcttccccaagagctcacatcgacggggaaggtttggcacctcgatgtcggctcttcgccacctggggctgtagtatgttccaagggttgggctgttcgcccattaaagcggtacgtgagctgggttcaggaacgtcgtgagacagttcggtccatatccggtgtgggcgttagagcattgagaggacctttccctagtacgagaggaccgggaaggacgcacctctggtgtgccagttatcgtgcccacgagcctccggtagcacagccgagacagcgatgggttctctgccccagcggggatggagcgaaagaagttttgagaattcaagagaag

SEQ ID NO: 54621 - DNA, 165 bp, Glycine max
  Peptide Sequence Number=SeqID_146306
atggggggcggggggtttagttgtttgggaaactgccaggaaccacattacaaacaaacctcaaagagagttgggcttcgtcctcaaaaggaaacaacaccagaaaatctagccttccatggattcaaacagaaaacgcaaatgaaacatgaagcagaaacgtaa

SEQ ID NO: 54622 - DNA, 486 bp, Glycine max
  Peptide Sequence Number=SeqID_146307
atgcatagatctcccacaggcaatttagttcctctggacttagaaattgaagctacattgagaaggaacagggccaagaggagaaggaaacttctgcaagacagaacagttgaatccattcttgaggaagaaactcatttttctaattcattatcacctaattcaccatcatcaagggaatccactactcaattgcctgaaaccactagcatggcagatgagcaacaccagaggatcacccttgaggattattcaagcagctcagtaccgcaattcgttactagcattgcgcgtcctgaagtgcaagctcataacatcaactacccgcattctttaattcatttaatacatgggaatttattccaaggattacctaatgaagacccctatgcacatttggcaatgttcattgaaatatgcagcactgttaagattgccagtgtgtccgatgaagctattagactcagcctattctcattctcattg

SEQ ID NO: 54623 - DNA, 322 bp, Glycine max
  Peptide Sequence Number=SeqID_146308
ccgaacgaccgagcgcagcgagtcagtgagcgaggaagcggaagagcgcccaatacgcaaaccgcctctccccgcgcgttggccgattcatgaatgcagctggcacgacaggtttcccgactggaaagcgggcagtgagcgcaacgcaattaataggcgctgtaactcgctcactcactcacttactcactgcgttgattttgttcttcacatgttgaagaagaatggcagcgaaaaaggaaacaacaaggagaacgaagacaccaccatcaccgatgtcttgaaggtcgaagcgcactacgacggttgcactcccgtatag

SEQ ID NO: 54624 - DNA, 171 bp, Glycine max
  Peptide Sequence Number=SeqID_146309
atgtctcgaggaaatttcaatgggggtttaccggaaagcgcaccgggtcgtcaacctaaattactaaaccctcgatccctcgtcaggctgaatatccaggcttcgtccgtagatccctcatttaagactacacccaatttagacagccctcttaggtttagactaacttaa

SEQ ID NO: 54625 - DNA, 486 bp, Glycine max
  Peptide Sequence Number=SeqID_146310
atggctccgaaaaagctttccgcgaagagatctaggagggacgccgcggctgaagggaccagtgccgccctcgagtttgatagccaccgtttcaggagcgccgagcaccagcagtgcttcgaggccatcaaaggatggtcgttccatagagagagacacgtccagttcagggacgatgagtacacggattttcaggaagagatagctcgtcgacgttggatgtcgctggtcactcccatggctaagtttgacccagatatagtcctggagttttatgataatgcttggcccacagaagagggagtgcgggacatgcggtcatgggtgagggtgttagaggaaggccaggagtgcgagtttagtcagaggaggaacagggccgatgggttcgacgaagaggccatgcccaactattatgcataccgggtcaggatttcgctcagactgctgcagggaggcgggtgcggatcatgcgcaccagcatga

SEQ ID NO: 54626 - DNA, 258 bp, Glycine max
  Peptide Sequence Number=SeqID_146311
atgtcaattgttcaagatgcttttaatacgtctcaggtcaacggtactcgagatgatgttttgcaatgggctcaaacagttgtccatgaaaatgaatttgttgcagtgattatgaggtctgacacagataccggtagcagagaaagaagttcatttgtcttaattgggtgtgaaaggagtggtacgcacaagtgtaggaataaagaattcgttagaaaagacactgggagtaggaatcagaatctatacgtcagttaa

SEQ ID NO: 54627 - DNA, 1003 bp, Glycine max
  Peptide Sequence Number=SeqID_146312
agcattctgaaagatgcttctgtgcctgatgctgagaaagaggttccaacatcttccaccccagaggtttctgtgcctgatgtcaataaagaggttccaacatcctccgctccaaatgctgaagtcctcccttcacccagtgaagaggaatcaacagaagaagaggatcaagcctcagaggagacccctgcaccaagggcaccagaacctgctccaggtaacctcattgacttggaagaagtcgaatctgatgaagaacccattgccaacaggttggcacctggcattgcagaaaggttacaaagccgaaagggaaaaacccccatcaagaggtctggacggatcaagactatggcccagaagaagagcactccagtcactcctgccacatccagaagaagcaaggttgctatcccctccaagaaaaggaaagaaatttcctcatccgattctgatgatgatgtcgaactagatgtctcgacatctaagagggccaagaaatctggaagaaaggtgcctgaaaatgttcctgatgcaccattggacaacatctctttccactccattggcaatgttgaaaagtggaaatatgtgtatcaacgcagacttgcggttgaaagagaactgggaagaaatgccttggattgcaaggagaccatggaactcatcaaggctgctgaactactgaagacagtcaccaagttgggagactgttatgaaggcctagtcagggaattcattgtcaacattccctctgacatatcaaatagaaaaagtgatgattatcaaagagtgtttgtcagaggaaaaccaacagatggagtgatggatattgctgtctctgagcatcaaattgccaaggaaatcactgccaaacaagtccagcattggccaaagaaagggaagctttctgcagggaagctgagtgtgaagtatgcaattctgcataggattggtgctgcaaactgggtacccaccaatcatacttccactgttgccacag

SEQ ID NO: 54628 - DNA, 228 bp, Glycine max
  Peptide Sequence Number=SeqID_146313
atgacggtgaaacctctgacacatgcagctcccggagacgttcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 54629 - DNA, 855 bp, Glycine max
  Peptide Sequence Number=SeqID_146314
atggccaagtttgatccagatatagtcctcgagttttacgccaatgcttggcctacagaggagggcgtacgggacctccggtcgtgggtgaggggccagtggattcctttcgatgcagacgccctcagtcagttcctgggatatccgctagtattggaggagggccaagagtgcgaatacggtcagaggaggaaccgggccgatggatttgatgaggaggccatcgctcagctgctatgcataccaggtcaagattttgcccggaccgctgccgggagacgggtgcgaatcatgcgcaccaacatgactaccttgagccagacatggatgatgttgctgctcagcaacatcctgcccaacgatcataattccgacctccctctgccgaagtgtgtgccaccaaccaggcaccctttagacccagataagtctaacagcgccctgggttttccggcattgatcacgggtctctgccagtcgttcggggttcctgtcacacctaacaggagcagggtggcgacccgtaggccccagacgcaccgccgccacctcatcaggttgatccagctgggtcatttgacacggagcggtatttacggcatttggttcgccagcaggtggcccaaccacagggcgcacgtgcagacccatgactgtctctaccagctcagcctcagcctgcagagtcagggtttcgccccttttccatgctctattctggatcagttcagggcagaggtcgcatggcccggagattggcctgaggcccaggtaggggaggcgcctgcagaggctcccggcgatgcagatgaggcccgcatggacgaggagatgacagatttactcgatttctaa

SEQ ID NO: 54630 - DNA, 875 bp, Glycine max
  Peptide Sequence Number=SeqID_146315
atgggttctgtcttgatccctactgtaaacaaaccaacggagggtccgtgtcgccttcttaaaaacgtgcgtcggggcattttgctacccctagacgtcgtatctaagaaggggacaaattccccggacccccgcattcctagattgcatctgtgtcatatgcattccatcatgcattcatccattccacccatgagatatcggagttttgatttgcaccagcttttgtctcactttagtaagcatgggaacaaatcaaaccggcaagaggttctaccaagtcaaggtcaaaagcctagataccaccagcatcaaggaattagggcggttgatggacccctccaaatgcaagccttccgcaagacttacggaaagatcttagagttgaccatagcagaggtgtccatagaagccattgcatcacttacccaatactacgaccagcctttgagatgcttcacattcggggacttccaattagtaccaaccattgaagaatttgaggaaattctaggatgtcctctcaggggaagaaaaccatatctttcctccgggtgtctcccctctttgagaagaattgcaactgtggtcaaggattcagcaagaggtttggaccgcataaaacagactcggaacggcatagcgggcctaccacagaagtacctagaagacaaggcgaggggtatggccaatcaaggagactgggtcccgtttatggatgtgttagctttgctaatttttggggttgtcctctttccaaacgtggatggtttggtagacctagcagcaatcgacgctttccttgcctaccaccatagcaaggaaagtccggtggtagctgtcttggcagatctatttgacacatttgaccgaag

SEQ ID NO: 54631 - DNA, 331 bp, Glycine max
  Peptide Sequence Number=SeqID_146316
atggtgcttagaaccatgccacccaagttcaagcatattgtggtagccatcgaggaatccaaaaatcttgaagagcttagcctagaggaattgcagggatctttggaatctcatgagcagagaatgaatgaaaggatcaatgagaagaaaagtgaacaagccttgcaagcacggtctaatccaaagaagcatggtgctagatggaagaaagagaaaattgaagggaaaaacaataaatggagaggaaatcagaacagtgataaggaccacaagaaaggagggggatccaattcccaaaactcttcaaatagaaagaagttcgacaaaagaa

SEQ ID NO: 54632 - DNA, 294 bp, Glycine max
  Peptide Sequence Number=SeqID_146317
atgccaagtctctatgaccgaaccacaaagctggaagagactttagctcaattcatgcaagtgtcaatgtataaccaaaatagcacggagtctgcaattaagaatctagaagttcaggtgggccagcttgcaaagcagttagctgaaagaccatccagcagctttacagcaaacacggagaaaaatcctaaggaagagtgtaaagctgtgatgactagcagcagaatggcgattcaagctgaggaaggaagagctaatcaaaaggtggagggatttcaacaaatagttggttga

SEQ ID NO: 54633 - DNA, 153 bp, Glycine max
  Peptide Sequence Number=SeqID_146318
atgtgcagcgctactgattacaaagttaaatcaatcgaagtttgtctgggagccatacacagcaactgtgatggcagcgttgcctccaatttgtgtggttggaagtgtagcctggtttgcggtggtgccactgatttgtttccatgttgttga

SEQ ID NO: 54634 - DNA, 117 bp, Glycine max
  Peptide Sequence Number=SeqID_146319
atgaccgatcgaggccaaatacagtctaaagccctagtggagaaggacgaaggcttttgtggagaaggacaaagcccccgagtggagaaggacgaaggcccaagtggagaaggatga

SEQ ID NO: 54635 - DNA, 276 bp, Glycine max
  misc_feature (5)..(5): n is a, c, g, or t
  Peptide Sequence Number=SeqID_146320
ggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccaactacgccgaggttgtctcgctaacctcgtttctttctggctctcctacatcatag

SEQ ID NO: 54636 - DNA, 120 bp, Glycine max
  Peptide Sequence Number=SeqID_146321
atgtgggacaatgtgggtgtcgagggagcggtttccgacagatttcaggcgggaagagaaagagaagagcgactgcaagttaacatcggttttggaaaaaccgatgctaacatcatatag

SEQ ID NO: 54637 - DNA, 696 bp, Glycine max
  Peptide Sequence Number=SeqID_146322
atggaaggaagaaccagagttcttatttcatgcggaggatttccaaatgttcccttgatggggacgaggggttgcatcagctacaatcccgttcttgctataagacaacttggctaccctatgagaggggcgccactagaggatgagctcacgcctatcatttcacgtggtttcaataagaccaacgtggagacacttcagaaggtccgcaaggcatgggaggtgttgcaaaagaaggacaaggaactcaggggcaacaacaatgggcccatcagtggctaccgtaagtggttgagagcccacgtgcaaggtttggattggctcctgagtttgagaaccgcaaaaagggaggaagttaaggcaccggaggaagacgaagaggtgcaggtccttagggcagaactcgagcaagcccaaacagtcaaagaaaggttcaaatcagcagctctgaagatccgaaaggagaatgccgaaataagagatatgaatgtagctaccaccaaagccttggaacaagaaaccaagagggctcgtaaggaagagcacggtcggaacaagttccgaggggctctgtggggcagtaacagcgagcttaagctctggagagaggaaagggaccaatcacgagtagacagtttgatcttgaaagatgagttgaaggtttgctcaaggttcaaaagaaagttgtctcagtag

SEQ ID NO: 54638 - DNA, 303 bp, Glycine max
  Peptide Sequence Number=SeqID_146323
atgtcagtgaaaaacctcgtcgggtgcttaggagtacatgacaagacaaatcacacactagcaagtcagatcactcttactagggttagaggagcactcaaactgggtgtatttacccctaaggcctacattccgaagagtccgtcagggcctctccctcctgattcaggtccaacccagaaaagatttttgtacacagactctatctatgaacggtacaaaacacatgacttctcaattgttctcaaaatagttttaactcgtcaccctttaagggtcttagcattaactcgtcgcccttaa

SEQ ID NO: 54639 - DNA, 338 bp, Glycine max
  Peptide Sequence Number=SeqID_146324
tgatcaaggggttcccatgaaccctaagagaataaaggtcattcctgaatggcccactccaccaacaccacttattgagttggtgagaaaccatgttccttcatgggaagatgcccaggaaatgggtgttgagggaaggagcccagagtatgaagaacctcgggatttgaggtcaaatcctttccaaggtggagggaatgatgcaatcctactccgtaagggcattgggggtgagcttagctattatagggggtgtgtagctaagctctggcttctcatctcaaggaggaatcttcttaaggaagcttctcaaggaggtgagcttagttatgagaggg

SEQ ID NO: 54640 - DNA, 734 bp, Glycine max
  Peptide Sequence Number=SeqID_146325
atggctgctggccgcgctgcccggcatggcggcacagctgctgctggcgaagaacgctaccgcatggcatatcccgttcagcttcctgctgtcgctggcgctgtgcggataactctgcccgctcgcgctggctgttcgcctgccgcgtcgctgaactcaccgctggtggcatctgttgctccggggcgaccatgctcggtgcgttctttattgccacaactgatacgcggtcactcgcgtccaccacgcaaccgtggccggctgatttacggtgcgctgattggcctgctggtgtggctgattcgcagcttcggtggctatccggatggcggactgatgatgatcgaaaccattcgtaaaaacgcgttcacgctgggcatgtttgccgtgatcaccaccggcgtgacggcggtggtcaactatgtcaccaaaccgacggtcgatcaccagaccgcgctgcagcagaaaaacctgctcgaccaggtggtgcccaccgatttgtacgacaacaatattcagcaggagtgtctgctggtgaccgatgcccgcgcgctcggcaacgacaaaccgcatcatctgtatgtggcgcgcaaaggggatcaaccggtggccgccgcacttgagaccaccgcccctgacggctattctggcgcaatacagatgctggtcggcgctgatttccatggcaaagtgctgggcgtacgcgtaattgacatcatgagacgccggtctgg

SEQ ID NO: 54641 - DNA, 279 bp, Glycine max
  Peptide Sequence Number=SeqID_146326
atgacattgctacttagcaacattctgcccagcgaccgcaatgccaatctccccctgcggaagtatcagttggtctgtgtcgtcccgacatgggtgtcataccctaatttcgtccggggacctttgcttgatgacatgcgaccattctttggtccttgtgagaaggcggttgcttctggaggaagcaaccctgctcgcctgggcgagctgagctcgcctgggcgagctgagctcgcctgggcgagctgggcggcaaccacctcccctattttgctataa

SEQ ID NO: 54642 - DNA, 399 bp, Glycine max
  Peptide Sequence Number=SeqID_146327
atggagtgcctagagggattttgggagaccctcgaaggcaatgcgaggtgcctattccgtggcacgatccgactcatggctacttcgttggtacatccagacgaaccagcacgcacgcttcagcgcactgtggagtggatattacctacacctacttcatatctactagtggagccagtccaagtgattgaggtgacgtcatttgaggaagaccccgaggaggacccagaggagctacctcctaagcctgctgtggatgctcttgactttctagagggtgatgaggacccactccctgaggtggattctcccgaggacatcatgtcggcatctgaggcagactctacggaggagagcggtcccggagggatagcgactagtggaggttcttcatcatag

SEQ ID NO: 54643 - DNA, 444 bp, Glycine max
  Peptide Sequence Number=SeqID_146328
atggaaaaatccaacaagaaaactttcaaagataagaaagaaaagaaaacatacatcacttgggaagataatgacatggattcatcaagtgattcagaaaatgaaatcataaatatgggcctcatggccaaagactatgaaagcggagaagaggtaatgttttctaactatgacttatctatttcttttgatgaactccaagatgcattcaatgacttgcataaagaatctatcatacttgccaagttagtttcatattctaagaaaactatttcaagtttagaaaaggaaattttgaaattaaatgtagagttagaaaatgatgcaatcctccccaggaagggaccagtcaccagagtcatgagcaagaggctccaagaggattgggctagagttgctgaagaaggccctaggattctcatgaacctcaggatagatttctaa

SEQ ID NO: 54644 - DNA, 105 bp, Glycine max
  Peptide Sequence Number=SeqID_146329
atggactattttgaatttaatattaagttagggactaatatgcaaaatgggaacaatctcagggacgaaattgcctattcacttaaatttgtgattcaatatgat

SEQ ID NO: 54645 - DNA, 147 bp, Glycine max
  Peptide Sequence Number=SeqID_146330
gctcataagaaccctagggccttctcttgcatctctggcccaatctacttggagtttttctatccaatgcccttgcggagtaggattgcatcacctggtgcttaccaacatggatggcgaagagctaccttcacccgtgaactctga

SEQ ID NO: 54646 - DNA, 336 bp, Glycine max
  Peptide Sequence Number=SeqID_146331
atggctccgaagaaactctccacgaagaggtctagaagagatgccataggagaagggtccagtgccgccccagagtttgatagtcatcatttccggagtgttgagcaccagcaacgcttcgaggccatcaggggatggtcgttccacagggagaggcgtgtccagctcagggaggatgagtatacggactttcaggaggagatagctcgcaaacatttgacaccgccggtgactcccatggccaagtttgaccctgagatattcctagagttctatgctaatgcttggcccatggaggagggagttcgagacatgcgtttgtgggtgaagggttag

SEQ ID NO: 54647 - DNA, 414 bp, Glycine max
  Peptide Sequence Number=SeqID_146332
atgtcggccgaaaaaaacccgttcttggtatatttgacgaccgatgtcgcctatggttgttttcctcaatccctgaataatcaatcggttaggaactattcggttaacgccagcatgctaaaggcccaagtggagaaggacgaaggcccaagtggagaaggacaaagcccccaagtggagaaggatgaaggctcaagtggaacttatcaaggtaatccttgtggcgtctacccagacttatcttccttcactggaagtggcgtctacccagacttatcttccttaaccggaagtggcgtctacccagacttatcttccttcactggaagtggcgtctaccatgacttatcttccttcactggaagtggcgtcatccaaaccttcgtagcctgtatcaaacgatccgccccgtaa

SEQ ID NO: 54648 - DNA, 342 bp, Glycine max
  Peptide Sequence Number=SeqID_146333
atggcttcccctggacctgttttctccttctccgggactccaaccatcacagctgctaaactcaattggaaaaattacccctcatggtctgcttccgtagaactttggtttcttggtcaaggacaccatgaccacttggagaaagcttccgattctgtttcaagtgacaaaagagccgaatgggagaagcttgattatcaactgtgtgctgtgttatggcaatcagttgagccggatattttggatatccttagatcatttaaaacgtgtcgttccttttggaagaaggctcaagaaatttttgccaatgatattcagagcttatttgatgcaaccatgaag

SEQ ID NO: 54649 - DNA, 582 bp, Glycine max
  Peptide Sequence Number=SeqID_146334
atggataatgaagagggcgtgcaggaacagatgaaggccgatctatcggctttaaaagatcaaatggcttccatctcggaggataaagccacggcaaccgcctccagtacagttagggaagcggagccggtgctgcagcccgccttaaattcgggccaagacagaaacactgcagtgtttggtcgaaggtatagcccgcaagcttatccttatggcttgcctccggacttcactccctgtgccaccccggaagatttaagccaagcccccaccttcgaggggcaactcccaccttatgatgactatcccgggcaagacgatgaggaaggagatacccatcttggccccctgctccacctcaaagatccgtccccccatgaactaccccaaccaaacatagtccgccatatcccggcttcacccacacccgtaaaagaatctgttcccttcgtggaagataagggaaagattgaggcacttgaagagaggttgagagcagtcgagggcctcgacaattacccattctcggatctagcggacttatgtctagtacccaatatcgtcattcctcccaagttcaaa

SEQ ID NO: 54650 - DNA, 294 bp, Glycine max
  Peptide Sequence Number=SeqID_146335
atggtcatgttggtgtgcatgatccgcactcgtctctttgcagcggcacgggtgaaatcttgccccagtatgcatagtagctgtgtgatagcctccctctctggttgtgctcgcacagttggccctcctccaatatcagggggtggcccaggaaccatatggagcccactgaaagtgaggacgcgtagtcctctaaaggcgagggcgtgtagccctctgaagttcaggacgtgtcgcctttcgaaggcgagggagtgtagtcctatgatggcaaggatgtgcaatcctctgaag

SEQ ID NO: 54651 - DNA, 555 bp, Glycine max
  Peptide Sequence Number=SeqID_146336
atggatagacttggcagctcaagtagcgcccccaataacagagaaagagattatcacaatgatagtagacatgttaccagtgttctattatggaaatggtgggttacacaccttcaagctttgcggatttggacttcacccggcagaaggatcaaagcgggtctgaaaagaggcaaatttaatcatcccacttggacgaatgagaaaactggggcaaatgaagagggtgaggatgaaggaggagcccatgctgtgactgccattcctatacaaccaagtttcccaccaacccaacaatgtcattactcagccaataacaaaccttctccttacccaccgcccagttatccacaaaggccatccctaaatcaaccacaaagtctgtctaccgcacttccaatgacaaacatcacctttagcatgaaccaaaacaccaaccaagaaatgaattttgcagcgagaaagcctgtagaattcaccccaattccagtgtcctatgctgacttgctcccatatctacttgataattcaatggtagctataaccctagccaag

SEQ ID NO: 54652 - DNA, 402 bp, Glycine max
  Peptide Sequence Number=SeqID_146337
tcagctcgtgttcaaggggggcattcatactggtggagggacctaagaaagctttatcaccagtctgatcaaagcatttttcaacaatgcatgagctggaagcaacccgaccttatttcaatgatgagaaatttctctcaagataactggagatgggacttgaaatggaggaggaatctgtttgatcatgaaagtgatctagctgtcaattttatggaagaaatcagctctatacatattcagaggcatgttaaggacatcatgacttggaaagttgatcctagtggtgtttattccacaaagcttcttaaagataggctccctactagagctaatctcataagaggaaatgtgatcatccaagacactgtttgtcccctctgtggcctagaacaggaggag

SEQ ID NO: 54653 - DNA, 432 bp, Glycine max
  Peptide Sequence Number=SeqID_146338
atggaggccatgaaagagcaaatggccacaatgatggaggccatgatgggcatgaagaagatattggaggccaatgcagttgcagctgcccttactagcgtcgttgctgaggtggactcgactcccccatctggcctcgaccaaataaattatccaacctcgaatatgataggtcagggtggaaaagaattgggaagtacgagaggcccccatttcgtgcaaaatgtcaataactccactcccatactcattgagagccaacaacctcaatctgatcatgcacatgtctctcaacccatgagggaggcacatgaaataccccaccataatctagccgacttcgagccttgcctcaaatacgccactgaaggacaagcagttggtggtgtacccctgccaaacactttggagggccctcaatttctcctataa

SEQ ID NO: 54654 - DNA, 604 bp, Glycine max
  Peptide Sequence Number=SeqID_146339
atggtgaatcaaaggagctcaaagatcaatcacaagaacaactcaagtgaatcaagaacaattcaagagttcaagaatcaagaagaattcaagactcaagaagaaagcctagaatcaagaatcaagattcaagaaagtctaaccacttcaagattcgtggcctcttcaaatcccttgtttcctgaaggaaattccattcacagaccacccattttcaatggtgagggttaccattattggaaaacccgtatgcagatattcattgaagccatagatctaaatatttgggaagcaatagaaataggaccacacatacccactgtagtagatggacaatggaggaaccaccctggaaatcagttcaacagagatcaaggtggaccatccacaaggccatcgcaacaaaggcctagtctctatgatcgcacaacaaagctggaagagactctagctcagttcatgcaggtttccatgtccaatcagaagagcacaaagtctgccataaagaatcttgaggtccaagtgggacagcttgcaaagcaattgacggatagatcatcaagcagttttacagctaatacagagaaaaatcccaaggaggaat

SEQ ID NO: 54655 - DNA, 399 bp, Glycine max
  Peptide Sequence Number=SeqID_146340
atggcttctgctagtcctgtattttctttctctagaactctaaccatcacaactgcaaaactcaactggaagaattatttgtcttggtttgcttcagtggagttgtggtttctcggtcaaggatatcatgaccacttggagaaaggtgctaatgctgttccaaacgacaagagacttgagtgggaaaagcttgattttcaactctgtgttgtgttatggcaatcggttgagccagatgttttggaaatccttagatcattcaaaacatgttgctctttatggaagaaggaccaagagatttttgccaatgatattcaaagcctgtttgatgcaaccatgaaagttacgactctcaagcaaaccagccatgacatgattgcacatataggtaaagcttga

SEQ ID NO: 54656 - DNA, 461 bp, Glycine max
  Peptide Sequence Number=SeqID_146341
atgattatgaggagccaagacatttatagtagccaagatgaggctactacttcaccctcctctagtgaaagtgaagaagcaaaaagggaagaatctagtgaagaaatctacccccaagaagaagaacaacctttaatggttaaggaagagtgtaaggaggtaagtgtctcctccaagagacaacctccacattttctcctttgtaaaaagacacttgttagcattgccacacctcttgggcttgagtttattcctcaagtaaagaatttgttggatgagggtttggttcgcaagagcttaaatcctggtgctttgtcggtgcccaaaataggttttattaggcaccaaatcccaaaaataggtggtatgatgaatgttttgagtggtgcaaccctcttttgtaaaatcactcgtgcacccaacatcttcatgatttatgtacatagggactcattaggtag

SEQ ID NO: 54657 - DNA, 651 bp, Glycine max
  Peptide Sequence Number=SeqID_146342
tcaccatctaccttgaagagcacaagaaacgccacacggctaagatcattggcgactagactagttgggacagagagaccgctggtccatgttgatcctgcgactggcaaggccgacggtccccacaataagaagttaagaacatatttgggaatcgtcactcgtgataaggtcgatgtcacatacaagaataagaagcaagtccctgatgctcagaaggatttgatatgggaggatattcaagctgaatttgatatccctgaagcatttgatcagaggacaaaaaagaaaatacttcagactatgggggagcgagacccttcgtgggaggatgtgccgaaaaaggcacaagccatccagaagcaaaacactgccctcctcgtgttgtctcgtaggggttatgaatatttagaaaagaagatgatggatgagaagacaaagaaaaaactggaggaagctgctcaaaccggaagcattgacaccgtgattgatccttcttcttccatcagacaacacgtcaaatggaagatggcccgcataaagaaaattggccagatgacatctgaggcagcaaagcaaattgctgacaagattgattcgttggaggagcaggcgtcacagggttcctttgtcacccatggacgtcaggat

SEQ ID NO: 54658 - DNA, 422 bp, Glycine max
  Peptide Sequence Number=SeqID_146343
atggaggccatgaaagagcaaatggccacaatgatggaggccatgatgagcgtgaagaagataatggaagccaatgcggttgcaattgccgctaccagcattgttgctaaggtgaacccgatgccttcatctggcctcaaccaaatgaatcatccaacctcagatatggtaggcaaaagatttgggaagtacggacgaccccatgatgtgcaaattcaaaacaagcacgccttcccgccatatggcttgcctcccaactatacaccacccaatgtggcgtacactcccaataaggatgtcaataactccgctctcatactcattgagagccgacaacctcatcatgtacatgtctctcaacccatgggggtggcacatgaaattccccaccacaatctagccgacttcgagccttgcctcgg

SEQ ID NO: 54659 - DNA, 693 bp, Glycine max
  Peptide Sequence Number=SeqID_146344
atgcggagacaaaatttggtcattccgcacccctttgccattcagacacagtcgtgtccgatggcacgcagagacaaaatttggtcattctgcacccttttgtcatccagaggcggcgggcccgatgacatgcggagacaaaatttggtcattccgcacccctttgccattcagacacagtcgtgtccgatggcacgcagagacaaaatttggtcattctgcacccttttgtcatccagaggcggcgggcccgatgacatgcggagacaaaatttggtcattccgcacccctttgccattcagacacagtcgtgtccgatggcacgcagagacaaaatttggtcattctgcacccttttgtcatccagaggcggcgggcccgatgacatggggagacaaaatttggtcattccgcacccctttgccattcagacacaatcatgtccgatggcacgcagagacaaattatggtcattctgcacccttttgtcatccagaggcggcgggcccgatgacatgcggagacaaaatttggtcattccgcacccctttgccattcatacacagttgtgtccgatggcacgcagagacaaattatggtcattctgcacctttcgtcaattgcgaccgacaagcccgttgacacggggagatttacatcatcttccgcactcacaagatctgtcatactga

SEQ ID NO: 54660 - DNA, 213 bp, Glycine max
  Peptide Sequence Number=SeqID_146345
atggcaggagcaaaactctctcgcctcgttgctgttctccattttcttattcttctcatggttcaaggttttagtaacccagatttcgacgcccttgtggccttcaaaaccgcctcagacacttcccaaaagctcacagcatggaggggatcctctagagtcgacctgcaggcatgcaagcttggcactggccgtcgttttacaacgtcgtga

SEQ ID NO: 54661 - DNA, 372 bp, Glycine max
  Peptide Sequence Number=SeqID_146346
atggtgcagcccaaaccaagtgctggccttaaggggaaaccccaccaacatgctctcactcatcatgccttcttgtatttcaacaaacaaaagcttgggccccctaggcctaagtcatgcaaaaataccattgaggcatttcaccgagcacttggtgggcgcacttttgggtaccaacaacaagggaatgggggcaatgtggcttgccccatcatcttaaaatacaacctatgcctaaagccatcccctacaacccctcaattcaaagaaacaaagcataaatttgccccaaattgtctcacggaattggtcaaaccatgtaccattcaaagcataaaaggcatcactggaaagctagaaaccaaagggtag

SEQ ID NO: 54662 - DNA, 201 bp, Glycine max
  Peptide Sequence Number=SeqID_146347
atgggaagagatctcaagaaggttccccaacacttaaatgctataagtggaatcgacccgaagaaaagccatgaagaaagaagatccaagaaggcgtatattgcttgggatgacaatgactcatccgatagttcggagaaggagatcaaccttctatccaaggactatgagagcgatgagaacatctctcaagaagattaa

SEQ ID NO: 54663 - DNA, 1442 bp, Glycine max
  Peptide Sequence Number=SeqID_146348
gggacgtttgccctgacgattcagggtcgtggttttgagagcaaggtatctgcaggtaacaaggatttccttgattcggaatgtgtctcctgtggagcttgcgtacaggcgtgccccactgcaacgctcatggaaaaaaccgtgattgaggcaggcacccctgaacataaagtcacgaccacctgtgcttattgtggcgtgggctgtagcttcgatgcggaaatgaagggtgagcaagtcgtacgcatgacgcctagcaaagaaggcggagccaatcatggccatagctgtgtcaaaggtcgttttgcctggggctatgccacacacgccgaccgtattaccacccccatgatacgcaaaagcattcatgacccctggcagaaggttggctgggacgaagccattaattatgcagccagcgaaatcaagcgcatccaggcacaatatggcaaggaggctgtgggtggtattacatccagccgttgtaccaacgaagaggtgtatgtcacccagaaactgatccgtgccgtattcggcgtcaataacgtggatacctgcgcccgcgtttgccatagccctaccggctatggcctgaagcagacgctaggtgagtctgctgggacacaaacgtttgactctgtgatgaagtctgatgtgatttttgtcatgggggcaaaccctaccgatggtcatccagtatttggctcgctcatgaagcgtcgtttgcgcgaaggtgccaaactgatcgtggttgatccgcgagaaattgatttggtggacaactccccgcatgtccgtgccgattatcatcttaagctgcgtcctgggaccaatgtggccatgatttctgcgatttcgcatgtgattgtgactgaaggtctggtgcaggaagactttgtcaaagcacgttgtgaatgggattcctatgttgcctggcgtgattttgcagccaagcctgaaaactccccagaagcgttggaaaaagagttgggtgtttcagctaatgtggtgcgtgaagcttcacgcttatatgcgactggcggaaatgcggccatttactatggtttgggtgtgaccgagcatagccagggttctaccacagtcatggggattgccaacctggccatggcaaccggcaatattggccgtgaaggcgtgggtgtaaatccattgcgtggacagaacaacgtgcagggctcttgtgatatggggtcgatgccgcatgagttcccaggctaccgccatgtgtccgatgatgaaacccgtgccgagtttgagcaggcttggggcgtcacattgagtgctgacccaggtttgcgcatccccaatatgctggacctggctgcagaaggtagctttaaggctgtgtattgtgtgggtgaagatattgcccagtctgatccggatacgcaacacgtgacgcatgcgctggagagtatgga

SEQ ID NO: 54664 - DNA, 820 bp, Glycine max
  Peptide Sequence Number=SeqID_146349
gagttaccttcgacaacttcgcgttcgtgctcacggagggcggcttcggacacctacctgcgaactcggccatcgtcgcgctgaaggacggtgctccgcgctcagcgccactggtgtgcctgctcgcggcgaaccccgacgccctgatcggatcgacgaggagggtggcagcgtcaccacgactcgatgcatcctgggcggactcgcatggcgggttgcgacgtcgctggcgttcggcatctggtgctgcgcggcttcgtcgccgaccccgtacccgccccgtgagctcgagggggcgttcgccgtgactgacgaggagctggtggcggacgtgttccgctcgatcgttgacggtggtcatgcccggactcgtggcgaagcatcttcacggcttcatcacggcgtggaacagttccatcttcgcgactcgatccttcgtgccgcagagatctccctcacacgaggagtgtcgatcggtctgaagtcgttcttcggccgcgatcgatggggcagcatcaggcggcgtcgaccatcatcacggtcccggtgcagtgatcttcttcgtgctcgtgcagcgcaagctcgcctctggcatggtcgcgtcggagcggtgactcggagggggtgccgacgagctggaacgcctcgccgcgtgctctggaccgggcttcttcggcaaccgaggccccggagtgcgctgcgctcgcggagctgcgccggacgggctcgccgccgcgagtcgtgtacttcggacagaacgtcggtgaaggactctccgcgctcagcgccgacattctcgcggcgaaccccgacgccctga

SEQ ID NO: 54665 - DNA, 417 bp, Glycine max
  Peptide Sequence Number=SeqID_146350
atggcttctccacctgcctcccttcctcctcctcctcctgctcttttggacgcattggcttcgctgtctgccataaagcggacacgcaaagcctcacgtctacgatcgttgtctactagaccacctggtgttgagagaccagtagtccatgttgatcctgctaccggcaaggccgacggtccccacaagaagaaattaagaacatatttggggattgtggcgtgtgataaggcggaatttgatatcccaaaggcttctgacaataggacaaaaaggaagttacttcagaccgtgggcgagagatggaggcagtttaaatcagacctcacgaggaaatgggcccttgcagctgatcaggatggtgtggaggacactgtttgtgagaaatacggcattagcatggaaaaatgggcctag

SEQ ID NO: 54666 - DNA, 360 bp, Glycine max
  Peptide Sequence Number=SeqID_146351
atggctacaccacccagctcccctcctcctccttctccgactgattcaacatcacattccccttctaccataaagaggacaagaaaagtgacccggctgagatcaatggctactagaccagttaggacaaagagaccccgggtccatgtggatcctgcaactgggaaaaccgacggtccctacagaaaaaagttaagaacatatttggggatcgtcgctcgcaataagtctgatttgacatcgaaatgggcacttatagccgataaggacggtgtcgatgacactgtatgccaaaagtacgacattagcaaggagaagtggacccaattttgtcagagccacagagacccttcatggcag

SEQ ID NO: 54667 - DNA, 216 bp, Glycine max
  Peptide Sequence Number=SeqID_146352
atgaggacgcgtagccctctaaaggtgagggcatgcagtcctctgagggtgaggacgtgcagtcctctgagggtgaggacgagcagtcctctgaaggtgaggacgtgcagtcctctaaaggtgagggagtgcagtcctctcaaggcgaggacgtgcagtcctctgaaggtgagggcgtgcagccctctattggcgaggacgtgtagtcctctcaag

SEQ ID NO: 54668 - DNA, 243 bp, Glycine max
  Peptide Sequence Number=SeqID_146353
atgcgacttagaactgcatctggagacgttgtccctattaacttggaaattgaagctacttgtcggcgtaacaacgctgcaagaagaagaaggaaacaagacacagaaggaagcagttacatctcacctcctctttctccaaatcatactgaaatggacgcgaaaccagcacgaagagtcacactagaggacttctctaagaccgccactcctcagttcttcacaagtattgcaagaccggag

SEQ ID NO: 54669 - DNA, 1205 bp, Glycine max
  Peptide Sequence Number=SeqID_146354
atggaacctctccaaatgcaagccttccgcaagacttacggaaagatcttagagttgaccatagcagaggtgtccatagaagccattgcatcactcacccaatactacgaccagcctttgaggtgcttcacattcggagacttccaattagtaccaaccattgaagaatttgaggaaattctaggatgtcctctcgggggaagaaaaccatatctttcctccgggtgtctcccctctttgagaagaattgcaactgtggtcaaggattcagcaagaggtttggaccgcataaaacagactcggaacagcatagcgggcctaccacgggggtacctagaagacaaggcgaggggtatggccaatcaaggagattgggtcccgtttatggatgtgttagctttgctaatttttggggtcgtcctctttccaaacgtggatggtttggtggacctagcagcaatcgatgctttccttgcataccaccatagcaaggaaagtccggtggtagctgtcttggcagatctatttgacacatttgaccgaaggtgcgaaaagagtagcgaacggatcatctgttgcttgcccgccctctgtgaacgaggggttgtattaactacaatccccgcgctcgctataagacaactagggtaccccatgagggaagcaccgatggaagaaagcatgtctcctttccttgtgagggatttcggcgcgcaaaatttcaaggctatacaaagaatccataaggcatgggaaaccccgttaaggaaagatcaagaacttaggggcattcgtaatggcatcattggtggttaccatgaatggctgaaagttcatatacgaggtttagattggctcgccaagttaaaagtcgtcagcgaagagagtttcgaagcaccggaagaggacgaagaagtccaagctctcaaaagcgagttaggaaaggcgaaacttgccaaggagaagttcaagttggccgctacacacatccggaaggagtgtgccggattatgggaagagaatgcaactaccgcaagagcccttgaacaagagaccaagagggctcgcaaggaagagtatggccgtaacaaatttcgcggagctctgtggggtagcaacagtgaactcaagctacgaagggaagagagggaccagtcgcgagcacatagcatggtcttgaaagaggagttagttgcctgttcaag

SEQ ID NO: 54670 - DNA, 228 bp, Glycine max
  Peptide Sequence Number=SeqID_146355
atggatgttaaattatatgactgttggcttatggtacctgttcccaactcattgaattctcatgtatcatctgtaccaatttttaatgggcttaacttctctgactggaatgagcaagtccaatttcatctcggtgttttggatcttgaccttgctatattggaagagaagcctgctactattactgatgctagtagcaatgaacagaaagctcattataaagcttag

SEQ ID NO: 54671 - DNA, 986 bp, Glycine max
  Peptide Sequence Number=SeqID_146356
ccagtttattgagattgcaattacggacaccgggataggcattgaagcgcaagatatcaccgactgtttaaaccgtttgtgcaagtggaaagcacgctttcaagacggtttgagggaaccggtcttggctggctttggtcaggaagctggctcagcttcaccatggcgcggttgccgtccaaagtgccccaggcaaggcagcacctttacgtctggcttgagtacaacctgcattagccgatcctgcgctggcgcaccaaacggacctgatccggtccagcttgagtcagacaattgccgtgtcacgcgtgcagcacggcgaaatagcgctgcgatattgggggatggtgtcccgccagatttaattacgctggatatcctgttacctggcatggatggctgggagtttctggcgaaactgaaagctaatgatgcgctcgcacatattcccgtggtgattatttcgattgttgcagacagcaatcgcggcttgtcgctgggtgctgcccatgtattgcaaaagccggtgtctgccaatgacttgcaaaccgctttatccaaacttggctttgccaagccggaaaatcagcaggctggtttaaacgtactggtggtagatgacgatcccaaggcggtggaaattatttctgcttacctggagcatgccaatcattctgtcttaagggcttatggcggaaaagaggcgatcaatattgccaaactgcaaacgcctgacctgattgtgctggatttaatgatgcctgaggcgagtggttttgaagtcgtcgaagcgttgaaactggacaagcggacggcaaaaatccctatcatcatcgtcacctctaaattcctcacgcctgacgagcaactcaccctcaaagggcaagtgctggcggtccttgagaagtctgaatttaatcacggtaatttcctgagtgaagtgcaccgtgcattggcaggtcaacggggtaaccatcgggcaaagg

SEQ ID NO: 54672 - DNA, 503 bp, Glycine max
  Peptide Sequence Number=SeqID_146357
atggaatttggtgatattgtagttcattttaacattcttgatgccatgaaacatccatttgaggatcattctatttttcgtgctgagtttgaatttgatcctgtgtctgacttttatgctgagagtgaatttgaatttaagtctggtgttgtacctcttaatgtcgattttttagagtcagaatgcactaaccatgttgcagtaagtacatatacttctgacttactttatgagcaacccttatcagtgatcatctctgcctcccttgctgctgagcaagaggagaagttgttgctagttctcaagaagcacaagaaagccattggatggactttagtagacattcctggtgtcgcaacctacccttcggtgggagggcgacgcgtgactcgcaggatgcgtgttccacgaaaggaatacgcgcggagtcgccaccaacgtttatttgaggaaaacgtcggaaaaaccggaaaagacgcgatctacgaactttttaatgaaag

SEQ ID NO: 54673 - DNA, 878 bp, Glycine max
  Peptide Sequence Number=SeqID_146358
ccgtgattgatgctttcctcgcatatcaccatagcaaggagagtccagtggtggctatcttggcagatttgtttgacacctttgaccggagcgcaatcaattggtttcctcgatggaaggaaggcgaggagggagtccttttctcatgtggggactaccctaatgttccgttgttagggacaaggggttgcattaactataatcccgcacttgacataagacagttagggtaccccatgaggggagcgccaacagaggagagtctctcgcctctccttgtgagggatctaggcgcgcaaagtctcaaggttatacaaagagtccacaaggcatggagaagtccgttgaggaaagacaaggagcttagggcatccgagaacttcgaagctccagaggaagatgaagaagtccgagctctaaaattagagctagggaaggcaagactcgccaaggagaagttcaaatcagccgctacacacatccggaaagagtgcaccgagttacaagaggaaaacgcagccactctcaagctccgaagagaggaaagagaccggtcacgggtgcatggcatgatcttaaaagaagagttagctgcttgcgcaaggtccaagaggagtttggctcaacacttggaagccacggagcaaagcaggctagctatcatagggcagtacaaggaagagttgaaccagtctgtgacccatgaacaaaagctagtggaggattttgcacaagtgtacaccgaaaaagaagcaagagggagggtgattgatgcattgcatcaagaagcgactatgtggatggataggttcgccttgaccttgaatggaagtcaagacctcccgcgtctattagccaaagcaaaagccatggccgaa

SEQ ID NO: 54674 - DNA, 51 bp, Glycine max
  Peptide Sequence Number=SeqID_146359
atggagcttacatcacatggtaccacattacctataggattgagtcttagt

SEQ ID NO: 54675 - DNA, 321 bp, Glycine max
  Peptide Sequence Number=SeqID_146360
atgaccaagttcgacccagacatagtcctcgaattttatgctaatgcttggcctacagaggagggcgtgcgagatatgcgatcctgggtgaggggtcagtggatcccgttcgatgtggatgctctcagccagttcctgggataccctttagtgctggaggagggccaggaatgcaagtatggccagaggaggaaccagtccgatgggtttgatgaggaggccatcgcccagttgctatgtatgccggggcacaatttttcccggactgctgctgggagacgggtgcggatcatgcgcaccaacatgaccaccctgacttag

SEQ ID NO: 54676 - DNA, 182 bp, Glycine max
  Peptide Sequence Number=SeqID_146361
gtgctgtgtccaaggatgctctgattgctgaactcaaggacacatgcaagagtggcattgatgatgaagaagcagctgaggaagaaggagaagcagctgaagaagaagaagaagctgctgaggaagaggaagatgcagcagaagagacagaatcagatgatgattctgaagccaccccatga

SEQ ID NO: 54677 - DNA, 333 bp, Glycine max
  Peptide Sequence Number=SeqID_146362
atgaaagcatacaggatatgcaaaagaggtcacccacattgtaaatcatcttgcatctttaggaaaaatattcaaaatgaagatcttgtcaataaagtgttaagatacttaagtagggaatggcaaccaaagaaacatgaaatggaattgatgagattgaattgtagaagcaagcttcatgatgatgaacctagcaattttgatgatgtcaaaagcccaagtgatagattcaatacttcaagatcaagcatcaagaatccaatccaagattcaagattcaagggaagaaatcaagaagaaacaagtcaagacttcatatggaataagtattaa

SEQ ID NO: 54678 - DNA, 540 bp, Glycine max
  misc_feature (113)..(113): n is a, c, g, or t
  Peptide Sequence Number=SeqID_146363
atgagaaagcgccacgcttcccgaagggagaaaggcggacaggtatccggtaagcggcagggtcggaacaggagagcgcacgagggagcttccagggggaaacgcctgggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtactcccgctctcagtgtaaaaagtgcaatgcttttcctcctgagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 54679 - DNA, 123 bp, Glycine max
  Peptide Sequence Number=SeqID_146364
atgaccaccgttacccagatgtggatgacgttgctactcaacaacgtcttgcccagcgatcataactccgacctccctctgccgaagtgtcagctggtatgccacctaccaggcaccctctag

SEQ ID NO: 54680 - DNA, 219 bp, Glycine max
  Peptide Sequence Number=SeqID_146365
atgcctataggttggacctccaagaagagtggagctgatactaaggaggaggaactaacagatttgaggttaaatcctcatcaagggggaggggatgatgcaatcctccctaggaaggaaccagtcactagagccatgagcaagaggctccaagaggattgggctagagctactgaagaagaccctagggttctcatgaacctcagggtagatttctga

SEQ ID NO: 54681 - DNA, 183 bp, Glycine max
  Peptide Sequence Number=SeqID_146366
atgactggtattccacaacctattcctgataatccagtagatcaagttgatcatcaaattcctgataatgatgaacaaccagttgaacaacatgatcgccaagaaaatgttgatgtagcattaaggaggtctactaaaagtaacggagtttggaaccttgtagagttgcctaatggggcaaag

SEQ ID NO: 54682 - DNA, 279 bp, Glycine max
  Peptide Sequence Number=SeqID_146367
atgacaaaaatcattcagcttatagaaggagcaaaagatacggttatcattcaaggcgtggaagggtctgctgcctgctgcggagaagttgatggggacaaggcaaggaataagggcaaggaacctttagaagaacttggaggacctatggcaagggctagaacaaacaaggccaaggaagctcttcaacaagtgttaaccatgctatttgaatttaggcccaagttacaagtggagaagcttcggattgttaattgcaccatgttccaagaagagtag

SEQ ID NO: 54683 - DNA, 111 bp, Glycine max
  Peptide Sequence Number=SeqID_146368
atggcggctaagaaggatgggcttgccaaggaccttgacttaggtctcttcgatcccttcaaggatgtgaaggatgatgttcttcttgatgaggaggagattgttgtatga

SEQ ID NO: 54684 - DNA, 462 bp, Glycine max
  Peptide Sequence Number=SeqID_146369
atggatacctcaaagccctacactggggcaatgaggggcaccgtgcatgaacctcaagatggacccttgggtactagtaccctcaccttcaggcggtcatgtaccttcaccttcagaggattacaagtcctcgccatcaaagggttgcacgccctcaccttcagaggactacatgtcctcacctatagagggtcatgtaccttcaccttcagaggactacacgccctcgccttcagaggactacacgtcctcgccttcagaggactacacgtcttcacctttagagggctacacgtcctcgccttcaaagggtcatgtaccttcaccttcagaggactacacgtcctcgccatcaaagggtcatgtaccttttcctttgtagggcgacacgccctcaccttcagaggactacacgtcctcgcctttagaggactacacgtcctcgccatcagaggactacat

SEQ ID NO: 54685 - DNA, 183 bp, Glycine max
  Peptide Sequence Number=SeqID_146370
atgttggaagtgtgggaaacctggtcatttaaagagggattgccgggtgttcaaaggaaagaacaaggctggtccaagatgatgacgttgcttggtggtttgattcgggagcaacaagccatgtgtgcaaagatcgtcgttggttcaaggaatttagaccaatcgatgatggctctattgtga

SEQ ID NO: 54686 - DNA, 324 bp, Glycine max
  Peptide Sequence Number=SeqID_146371
atgtcgtttgaattggctcagagcttcaacattcaatttcaagcgtctcgatatatgacgggactcaatcagacatccgaagcttcaacattcaatttcgagcgtctcgatatattacgggcctcaatcagacatccgagtaaaaagttattgtcgtttgaattggctgagagcttcaacattcaatttcgagcgtctcgatatgttacggacataatcagatacccgagtaaaaagatattgtcgtttgaattagctcagagcttcaacattcaatttcgagggtctcgatatgttacgggactcaatcagacatctgagtaa

SEQ ID NO: 54687 - DNA, 367 bp, Glycine max
  Peptide Sequence Number=SeqID_146372
gagcgctgagcaccaacagcgtttcgaaaccatcaagggatggtccttccaccgagagagacgcgtccagctcagggacgacgagtacatagatttcctggaggagatagcttgccggcgttggacgtcgctggtcactcccatggccaagtttgatccggatatagttctcgagttttatgtcaatgcttggcctacagaggagggcgtgcgggacatgcggtcatgggtaaggggccagtggattccttttgatgcagacgccctcagccagttcctgggatacccgctagtgttagaggagggccaggagtgcgagtacagtcagagaaggaactgggccgatggacattggcctgaggcctag

SEQ ID NO: 54688 - DNA, 1062 bp, Glycine max
  Peptide Sequence Number=SeqID_146373
atgaacattgaagaattagcccgcgaaaatgtccgtcgcctgacgccttaccagtctgcacgccgtctggggggcaaaggggaagtctggctgaacgccaacgaattcccgaccgcggtgcagtttgagctatcgcagcagacgctgaaccgttatccggagtgtcagccgaaagcggtgattgagaactacgcgcagtacgcaggggtgaagccagagcaggtgctggtcagccgcggagccgacgagggtattgaactgctgatccgcgcgttctgcgagccgggtaaagatgccgtgatgtactgccagccgacctacggcatgtacagcgtcagcgcagaaaccttcggcgtggcgtgccgtaacgtgctctctctggagaactggcagctggatctgcagggcattgccgacaatctcgacggcgtaaaagtggtgtttgtctgcagcccaaacaacccgaccgggcagattattaacccgcaggatatccgtaccctgctggagatgacccgcggtaaagccctggtggtggccgacgaagcctacattgagttctgtccgcaggcgacgctggcaggctggctggaagagtatccacacctggtggtactgcgtacgctgtcgaaagcctttgccctcgcgggtctgcgctgcggatttaccctggcgaataaagaggtcatcgacctgctactgaaagtgattgccccgtacccgctctccacgccggttgcagacattgcggcccaggcgctgaccccgcaggggatcaacgcgatgcgcgaacgtgtggcgcagatccttgaggagcgtcagtatctggtgaccgccctgaaagagattccttgcgtggagcaggtcttcgactcggaaaccaactacatcctggtgcgcttcaccgcttccagcgccgtatttaaatctttatgggatcagggcattatcttacgagaccagaataaacaaccttccctgagcggttgcctgcgcattaccgtaggcactcgcgcagagagccagcgcgtgattgacgccctgaaagcggagaaagtatga

SEQ ID NO: 54689 - DNA, 510 bp, Glycine max
  Peptide Sequence Number=SeqID_146374
atgttagtgagctgcccctcctccgcaccatacgtagaagcggcggaagaatcattggaaacggctttccaatcctttgaagtggtgagctgcgcctctgtggaaccaagttcgtcgctaccttctctcttcaaagcggccataatggtggcgcgcgttatgctcaggaacggatttgagcccggaatgggtctaggcaaggactgcctcgggaatgccgacgtggtcaatatcaagggaaatccatacaagtatggattagggtatgaacccgggatgccaaggaggaggaacgtgccgtcaagatttcgggcggatagggtatggcccgaccgtattagccagtgtttcaccagcgctggaatggtgtccgaggaggaggtggcagcgatagaagaggaattccctcaagacccaccaagttttgtgcaaccatgccaccccgattcccaagtggggaactggcgcgtgataagccagtcagaagtctataccgctgattcaatgtaa

SEQ ID NO: 54690 - DNA, 210 bp, Glycine max
  Peptide Sequence Number=SeqID_146375
atgatgacaacaaaagatgatgacaaaagtgatgaacaaaaagctcaagtgaatcaaagaacatctcaagagaatcaagaacaagtcaagagttcaagaatcaagaagaattcaagactcaagaaaaaagcctacaaacaagaatcaagattcaagattcaagatctcaagaatcaagatcaagattcaagactcaggattcaagaataa

SEQ ID NO: 54691 - DNA, 362 bp, Glycine max
  Peptide Sequence Number=SeqID_146376
agcatcaagttgatctccttccagaagcttcattgcctaacaggccaacttacaacagaaagccccaagagactcagcataaggatgcacaggccaaagttgagtatgtgaaaagattgtatgaccaagtgaaggtgcaaattgcaaagaagaatgaaagttataccaagcaagccaacaagaaaaggaaggaagtggtacttgaacccggtgatgatcctggacatttgagggaaaatgttttccaagaaggaaggaatgatgagaatcctgaaactggccaaatacaggctaaaggcccaagtggagaaggacaaagcccccgagcggagaaggatgaaggcccaagtggagaaggatga

SEQ ID NO: 54692 - DNA, 258 bp, Glycine max
  Peptide Sequence Number=SeqID_146377
atggaggagggcatgcgtgatatgaggtcctgggtgaggggtcagtggatcccgtttgatgcagatgctatcggccagctcctgggatatcctttagtgctggaagagggccaggagtgcaagtatggccagaggaggaaccgattttgcccggactgctgccgggagacgggtgcggatcatgcgcaccaacatgaccaccctgactcagatatggatgactttgctgctcagcaacatcctgcccagcgaccataa

SEQ ID NO: 54693 - DNA, 492 bp, Glycine max
  Peptide Sequence Number=SeqID_146378
atggataatgaagagggcatgcaggaacagatgaaggccgatctatcggctttaaaagatcaaatggcttccatctcggaggtcatgttaaaactccagaaaactatagaggataaagccacgacaaccgcctccagtacggttagggaagcggagccggtgctgcagcccgccttaaatccgggccaagacagaaacacgatcgtgtttggtcaaaggtatagtccgcaagcttatccttatggcttgcctccggacttcaccccccgtgccaccccggaagatttaagccaagcccctactttcgagggacaactcccaccttatgacgactatcccgggcaagatgatgaggaaggagatatccatcttggccccctgctccacctcaaagatccgtccccccatgaactaccccaaccgaacatagtccaccatatcccggctgtcacccacacctgtaaaaaaatctgttcccttcacggaagataa

SEQ ID NO: 54694 - DNA, 243 bp, Glycine max
  Peptide Sequence Number=SeqID_146379
acttatcaaggtaatccttgtggcctctatcctgacttatcttccttcactggaagtagcgtctacccagacttatcttccttcaccgaaagtggcatctaccctgacttatcttccttcaccagaagtggcgtcatccaaaccttcatagcctgtatcaagcgatccgctcctactcaggttcacatcattttccatcaaggtttaatcctagacgatcctaagtcagcctttttgcaatga

SEQ ID NO: 54695 - DNA, 174 bp, Glycine max
  Peptide Sequence Number=SeqID_146380
atgaccaagagcaagggcaaggatccacttgaaggacttggaggacctatgacaagggctagagcaaggaaagccaaggaagctcttcaacaagtgctgtccatactatttgaatacaagcccaagtttcaaggagaaaagtccaaggttgttaatggcattaagttattctag

SEQ ID NO: 54696 - DNA, 303 bp, Glycine max
  Peptide Sequence Number=SeqID_146381
gagttgatttgtggtggaaggaggaatttcacttcccaatggtggcaggatttgaagagtatcttccagcagcatcacaatgaatgcttaactgataatttaaaatggagagtgggaagggggtccagcatcaatttctggaagcataaatggatggaggacaactgtactctccaaggaaaatatccccagttatatttaataagtaaacagcagaattcatcaatcaattatatgggagattttgtggagggtagtgggaatggaagttatcatggagaaggacttccaaatgcactttaa

SEQ ID NO: 54697 - DNA, 294 bp, Glycine max
  Peptide Sequence Number=SeqID_146382
atgtctgaatctaccgtggtaatccgcgtggatgaagagttaaaaaccgctttcgccagcgcggcaaaggccgccgatcgcacggcttcgcaactgctgcgtgatttcatgcgtgagtttgtcagccgccaggcgcaacaggaagagtacaaccagtggttaaaggaaaaggtcgaggtaagccgcaaggcgttgcgtgaaggcaaattcgccgacgatgaagagcgggaaaacggggcggatagccggtacgcgcgagctggtcatctccccgtcctatttgctggtctatga

SEQ ID NO: 54698 - DNA, 159 bp, Glycine max
  Peptide Sequence Number=SeqID_146383
atgaagcttgcttctacaatcgattcctttgaggagaaagcgacacagggatcctttgtcccccatggacgtcaggatgttctcaccgctgttattggatgtccagagcaccctggacatgtccgtgctgctggagccagtgtcaccatcaagcaatac

SEQ ID NO: 54699 - DNA, 213 bp, Glycine max
  Peptide Sequence Number=SeqID_146384
atgctccaaccatatgggatcaacatatgcttaaaggagcactcaaacccggtgacccccaaggcctacactccgaagagtccgtcagggcctctccctcctgattcaggtccaacccctaaaatcgaatttatttgcatttacaacacaatgttcatgaattatgtcaatatcccacgacctcacactcatgtttcaaacacgtttaactaa

SEQ ID NO: 54700 - DNA, 138 bp, Glycine max
  Peptide Sequence Number=SeqID_146385
atggccacccctatgagcactgcttgctacttggataaagatgaagctggtcaattagtagatataaagaaatatagagatataaaatcgatagaaaaagcactagtgggacttgccactttattggttccgcactag

SEQ ID NO: 54701 - DNA, 132 bp, Glycine max
  Peptide Sequence Number=SeqID_146386
atgggtgccaagtacttcgaagtggtcaaaagagggtcgcatcccaacaacagatggtccccggacaaaattagggggcatgaagcgaacacgctgcgtgcctttttaagcactgccatgcatataacctaa

SEQ ID NO: 54702 - DNA, 339 bp, Glycine max
  Peptide Sequence Number=SeqID_146387
atggaagggttagtggacctagcagtgattgacgctttcctcgcctttcatcatggcaaggaaagcccggtcgtcgccattttggccatgtatgacacattcgaccggggaggaaggaagaatcgggattctatcttcatacgaaggatgtccaaatgttcccttgatgaaacaaggagttgtattaattataatcccgtcctcgccataagacagcttggctacctcatgagaggagtgccatcagacgaaagcatcccgcctttcatcgcacagggttttagtgaccacaacgcgagggtactccaaggagttcgcaaggcatgggatgcggcgtga

SEQ ID NO: 54703 - DNA, 241 bp, Glycine max
  Peptide Sequence Number=SeqID_146388
aggactacacgtcctcaccatcagagggctgcacgccctcaccatcagaggactacacgtcctcgccttcgtagggctacatgccttcacctttagaggactacatgtcctcgccatcatagggctacatgccctcaccctgaagaggactacacgtcctcgccaacagagggctgcacgccctcacctccagaggactacacatcctcgccttgagagggctccacgccctcacctttag

SEQ ID NO: 54704 - DNA, 345 bp, Glycine max
  Peptide Sequence Number=SeqID_146389
ggtagcaaaggatcattaaattgtaaacatcataagccacatgatgagggaagcagtatcaaatcaatgctttacaagcttttggtcaatctaaggagtggtgtcttcatgctgcaaattgatgcatctgcagtatgtgggtggaaaaagggtgggagtggaaatttaaatggagaagacacttgtttgacagagagcttgagatggcagattgtttccgtaatgatgttgctggcagctaatacttccattatgatgggaatctatgacatgggtcaacattcatggagcttttccgcagaaaccgtggtagcacttttcccagcacgcgttctgtttgcctag

SEQ ID NO: 54705 - DNA, 1121 bp, Glycine max
  Peptide Sequence Number=SeqID_146390
ttggcaccgaccatagaagagttcgaagggatctttggatgcccggtaggaggaaggaagccataccttttttctgggtttcatccttctatggcaagaatagcaaaagtggtcaagatctcagaataagagctagactgaagcgcttggagaagaaggcaaaagctttggcaaatcaaggggagtggacctcgttcaatgacatattagcactgttggtgtttgggaccacactatttccaaatgtagacgagctagtggacttagcagccattgacgcctttctcgcttatcatcacagtaaggaaagcctggtcattgctattttggccgatgcatatgatatgttcgacctgagatgcgagaagagcagtgcaagaattgtctattgtacgcctactctttatgtgtggttggtctcccacattttttgtcatgaaggtaggactgtttgtcctctacaaggccatcgcatgtgcgtcgaaaaagggaaagcaaattgggaagagcgtttggcaggtatggtaggagcgtccgttaattggttcccccgatggaaagaaggaggggtaggagtgttgtgcttgtgcaaaggattcccaaacatccccttgatggaaacaaggggttgtattaattataatcccatgctggccataagacaactaggctaccctatgagaggtgcatcgtcggaggagatcatcgcgccttttgttgcgcgaggtttcagtgaagccaatatgaggatacttcagagaattcgtaaagcgtggaatacagtggaaaggaaagataaggagcttaggggaagtagcaatggcatcattggcggctatcacaagtggttgaggtctaggacacaagggataactttgttcctgaagctaaaaggcctaagtgggaaagaagctaaagttcttgaggaaagcgaagaagtgcaagctttgaaagtagagctcaaaagaacaagagtggtcaaggagaagctaaagatggcagtcactagggtcaggaaaaagaatgagctcaagcttagaaggttggaaagcatggtgttggacacactttatgacacccttaccgaacgcgtgctagagctagaatcaggagtgaggtag

SEQ ID NO: 54706 - DNA, 645 bp, Glycine max
  Peptide Sequence Number=SeqID_146391
atggccccaaggaagcttgcttcaaagagatccaggaaggataaagcggcagaaggaaccagttccgctcccgaatatgatagtcattgttttaggagcgctgagcaccagcagcgcttcgaggccatcaagggatgggacgacgagtatatcaacttccaggaggagatagttcgccggcggtgggcatcgctggttacccccatagccaagttcgacccagacatagtcctcgagttttatgccaatgcttggcctacagaggagggtgtacgagatatgcgatcctgggtgaggggtcagtggatcccattcgatgcggatgctctcaaccagttcctgggatatcctttagtgctggaggagggccaggagtgcgagtatggccagaggaggaaccgggccgatgggtttgatgaggaggccatcgcccaattgctgtgtatactggggcaggattttgcccggactgttgctggaagacgggcgaggatcatgcgcaccaacatgaccaccctgacccagatctggatgactttgctgctcagcaacatccagcccagcgatcataattccgacctccccctgccgaagtgtcagctggtgtatgccatcctgacacggatgagcattcacgtggcttag

SEQ ID NO: 54707 - DNA, 384 bp, Glycine max
  Peptide Sequence Number=SeqID_146392
gaatttaaagatgtctttcctaaggagatttctcatgtccttctagaagcttcattgcctaacaggccaacttacaacaacaagccccaagagactcagcataaggatgcacaggccaaagttgagtatgtgaaaagattgtatgaccaagtgaaggtgcaaattgcaaagaagaatgaaagctatgccaagcaagcctacaagaaaaggaaggaagtggtacttgaacccggtgatgatcctggacatttgagggcaaatgttttccaagaaggagggaatgatgagaatcctgaaactggccaaatacagcttaaaggcccaagtggagaaggacgaaggcccaaatggagaaggacaaagcccccgagtggagaaggatga

SEQ ID NO: 54708 - DNA, 378 bp, Glycine max
  Peptide Sequence Number=SeqID_146393
atgacaagcagagaccaaatttggtcattctgcacccttgtatcatccagaggcggcgggcccgatgatactcggagataccttacggttatccgcacccttttgtcatccagaggcggcgggccctatgacaagcagagaccaaatttggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaaatttggtcattctgcacccttgtatcatccagaggcggcggggcccgatgatgcgcggagataccttacg

SEQ ID NO: 54709 - DNA, 264 bp, Glycine max
  Peptide Sequence Number=SeqID_146394
atgctgacatctctggaaagggtgcagatgaccacgttggtctctacttgtcaatcggacttggggtcttcgaatgatgaggtgcggataatcggaaggtgtctccgcatgctaccagactcttgggtcatgatagcaaaaggtggggtggtcgacaaaagcggggcttttgctcctacgtatcctcaatttgtgatgaggaagtcagacctacgtagttcttgcaaaagtgagactaaaatattctcggtgttctttaactaa

SEQ ID NO: 54710 - DNA, 528 bp, Glycine max
  Peptide Sequence Number=SeqID_146395
atgtccaaccataagagtattgagtcaaccctgaaaaaccttgagatccaggtgggtcaactggccaagcagttagctgagaagtcatctagcagctttggagcaaatactgagaataatcccaaagaagagtgtgaagcagttatgacaagaagcaggaagcttgtggcggctgaggataaggatgttgttgctttgaaggagcaatttgctttgaaggacactactgataaaaagaagaatgaggtgagcagtggtgggtgcgaaggtagatggtcaacgtgttggtcttcctactgggcgactgatgctactaaagatgttctctacctaacaatgttcctgtgttctatgttgtctcctggactgctaaaccccgatgtctcgtgcatgtttagcctaatcctagccaagcgtcatcctcagatccctcttgttggactaaacttgaccagaactgcattaagacatacataccaacaactaggttaccataccccgatccctcatgaaaatacgataaactag

SEQ ID NO: 54711 - DNA, 864 bp, Glycine max
  Peptide Sequence Number=SeqID_146396
atgtgcttatttaataaacaaccggttgactatactcaagccattggggtaaaacacagcgttcattcgcagaatgaagcgtctggtgctgtggtacccggcgatatcgacaaacaacagcggtgctttatgcaagtttttataatgcgtcacggcgacgcagctctggaagcagcgagtgatgcggttcgtcctctcaccctgtgtggctgcgacgaatcacgtcagatggcgagctggctgaatggtcagacgccgggaatcgataaggtgctggtcagcccttatctgcgcgccgggcaaacgctcgccacggtacgtgaagcgctgaaactgccggaagggcaggaagtgctgccagaactgacgccaggcggcgatccgggcatggtcgcctgtcatttacaggcgctggcggtgcagggtgcgcacgcagtgctggtgatttcgcatctgccgctggtcggttatctggtatctgaactctgcccgcaggaagcgccaccgatgttcgccacctccgccattgcctgcgtggagttcgatgccgacgcctgcgaaggcaagctggcgtggcaggtgagtccggccaaattagccaaagccatctgcgttggctgcgtcaattcaccccagtcacttactgatgtaagctcctggggattccccgtcatacttcaggctgcagctgtgttggctgcgtcaattcaccccagtcacttactgatggtaactccggcggctgccactctccgacttcaatcaacaccagcagcgcggcgtcgccgccaaacagtttgggtgcctggtgaaacgccatcacgtgcggatgctgtgccagccacagcggggtttgctgcttga

SEQ ID NO: 54712 - DNA, 1137 bp, Glycine max
  Peptide Sequence Number=SeqID_146397
atggcccagaagaagagcactccaatcactcctaccacatccagaaggagcaaggttgcaatcccctccaagaagaggaaagaaatttcctcatccgattctgatgatgatgtcgaactagatgtctcgacatccaagagggccaagaaatctggaagaaaggtgcctggaaatgttcctgatgcaccactggacaacatctctttccactcaattggcaatgttgaaaagtggaaatatgtgtatcaacgcagacttgcggttgaaagagaattgggaagagatgccttggattgtaaggagaccatggacctcatcaaggctactggactgctgaagactgtcaccaagttgggagactgctatgagagtctagtcagggaatttattgtcaacattccctctgacataacaaacagaaagagtgatgagtatcaaaaagtatttgtcagaggaaagtgtgttagattctcccctgctgtgatcaacaaatacctgggcagaccaactgatggagtagttgatattgctgtttctgagcatcaaattgccaaggaaatcactgccaaacaagtccagcattggccaaagaaagggaagctttcagcagggaagctgagtgtgaagtatgcaattctacacaggattggtgctgcaaactggcattcagaatcttttgctatcaaattacccattgccttccctactgtgttgtgtggcattatgttgagtcagcatcccaatatgttaaactacactgactctgtgataaagagagaatctcctctatccctgcattacaaactgtttgaggggacacatgtcccagacattgtctcgacatctgtctcgacatcagggaaagctgctgcttcaggtgctgtgtccaaggatgctctgattgctgaactcaaggacacatgcaagatgctggaagcaaccatcaaagccaccacagagaagaagatggagctagaactgctgatcaaaaggctctcagagagtggcattgatgatgaagacgcagctgaggaagaaggagaagcagctgaagaagaagaagaagctgctgaggaagaggaagatgcagcagaagagacagaatcagatgatgatgattctgaagccaccccatga

SEQ ID NO: 54713 - DNA, 221 bp, Glycine max
  Peptide Sequence Number=SeqID_146398
ggatcgcgctcgcaagacacccagtggacccggagaagtccaacaaggtcttggggtttccagctctgattataggcctttgtcagttctacggagtgcatgtcgcccccaggcaggcgcagggcgaaacaccacagcagcctggggatggccggcagtgggcaacatacgcaccaccaccacctctagagttcaccttagctcatccacaaaaaggttag

SEQ ID NO: 54714 - DNA, 880 bp, Glycine max
  Peptide Sequence Number=SeqID_146399
aggactacacgtcctcaccatcagaggacgacacgtgctcaccatcagagggttgcacgccctcgccttcagaggactacccgtcctcaccttcagaggactacacgtcctcttattcagaggactacacgtcctattattcagaggactacacaccctcgccttcagaggaatggacattttcaccttcagagggctacacgccctcaccttcagaggactacatgtcctcgcctttagaggacttcatgtcctcaccatcaaaggacaacacgtcctcgtcattagagggttgcacgccctcgtgttcagagagttgcacgcccacgccttcaaagggatacatttcctcacctttagaggactacacgtcctcgccttcagaggattgcacgccctccccagcaggggaggactacacgtcctcccctgcaggggaggactacacgtcctcccctgcagaggactacacgtcctcccctgcagaggactacacatcctcgacttcagaggactacacgtcctcgccttcagaggaatggacgtcctgaccttaagagggctacacgccctcactttcagaagactatacgtcctccctttcagagggttacacgccctcgcctttagagggctacacgccctcatttctagaggactacacgtcctcaccttcagaggcctacacgccctaaacttcagagggctacacgtcctcgccatcagagggctgcatgccctcaccatcagaggactacacgtcctcgacatcagaggactacacgtccttgccttcagaggactacacaacctcgccttcagaggactacaagtcctcaacttcagaggactacatgtcctcgccttcagaggactatag

SEQ ID NO: 54715 - DNA, 210 bp, Glycine max
  Peptide Sequence Number=SeqID_146400
atgcccctcattgccccaactgtcgcaacctacccttcggcaggagggcgacgcgtgactcgcgggatgcgtgttccacgaaaggaatacgcgcggagtcgccaccaacgtttatttgaggaaaacgtcggaaaaaccagaaaagacgcgatctacgaacttttaagtgaaaggttcgggagttgtatttacgcgcggggaaggtattag

SEQ ID NO: 54716 - DNA, 192 bp, Glycine max
  Peptide Sequence Number=SeqID_146401
atgtataagaatgtaggtgtacaaagtgatgaggacatgaccaagagcaagggcaaggatccacttgaaggacttggaggacctatgacaagggctagagcaaggaaagccaaggaagctcttcaacaagtgatgtccatactatttgaatacaagcccaagtttcaaggagaaaagtccaaggttgtttag

SEQ ID NO: 54717 - DNA, 555 bp, Glycine max
  Peptide Sequence Number=SeqID_146402
atgcgtactgtgagaggtctgcgggggcttgacccatgcgggcgccgaagtgacggcatgggtatctccctccttcctttttgccccagttgctccgactcttttagcatgggtacttgtggaggaaatgtaattgaacttccctcttttcaaccctacttcaattatttccctggcgaataccaagtctgcgaagctggaaggcatgtagcctaccaacttctcatagtaaaacactggcaaggtgtctaccatcatggtgatcatctccctttcgaccatgggtggggccacttgtgccgccaggtctctccaccgttgcattttgaattttggggggatgacgacattcgataccaagcaaaagtctgtcatgtctgcgaacggatcaccaaagcctttaagaaccctcaatctctcttcaaggagatcgagtttccttctttcttcggccgccgggggtggtccttctgtggacaagaatattggctgtgctgtgaggttgggctgaggcaaagtgttgggtgtcggcccctcgacgggaatcaggggtag

SEQ ID NO: 54718 - DNA, 189 bp, Glycine max
  Peptide Sequence Number=SeqID_146403
atggggttgaaccaagcacatgttttaaggaaaggttcatcaagtcaaggtcaagtatggaagaaagaatgcgctttacggaacccttaccgaatgcgtgctagagctagagtaatgagtgaaatagaggaggtgcaagagcagataaaggctgacatggaggccatgaaagaccaatggcccccatga

SEQ ID NO: 54719 - DNA, 105 bp, Glycine max
  Peptide Sequence Number=SeqID_146404
atggcgcgaggatgcttcccaaatgaatatatgatgtggaattgcccctcaagagtaggaaatggccccgaggaaacttgcctcaaagagatccaggaaggataa

SEQ ID NO: 54720 - DNA, 297 bp, Glycine max
  Peptide Sequence Number=SeqID_146405
atgatgagtattatggaagatatagtgaaagtggacaacatcctgatccatttgctaagttccttgaaagtgtgggttcctagtaaggcagttcaagagacacctagtttgagacacctatatgttttgggttgtcaggcagaaattagaatatataatccgcaagaaaagaaattggatgcaagaacaattggtggatatttcattggctatccagtaaaatcaaaagggttcattgagaatggtgaaaccaatgggagtgaagcttcacaaaatgtggagattaaggaagttaga

SEQ ID NO: 54721 - DNA, 222 bp, Glycine max
  Peptide Sequence Number=SeqID_146406
atgggggtgcaaatagcacccaggcccacttgggccctccagaagattcctccagaaggctgttgcttctggaggaagcaacctggctcgcctggaaaatctaagccgaggcgcttccgaaacgtttccgtaacgttttccgtgaagaatttcgcaaaggtttcaaccgttcttcgacgttcttcattcgttcttcatcgttcttcgatcttcaacgggtaa

SEQ ID NO: 54722 - DNA, 462 bp, Glycine max
  Peptide Sequence Number=SeqID_146407
atgcatgtgcttttaagtggaggatcagttcatcaaattcatgaggtcaaggaaatgaaccctcaagattccttgaaacttttctgcttaaatgcctttaatgaaagccagcccaaaatgggttatgaaaaactaaccgaagaggttgttaaaatagcgcaggggaatccattagctttagaagttttgggttcagatttccattctcgatgtatagacacatgggagtgtgcattaagcaaaatcaagaagtatcccaatgagaaaattctaagtgtgttgagattcaattatgatggactggatgaattagagaaaaaaacatttctagatattgcattctttttctataatcatgacaaagactatgtcataaggaaattggatgctcagggttttcatggagcaagtggaataaagggaactgatgaggtagaggccatgcaaatagatgagtcttga

SEQ ID NO: 54723 - DNA, 147 bp, Glycine max
  Peptide Sequence Number=SeqID_146408
atgtggaccaccacgggagagaagcttgccgcccagctcgcccaggcgagcaaggttgcttcctccagaagcaatagccttctggaggaatcttctggagggcccaagtgggcctggttgctatttgcacccccccccttttactaa

SEQ ID NO: 54724 - DNA, 354 bp, Glycine max
  Peptide Sequence Number=SeqID_146409
atggtagaatcgtcgaagaagcgaaagggatcatcctccaccaccgctgctgctggccatcgccgccacagaccatctgaagcacccacaacacctattcatccttccttatcatctccaagatcatccactttgttttcttctgatgatcaacgtctacgaaatttaaaaattcaggatggtattatttcttctgaggtgcatggtatttctatgatcattgatcaatctttgttcttttcattgacaaaattacccagtcaaggtgcaccttttgagggcaccattgttgatgactggaaatttgattattctagtcatgatgctcgccgtatggtttgcaatgactggtag

SEQ ID NO: 54725 - DNA, 502 bp, Glycine max
  Peptide Sequence Number=SeqID_146410
gcttttcgtcttacagacagcaaaaaagaatgtttatacggataaccactcgggtattccgcccgttagcgtgactcaaatgcttttcgtcttacagacagcaaaaaagaatgtttatacggataaccactcgggtatctccgcccgtcagcgtgactcaaatgtcagtatgacagatcttgtgagcgcggaagatgacgcttttcgtcttacagacagcaaaaagaatgtttatacggataaccactcgggtatttccgccagtcagcgtgactcaaatgtcagtatgacagatcttgtgagcgcgaaagatgacacagcaaaaaagaatgtttatacggataaccactcgggtatttccgcccgtcagcgtgactcaaatgtcagtatgacagatcttgtgagcgcggaagatgacggcgcagaagacgacgatcagtctctgcgtgctatcaggcttttcgtcttacagacagcaaaaaagatgtttgatactggataa

SEQ ID NO: 54726 - DNA, 357 bp, Glycine max
  Peptide Sequence Number=SeqID_146411
atggtcattgaccaatccctcttctatgatttgacccaattatctagcgatggtgtaccatttgaaggtacattggacgatgattggaagtttgatttttctgtgcatgatgcccgccgattggtttgcaccaaccaagcggatatgaccggaaggcttcttgccgtccgatatcgcatgcataaggcattgcgattaaatgctcctttaccatatccacatttagtcactcttttccttcaacatttcaacatccctcttgattctgaaccttatgttccaatcaagagatctttcttgatcggtgctgctgtggttgcatcctttggttaccgcaaagagcatgatggctcttgg

SEQ ID NO: 54727 - DNA, 1047 bp, Glycine max
  Peptide Sequence Number=SeqID_146412
gaagcggaagcattgctgcggttgatcaacaacgtgctggatatatccaagctcgaagcggggaagttcgtgctggacccggcgcctactgacttcgcccatcttgtgcatgaggtggtcgacgcatatcgtacccgcgcggcagaaaagggactggaactcgcggcgggcgttccggagaattgcggccgcttgatattggactccagccgtgtggcgcaagtgctgcacaacctggtttccaacggtgtcaaattcagcgcggtcgcggataccggaatcggtatcgagccaggcgatcaaaaccacctatttagcccatatagccattcggcgagccccgcgagaggccgcaaggcgagcgggacagggttgggactgctggtttgccgcgagttggtggagtgcatgggcgggaccatcggactgcatagtgtgccgggcgttggtacgaaagtggtcgtgtcgctgccggtcgaggtctgtgtagaagagaattctcctatggtaacgccgcctcgtgacggcgttcatccgaggggggaaagcctggccatcctgctggtagaagatacgcccgccaatcaatacgtgattcaggcgcaattggcccaattgggctgcaacgtccacttggcgccagacggatcacgggctcgccaggcatttcgggacaaccgcttcgatcttgtcttgttggattgcgaccttcctgataccgacggctataccctggccgaagaatttcgagcccatgaggctgaacatctgctccccgccagctcgatcatagccatttccgcgtcctcgggcagcgaacatgtatctcgctgccttgacgcgggcatggacggcgttctgagtaaacccatccaattgggcaagctacgggacaccatcgaaatctggtgtgacgtgacgttgaacctggatgccgaccacgattccgttggggcggaaattccagttgtttctcgggacttcgcgcactccgccctgggggaagacctgagcgcgttgcgtcgcgcgctcgcggaaagagatcca

SEQ ID NO: 54728 - DNA, 500 bp, Glycine max
  Peptide Sequence Number=SeqID_146413
atcattgcaatgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgtgcgcccggcctcctcgtcctcgcgacaaacacaaaccccggcgcttctgcgccaaggaactcaaattgttaatggactccttcgggggcccggagacggtgtcggggggatcagcggatgttgcttttaggactccgctggcaccttatgagaaatcaaagtctttgggttccggggggagtatggtcgcaaggctgaaacttaaaggaattgacggaagggcaccaccaggagtggagcctgcggcttaa

SEQ ID NO: 54729 - DNA, 90 bp, Glycine max
  Peptide Sequence Number=SeqID_146414
atgtggattgatccttttgtggtgactaatgtttttccatatgtggtggaggagacctccttacttcaccctatttctcttccaccatga

SEQ ID NO: 54730 - DNA, 272 bp, Glycine max
  Peptide Sequence Number=SeqID_146415
atgactaggggcaatccaggtgatttacaaccctttgatcttgaaatagatagaacctttcatagattagttaggcatagtgtgcatcctgtgcattttgagcactctgagcattctgttgagggtgattctaaatattctgattttgagcattccactactaattttcatactgagaacatggctcaacctctacctcgtgagaggactcttagggagatggctacactgatttcacttatgaaagcttgtgcattcaatatcctaatgag

SEQ ID NO: 54731 - DNA, 189 bp, Glycine max
  Peptide Sequence Number=SeqID_146416
atggttgccgcccaggcgagctgggttgcttccaccagtaggcactgccttctgttggaacatcctggaaggcccaaactatgcaacaaccccttctttgacttctggaatgttgcgaaactttacggattgcgcaacaatgcttcccttcaacttccggcatgtcgcggaactccacggattgcctaa

SEQ ID NO: 54732 - DNA, 168 bp, Glycine max
  Peptide Sequence Number=SeqID_146417
gggtagagaatggagaattgcactaagcaatcactacgcatggctccaaactcgtgggtggaggatgcatgaacggaaacgcaattcatggggctccgaaaaaggggcgacacgtgactcgcgggatgcgtgttccacgaaaggaatacgcgcggagtcgccaccaac

SEQ ID NO: 54733 - DNA, 311 bp, Glycine max
  Peptide Sequence Number=SeqID_146418
attggctcgccaagttaaaaattatcaacgaagagaatttcgaagctccggaagaggatgaagaagttcgagctctgaaaaccgagctaggaaaagcgagacttgtcaaagaaaaattcaagttggtcgctacagaagtccggaaagagtgtgctgggttacaagaagaaaatccagctaccgcaagagcccttgaacaagaaaccaagagggctcgcaaggaggagcatggccgtgacaaattccgtggagctttgtggggcagcaacagtgagctcaagcttcgaagggaagagagagaccgatcataa

SEQ ID NO: 54734 - DNA, 363 bp, Glycine max
  Peptide Sequence Number=SeqID_146419
atggaagatgaaggtcccatagcccaggtacctcagcatgtggaggatgagtcatctgaggccaccatcccagatccatttgttataagagaagagacagatgagaccctggtgagacaggtagttgctgccactcccgagagatcccttgaggccacttcagagcctcctgcaccagtggtggacctaccctcacctcagcatacagtagacccttccactcctatcttagagataccagaggacccgaccacaccagtcctggctatggacacttctcttccagctactctagtacttcatctgacagatgaggaggatgttcagacacaggacacccaggaccagtcacaggaattctaa

SEQ ID NO: 54735 - DNA, 267 bp, Glycine max
  Peptide Sequence Number=SeqID_146420
atgacagatcctgtgagcgcggaagatgacgtaaatctccgcgtgtcaacgggcttgtcggccgcgattgacgaagggcgcaaaatgaccataatttgtctctgcgtgccatcagacacaactgtgtctgaatggcaaaaagggcgcataatgaccataatttgtctctgcgtgccatcggacacaactgtgcctgaatggcaaaagggtgtgcggaatgaccataatttgtctccgcatgtcatcgggcccgccgcctctggatga

SEQ ID NO: 54736 - DNA, 936 bp, Glycine max
  Peptide Sequence Number=SeqID_146421
atggacatcctggcacttttgatcttcggggtggtcttctttccaaatgtggatgggttggtggaccgagcagcgattgatgcttttatcgccttttatgaccgcaaggaaagcccggttgtcgctatcttagcggatctatatgacacattcgaccgaagatgtgagaagaacaatgcaaggatcatttgttgtatgccggctctctacatatggttggtttcacacttatttcgccaagagatgagacacgtttgcccgctagaaggccaccgctcatgcaccgagaaaaaagaggtaaactgggaccagcttttagcgaacaaagaaggagcgtctgtcaattggttcccccgatggaaggaaggaagaaccgggattattatttcgtgtgggaaatttccaaatgttcccttgatagggacaaggggttgcatcaattacaatcccgtcatcgctataagacaacttggttaccctatgagaggagcgccatcaaaggaaggcctcataccttttattatacgaggtttcaatagcaccaactcgggggtgcttcagagggtccacaaggcatgggaaatgttgcaaagaaaggacaaggaacgtaggggaagtagcaacaggcccgtcgacagttaccgtaggtggttgaaagcctacacacaagatctggattggctcctgagtttgagaaccactaagggggtggaggttgaaactctggaagaagacgaagaggtacaggccctcaagacagaacgtgagaaagcccaaacaatcaaagaaaagttcaagtcagcagctgttaggatccgaaaggagaacgccgaactgagaggcatcaatatagccaccgtcaaggccttggagcaagagaccagagggcccgtagggaaaaacatggccggaacaaattccgaggggctctgtggg

SEQ ID NO: 54737 - DNA, 255 bp, Glycine max
  Peptide Sequence Number=SeqID_146422
atgatgctccttaacggtgaaggcccacagcatccgcacgtagttgctgaggatgctcctcacgtggatgacgcaactgaagaggtcttccaacatcctgaagaagctggtgttgatgcccagggcctaggatcttcttcatcaatggattcatttgcttcttggaagatgaatggcagcggaatggagaaggaagagagagaggagacgccacttcaaggagaagatgagtctagaagaagctcaccaccatag

SEQ ID NO: 54738 - DNA, 63 bp, Glycine max
  Peptide Sequence Number=SeqID_146423
atgacgagactcaagaggaacgccagacaattggcggcaacaaaatcaacagcaacaacatag

SEQ ID NO: 54739 - DNA, 2970 bp, Glycine max
  Peptide Sequence Number=SeqID_146424
atggagatgccaatggagcaaaagaaagccaccgagctgcttgaaaggaaaaagggtggttggagaaccatgccctttatcataggttgtgatttccatcttcctgtagcaaacgagacctttgaaaaggttgcagtagtggggctccgtgtaaacatgattttgtacctgcttcaggagtatcattttgaccctgcaactggaactattataatgttcctgtggaacgccttgaccaatctgttgcccatcttttgtgctttcctttctgattcttgccttggacgatttcgtgttattgcaatgggaacagtcatccaccttgttggcttagttgtgttatggctcactactattattaggcatgcaaggcctcaatgtgatacagaaccttgtgcaaatccaacagtaccgcaactcctgattcttttctcttcccttactctcatggctcttggagctagtggcattaggtcatgtaccttggcctttaccgcagatcaaatctacaaccctgaaaacccacaaaacgagaggaccatgaagagctttttcaattggtactatctttcagttgccatttcagtaacaatttcaatggcattcatagtgtacattcaagttaaagcagggtgggttgtgggttttgggatttctatggggattgtgtcactgtctgcaatcatgttttttttgggcacttccatatacgtcaaagtgaaaccaaacaagagcttgctcactggcttcgcccaagtgattgttgcggcctggaaaaacagacacttacccctgcctcccaagaactctgacatttggtatttccgcaatggttctaatcttgttcaaccaacaaacaaagtaaggttcttgaataaagcttgcataatcaagaatagagagaaagatttggactatgaggggagacccaatgagccatggagtctgtgtacagtgagacaagtagaggagttgaaagccataatcaaagtccttcctatttggtccactggcatcatacttgcgactactgtaagccaacaacaatttttcatagtccaagcaggtaccatggacaggatggtgttcggtatagatatcccagctactaatttcgctttattcatgatgctaactttgaccatgtgggtgattgtgtatgatcgcattctagttcccattttgcctaaccaacgaatactcactgtgaagctacgaatgggaattgggctagtgatctcatgtttagccactctagtagcaacattggtagagaagaagagaagaaatcaagccataagtgaaggatttatagacaacccgaaaggagtggtcaacatgtcagctatgtggttggtgccctcctattgcttatttggtttggcacaaggttttactgtcattggacaaatagagtttttttactctcaatttcctaaaacaatgtccactgttgctgtttccctatctacccttaacattggggtgggaaacttggtgggaagcctcatcatcaaggttgtgaaagatgggacaaggagaggaggaagagctagttggctagcatcaaatatcaatagaggacactatgattactactatggactccttttcattctaaatttggttaatttggtatgtttcttggtatggagtagggcttatgggagtactcaggatataaaagattgggatgaagataggcattggacaccggagtggacagtgagtgtgattgagatggatcctccaccgaagagctggagcatccacacccgatccgagatcatagcaaaatacgaggtcatggagcgggtcgggtcgggagcatacgccgatgtgtaccgcggccgccgcctctccgacaacctcaccgtcgccctcaaggaaatccacgactaccagtccgccttccgagaaatcgacgctttgcagctcctgcagggctccccaaacgtcgtcgttttgcacgagtacttctggcgcgaagacgaggacgccgtccttgtcctcgagttcctcagaaccgacttggccaccgtcgtcgccgacgccgctaaggccaaccagcccctccccgccggcgagctcaagcgctggatgattcagattctctccggcctcgacgcttgtcaccgccacatggtcctccaccgagatttgaagccctctaatctcttaatttccgaactcggcctcctcaagatcgctgattttggacaggcaaggattctcacggagcctggtattgatgcttctaataatcatgaagaatattctagggttttagatgacgctgacaataaggatactattactagcactcacgatgggaaagcaacatgcaccacaagtggcgtagatagggaagaggaagagaaagaacttggttgtttgacgtcatgcgtggggactcgttggtttagggctcctgagttgctttatggatccagagactatggtttggaggttgatttgtggtccttgggatgtatctttgcagaacttttaactctgcaacctttgtttcctggaactgctgatattgaccagcttagtagaatcattggtgttttgggtagccttgatgagagtgcttgggctggttgttctaaacttcctgattatgcgataatctcctttagcaaggtggagaatcctgctggtcttgaagcttgtttgcccaatcggtcccctgatgaagtggctctggtgaaaaaactggtttgttatgatcctgctaagagggccacggcgatggagctgcttcatgacaagtactttagtgaagagcctcttcctgttccggtttctgagctgcgagttcctatgaccagaaaagggcaagatgaggattccctttgtgggtggggtgatatcgatgaaatggattgcgattctgattttgatgagtttggccctctgaatatcacaaggactggaactggtttctccatacagtttccttga

SEQ ID NO: 54740 - DNA, 2223 bp, Glycine max
  Peptide Sequence Number=SeqID_146425
atgtatagatcatttctgagatgtgatgatccaaaaggagtagtacaatgtggaacaatcaggaaatacaggactcgttctcacaaagtgaaggacaagacaagaatccaaaagacaggcgaaaacttggagacatccttgtccttgatgaacaaaagatacaaagaagacaaaaaggtcttaaaaggatgtgatggaaatctcattggtccatcatctttgcagctcacacaagtctacggaggggatcaaagtttgaaaaacatgctaaattcatggtctagagatattatgtgtgatggaaagtctgaagacattgcaaaaggagctcttggtctgcaagactctctaatcatgcttcgcaagttgcaagaggaggcttcaccacattcagcttcttttaggagaaaacggactatgaaacctgtaagagacagaattgatgcaaagatggttggtagaacgcaggctaaaccatttggggaacaaagtaatccaaaggggtttcaaagaccacagccttcagctggtggttcttcaagtaattgccaagaggaacttaagaaggtgattaaggagagtttggttaggcaaaatatgtttccaaagacctctgaaagattaaattcaggctcagaaactttttctaccagcacaagccaatattctgctgtcaggactaacagcctttttgatccttctttgtcagtaatagcttcaaagatggaaagaggaccaggcctaattttcaagctgatgggtttagaagaagccccctcaaaatcatttccagctgttaagcagaaacagttggatagtgagatagatacgtcaaaggtaagaaagaatgattctgtagctgagaaggttaatccagaaaaaaaggccctgagggaaactcttgacaccaaacatttcaaaggaattttgaaggagagttttgtcgaagagcccaagcttcatgtgcatcatttcaatgatacacattctaagcagtttggtgatttatctcaaattgcacttatgaaacctcaatgtactctttaccaggaatcagtaaaaagtacctatatgccagttcctccaaaagagttacccataacaaaactgaaaccagaaatagcctcttccaaaactatcaaacatagaaaaggttccagttctaccaccatgggaaaagaagaggttatgaaactggatgcaaaaggaatcaatcctgttgaagaatcatcaggtaaggtaaatgagacaattggtcaaaattggaaggtacagaccattagtagaaaacagccagagaaggatatctcacaacctagaattgtgacaacaagacctcaatatcaacgaggaatcccctccacaaaattgaggaagctaaaaagtgggtccagaatcgacaagaatgagatttcttgcttaaagagaacaggtataaagaatcggatgatgaaccaaagcccagttgctgagcctgaaccagctaaactaactgttgaacaaatcaggaagggagaagagcaaaaagtttacactgagattagtgcactagaagatgaactcctgaatgtgtgtgaagcagatgcctacataaataagattggagaaaaatacaagcagaggaagagtttttcaggcgatgacattattatgctgctcaagtctgaacatgaaaataatgctatcactgcttatagcattaacgctgataaagaggggactgagctgaaacattttcttttaaccagtccatcattcattggacatgcaaagaagctcttcaatcttgaagttgattgtcccaacaccctacaaaaggatgaaactatttacagcatggcaaatctcaggctttatttggattgcacgtatgaactcgctgagcgtaaaagccttcaagagtcacaagtagttcgttctttcttgctcgcttgtggagggaactcaagattacacttctccttaggcaggttggttgaagaaatctgtgatggcattgagaatctgaaattttacaaagaagattccggggaggaagtttttgcaggcaatgatgtctttgcaatgatggagaaagacatgaagtgcaatggagagataaacagtatgtgggagaagggttggaggcgaggattttctgcagatgaggctgaactagttgtcaataaaatagagatcctgcttatgagtggattaattgaggaggtttttataaatttatga

SEQ ID NO: 54741 - DNA, 690 bp, Glycine max
  Peptide Sequence Number=SeqID_146426
atggatgaaccaatcaatagggcattaattgataagtggaataatgctgatgcactctatgcaacacctactggatcaaatgatgattggtactggttgtatgcagctataaaatttagatgcttacttgttaccaatgatgagatgagagatcatctatttcaacttttgggaaatgactttttccccaagtggaaagaaaggcatcaggctgtcctaacattggaatccctgtcttccaaatttaaggtacgcttcagtttctctgatactggtagtccagtgtttcacatgccccctccttgttctgttgttattcaggaatcagaggaaggccactggcatattccaattgatgcagaacttaatgatgaatcagaaagaagatggttgtgcattacccgcgctaaattagatgtggtttccaaagattcttcaacatctaaagactctaaacctttgcaaaaaggagaatgtgcaagatcagctactagaaatgcgtctgcaaaggagtcgcaacatcagaatcttgtcaaccacaaagaaaaaaaggaaacacctcaagaattgtataaaaatgttagagatatttttttagaatcagtatcctcagataaaaataactcaatattgtctgacattgaggctgcagagttgattggtggttgtaccattgattttcagatatag

SEQ ID NO: 54742 - DNA, 3888 bp, Glycine max
  Peptide Sequence Number=SeqID_146427
atgaccaccgtaacggtcaccactcgagctcaaatcctccgccacaccgccgcattcacctcctccgtcctctcgcaatccgaactacgtcgccgcctcatcgccactctcctccgcgacactccattctccgaccaaaaacacctaaacctcgccgcagacactcttgagagcgcgatctcgttctcgagccccgccctccgcttctcgtccctctccctcgccgagaagctcctcctccctctccccgacttccccctctcctctcttctcctctctctcatccacgcactccgtaaccgccctaccgaatccgccgttagcctcctccgaatcttccactccaacgcttccctcgctcgatccgaaatcgctcccgcgctctacgaacgcctcttctctctccacctcttccccgtcttccgctggttcgatgatcagaggacgcggattctctcaacgagccgtaacgatagcgattattcggtaacttccgaggagtactccgtggtgctgccatgcgcgaaggtgttgtcgaagatgagcgaggagcaggcagcgaagctcagggaggtggagagagactacgaagaggtcctcaaccagaactgcatggttctcgccgagtatttcaaagaggttttggtcaacgaaaacggtgacgctgctgcgattagtccaccgtcgttggtactgaagagcgccgcagaagatggccgcggcggtgtggagaacagaaaggaggagatgatgaaaatgagcgtgttggagaacggacggtataatccaatatggtccgaaagggaagcatctattgaatttttgagccccagttccagcagcagatcttcccaagtgccattttatcctcaaagagtcttttccagaatcctcaaaccccaaaaagcttcaaaaacttggacaacaccagtctatttaaactcaaccaccgctgatactgatttttctttagatgagagtttgcttagttcgtcttcagattctgaggcagaaaatgatgaggaaaaggacaaaactgttgcattgttggagcctcgacaaagccaaattaaggagcgaatgctatccatcttcaaacaatcaagaggttccccagattatcctatggcagacttcgataccccgctgcatggaattgggaaacatgcacctcccaaggactttgtctgtccaataacaagtcacatatttgatgatccagtgactcttgagactggtcagacatatgaacgtaaagctatcgaggaatggtttaatagaggaaacataacctgtcccatcacacgccagaagcttcaaaacacccagctacccaaaacaaattacgtgctcaagcgactaattgcaagctggaaagatcgcaacccccatttggtcccaccgccgtgtgagagtccgtacgaagatactgatgaggcagttgtgataccaacaacattgccttcaacttctcctaatagtgttataacccaagccaccgttgatgggatgatgagtgagttacgctgtgcaatcaataacctttatatgtcagaggttctccaggaatcggaaatggccgtgcttcaaattgacaagttctggagaggagtgaatgtaggagtggatatacatagcatgctatcaaaacctgcgataatcaatggatttatggagatccttttcaattctgttgagccccaggtgcttcaagcttcagttttccttttggcggagatgggttccagagacaatgctgttattaagactctcacacgtgtggacactgacgtggaatgtatcaaggctcttttcaagaacgggttgactgaggctgttgtcttgttgtatctgctaaacccttccactatgagtcttgcagagatggcaatagtggagtctctaataacagttttcaataagaaagaggaagacttggttaagatgtgtttgaagcccaaaacagctgcagtgcttttacttgcacggattgttggaagcagtgaagagataattgcatcttcggttgtcaatacccttttctctgaaaaaacaattggaactattgtcggaagtttgggagctgacttggcaaaggagaggattgctgcagtggagatcttgttgagatgcatggaagaagatgggacttgcaggaataacattgctgataaagcagagttgtcacctattttggaaactttaatcggtgcaaccgatggagatcgatttaagattattcagtttttctttgagttagtcaaattaaataggcgtacattcattgaacaaatcctccacattataaaggaagaaggaccttttagtacaatgcatactcttcttatttatttgcagacagctcttcaagatcaatgtccagttatggctggcctcttactccaactcgatcttctggttgagccaagaaaaatgagcatataccgggaagaggcgatggatactcttatttcatgcctgagaaacacagatttccccgttacccaattagcagctgctgatacaattatttcactgcaagggagttttgacttctctggaaaccctcgaacaagagaagttcttcttaaacgagcaggtatcgaaaaaagttccagaagtcttgtacaggaagaagagaaggcagctgatgattgggaaagaagaattgcatctgttctagttagccatgagtttggcactctttttgaggctttagcagatggcatgaagagccgaaacccagaactacgatcagcatgctttatattagctacatggctcatttacatgttgaccattctaccagatacagggatacatgtagcagctcgtgcctgcttgctgaagcagttcatagctaaattaaattgtgctaaggatgtagaagacagaatcctttctatgcttgctctcaatagctttcttcatttctctgacggctttggtgatctaacttccttcactaaggatatcataaaagggttgagagagctaaagagatcctgtcctttagcaactaaaatgctaaaggttcttgttgaagaaaatgaatctaaagcggaaatttggatacataaagagctcataaaagaagactgcagcgagaatggagaggtgctgtctgtcatttgctttaagggtaaatttttttcaggacatacagatggcactatgaaggtctggacattaaaggataacttattctgtctgatgcaagagatccaagaacatactaaggctgtgacaaacttggtgatttccgaatctgatgacagattatacagtggttcacttgaccgaactgcaagggggactggtgtcaaggttcagtcattgaatggagaatcaaagttgttaaattctagtaaatatgtgaagtgcttggctcatgttcatgggaaattatactgtggatgccatgacagtagtgttcaggagatacatttggccactggaacagtcaacactattcaaagtggttataaaagattacttgggaaagcaaatcctattcatgcactgcaaattcatggtgaacttatatatgcagctggctcttccttggatggatccgctataaagatatggaacaattccaattacagtatagttggatcattgcaaactggatctgatgtgcgggccatggaagtgagctcagaattgatttatttggggtgcaaaggaggtactgtggaaatttgggataagaagaaacacaaaagagtcgacacgttgcaaatgggtacgaattgtagggttaattgcatggctctagacagcaatgaagaggttttggtaattggaacttcagatggacagattcaggttcctcgtgagctgtatatagctcaaagtttatacatccaagtgacttgtacatag

SEQ ID NO: 54743 - DNA, 462 bp, Glycine max
  Peptide Sequence Number=SeqID_146428
atggctcaagatattcatctggtcaggggcaaccatattcttcgtgaggcgaatctgcaagttgctaatttgttggctaagcgtggagtggagctgcacgatggtgttcatgtttttcatagtcctccaactaggaatcagttagctatgttggctgatcgctgtgtttggaaattggaactggaggggcttcaggctatggtgaaagaaacagacatgtcaaccaagatgcagatccatgccatggcctctgcttctcaggcccttgatctctacgatgtttatgattgcatctctattgctgcccatatcaagaaggaatttgatagtgtgtacgggaatgggtggcaatgtgtggtaggatccaattttgggtgctatttcacccattcatcagggactttcatctattttgctctggcgactcttaattttcttatcttcaagggaacatcttcttga

SEQ ID NO: 54744 - DNA, 942 bp, Glycine max
  Peptide Sequence Number=SeqID_146429
atgtctgaggcattggaagaggttgttccttcaatgaaaggagggtgtgaagaagaagggttgaacctgaaggctactgagctgaggcttgggttgccagggtgtgagtcaccagagagggagggtgtgtttaagagtgtggtggtgtctggggccaagaggggtttctctgatgccattgatggaaactggaatggtggaggatctgaaaaagatgccgctgccttgttttctccaacttcaaggggtgctgttagtgttagtgttagtgctgccaagtctctcactctcactgcaacagactgcaccaaccaaccaactgctttgggtgcttctgttctcaaggaaactgttccacactctccaaaaccattacatgagaataagccccagatttctgctccagctgcaaaggcgcaagttgtgggatggccaccaatccgttcattcaggaagaactcaatggcttctcagcctcagaagaatgatgctgctgctgatgcagaagccaagtctggatgcctttatgttaaagtcagcatggaaggcgccccatacttgaggaaagtggatctgaatagttttaccacttacaaggacctctctttggcacttgaaaagatgtttagttgttttacactcagtcaatgtggctcatatggggtttctagtcgggaaaatttaagtgaaagtagattgatggatctccttcatggttcagaatatgttcttacctatgaagacaaggatggagattggatgctagttggtgatgttccgtgggagatgttcactgagtcttgcaagaggctgaggataatgaagagttctgaagcaattgggctagatgtagaattgagaaaacaggaaagtcatcattcaaactggaaaacagaatcctggtttgacaaacacaattgtactcaattgttaatgctttga

SEQ ID NO: 54745 - DNA, 1308 bp, Glycine max
  Peptide Sequence Number=SeqID_146430
atggaacgcatcgttggcggcaagtacaagctcgggcgcaagatcggaagtggatccttcggcgaaatctacctcggtgaaccctctctctttctctcttctgctactgatttcacagtaaccgttgattcgacgcatattgataccttcgagatcgtcgccgtcaagatcgtaaggctccgcgtactgctatttgctaggggtggcattcctaacataaaatggtccggcatagatggggaggataatgtgcttgttattgacttgcttgggccgagtcttgaggatctctttgtgtattgtggaaggaagttttcattgaagactgtattattgttggctgatcaaatgatcactagaatagaatatgtgcattctaaaggatttttacacagggatattaaaccggataactttctcatgggacttggtcgaaaggccaaccaggtttacataattgattttgggcttgcaaaacgatatcgggattccactactaatcgccacatcccttacagggagaacaaaaacttaacaggtactgctcgatatgcaagttgtaatactcatcttgggattgagcaaagtcgacgggatgatttggaatcactaggatatgtacttctgtacttcctaagaggaagccttccttggcaaggtctaaaggctgctacaaagaaacaaaagtatgataaaatatgccagaagaaattatcaactcctattgaggtactatgcaaatctcatcctgtagagtttgcctcgtacttccattactgccactctttgacatttgatcagcgacctgattatggattcttgaagcgcctatttcgggacctatttgctcgagaaggttatgattttgattatgtatttgattggaccattttgaagtaccagcaatctcaaaagaatgtaatgctccctccattatctccagttccaggagcaagtaacagtcgtgcaactccaatcgatgttgacagccatcaaggtcttaatgcatattcagggcatgttaaagagcgtattagagctggtgatgctactggttctggtgttaaaattcagtttaaatcaccagtgggtaaaaatttgagttatgagaatccacttgacaaaaatatttttggagaagcaaatataccctctacttcattttctcctgctagtacttcaaaaaggaactccttaaagcaatccttgtctgctgaagcttccaaccctggacatgcacaaggcagtaaaatgggcccttcaagtagctggatgtcatctctgcagcgcatgtcttctgctaaatga

SEQ ID NO: 54746 - DNA, 639 bp, Glycine max
  Peptide Sequence Number=SeqID_146431
atggagatggaaatgccccatggtcttcagtgccccaaaaggatgataattactgcagtgagtattcctaggagaaagatgaggtgtatgatgccgcctaagtcaagaacgttatttcaggagatgaaccgtattctagtgcgcaagcgtgcttctgctcgtgctatgagaccaaggttgtcatccaaacttgacctggaaattcttgctgcgaggtcagagattgagcatgctcctatagtaacacatgacaaagaactttatgctcctctctttcgcaaggctccatatgaaacaagacaccatatggaatactgcataaaggccctctgcaatgctgatgtgactcaaggctttaaaataggaagggatgtttctcttccggaagcttatgtccggtcacactggaaggacaaagaccctgatatgaagatatatggcccaatgcctcatggtgttacaagcaaaatgaattatatcaatcacatgaagaacagcaaatactgcatatgccctaaagggtatgaggtcttaaattgggatgtgttctcaataatccttgcagagaaagatattcccaacttgaaacagatacttctttcagtgtcacaagtatctcgagttgcaacttggagttag

SEQ ID NO: 54747 - DNA, 1731 bp, Glycine max
  Peptide Sequence Number=SeqID_146432
atggctccgaaattggcgaaaacagggtcgttccgtcacggtttggcggagaagaaggagaaggagaagcttctctcggcggcgaagagtagtagtagttattcagagataggaataggaattggcatgatgcaacaagaggaagagcaatcgtggtggaacacgtttaagcgcgtcgctgagaaggcattggaaatgggtcgttctgatccaaggaagattatcttctctgcaaaattgggccttgctttgaccattctttctcttttgattttcctcaaagaacccttcgcggatttgagcagctactgcgtctgggccattctaactgttgtcgtagtctttgaattcaacataggggcaactctgagcaaaggagtaaacggtggaatggggaccttgttggctggaggacttgctctggggatggcagagttatcaacattgggtggaaaatgggaggaacttataatcattatgtgtaccttcattgtaggattttgtgccacctatacaaaactataccctacttttaagccttatgaatacgggtttcgcatgttcttgatcacgtattgtttcatctctgtatccgggtatcagacaggggaatttgttgatatagctataaatagatttgttctcattgcacttggtgctgctgtatctttgggagtcaatatctgcatataccctatctgggctggtgaggatctgcataatcttgtcaccaaaaatttcatgggtgttgcaacatctttggaaggtgttgtcaatcactaccttcattgtgttgaatataagaaggtgccatctaaaattcttacttaccaagctgctgatgacccaatttacaatggctacagatcagctgttgaatctacaagtaaagaagattcattgatgggatttgctgtctgggaaccaccacatggtcattacaaaatgcttaaatatccatggaagaattatgtgaaattaagtggggctctaaggcattgtgcatttatggtcatggctatgcatggatgcatactttctgaaatacaggccccagctgagaagagactagttttccgcagtgagcttcagagggtaggttctgaaggagcaaaagtgttgcgtgaacttggaaacaaagttaaaaagatggagaaactaggtcgtggagacttgctgtatgaagtgcacgaggcagcagaggaattgcaacagaagattgataaaaagtcttaccttcttgtcaattcagagagctgggaaattggaaaccactcaagagaagaggagagtgattctcaacaacaaggcctctttaacatggacgaagaaagaaaatttctcgagtacaagtctctcagtgaagcagttcttgatctcagaacagttgaagctccaaatacctgggaaggaaatttaactctaggcaatagccctgatgtgcctgcaaccgatgcctctgaaaacatgttcaggaaaaagatttctcggccttctcatatttattaccataaatcaaatgccgaggccgaatcaaaaactttcgaaagtgctagttctctatctgtaacaacatttacatcgcttctaattgaatttgtagcaaggcttcaaaacctggtggattcattcgaggaattaagtgaagtagcaagctttgttgacccccttgagcaacaagcaccagtagcatctcattggttgtttaactgctccaaattcaaggactga

SEQ ID NO: 54748 - DNA, 885 bp, Glycine max
  Peptide Sequence Number=SeqID_146433
atgatagttggttatgcacaaaatggaagagaggaggatgcttggatgttgtttggtgacatgctatgtagaaatgttaaacctgacagttacaccatttctagcatggttagctcttgtgccaagctagcttctttgtatcatggtcaagttgtccatggaaaagtagttgtaatgggtattgataataacatgctcatttttgaaactatgcctattcagaatgtgatcacttggaatgccatgattctggggtatgcacaaaatggacagaagtattttgattcaatcagtgaacagcaaatgacacccacattggatcactatgcatgtatgatcactctccttggtcggtcaggtagaattgataaagcaatggatctaatccaaggtgacctaaagaatgcagagttggcagctagtcttctctttgaattggatccacataatgctggaccctatatcatgctttccaacttgtatgctgcttgtgggaaatggaaagatgtagctgttgtaagatctctcatgaaggaaaagaatgcaaagaagtttgctgcttacagttgggttgaggttaggaaagaagtccacagatttgtttcagaagatcaccctcatccagaagtgggaaaaatctatgatccatttcttaccaatgagaaacttgctcttgcatttgctttaattagaaagcccaatggagttgcacctatacggatcataaagaatgtatgtagcatgagaatactaagtgagaagtacagcagtacttcgatgaaaatttcttgtgacttggcaatgcagcttaagatgtttgggactctgaggcaagtatactctgaagtcattgatcactactttgcattgaatgagcaggtttga

SEQ ID NO: 54749 - DNA, 1377 bp, Glycine max
  Peptide Sequence Number=SeqID_146434
atgtctatgcatagttttaggttcttgcaacttatattcccctgtcgtcgttgtttctctacccaaaattctgtgtttcgatctcttctggattattctggaaacgacccagtagcgttgatagctactcagttgagtaattgcgctactgtgagggaacttaaccaagtgtatgcccacgttttaacgacgcactttttgatctccaatccggcgccgtttaattggaacaacattgtaaggtcatacactaggctagaggctccacgcaatgcacttcgcatcctcgttttcatgttaaggaatggggttttgcccgattgttacaccctccccattgctctcaaggccgtgtgccaaacatttgatgttaaccttgggaaacagcttcattccattgctatcaagattggactgcaatgtaacgagtactgtgaaacggggtttcttagcttgtatcttaaagctggtgaatttggaggtgcccgtatggtgtttgacgaaaatcctgacccaaagctgggttcttggaatgctgtaataggtgggctttcccaagctggccttgccagggatgcgataagtgtgttcctcaatatgaggaggcgtggtttcatgccagatggtgtgaccatggttagtgttatgtcggcttgtggaaacattggtgacctcaacctggctctccagttgcataaatgtgttttccaggctgaagctggtgcgaggactgacattttgatgttgaattcgctgattgatatgtatgggaagtgtggccggatggatctggcttacaaggtttttgcaatgatggaggaacaaaatgtatcgtcgtggacgtccatgattgttgggtatgggatgcatggccatgtgaaggaagcgcttgattgcttctggcggatgagagaggctggggtgaggccaaatttcgttacttttattggaatgctaagtgcttgtgtgcacggtggggcagttcaagaggggagattttactttgatatgatgaagaatgtttatggcataacaccccaattgcagcattatggatgcatggtggaccttctgggtcgagcaggattgcttgaggatgccagaagaatagtggaggagatgcctatgaagccaaattctgtagtgtgggggtgtcttatgggtgcgtgtgaaaaatatgggaatgtggacatggcagaatgggtagctaagcatttgcaagaattggaacctgggaatgatggtgtttacgtggtgttgtctaatatctatgccaatagaggcttatggaaggaggtggagagaataagatcggtaatgaaacaaggaaggcttgctaaggttcctgcctatagcctggcaacaaattcaaattga

SEQ ID NO: 54750 - DNA, 2373 bp, Glycine max
  Peptide Sequence Number=SeqID_146435
atgcacgagcacgagcatgttgtggagttcgaggacattcttccttcccccttcgctccaaacttatcagaatcggagctccgggaaacggcctatgagatgctcgtgggggcttgccggagttcggggcccaagccgttaaccttcttctcgcactctgagcagtctaacagaggaggaactcagcggattccgtcgccttcattgtacaggtcgctgactgtgacggcgtcgtcgaggaatggaagggcggcgaccacgggggagttgatgagagtgcagatgaaggttacggaactcactgacactagactcaggcgtgccctcctcagagtagctgcaggccaggtcaagtgttcagattttcctagtgaacaagagtacgaggcttggctaaggaggaatttgaaggttctcgaagcaggactcatcttgcatcctcgcctgccattattggataaggcagacacttgtgtactgcgtctgcaacagatcatccatgaaggccttgagaagcctatggatattggtaaaaacagtgaatcaatgcatgcacttcgcactcttgttatgtcgtttgacgggtctgttcccgagacatgccattgggctgatggctttccactgaaccatggcatctaccaaactctgttagaagcatgtttccataataatgatgaaacctgtgtgatacaagaggttgacgaggtcttcgagctcattaagacgacctgggttatgcttgcaatgaatgagatgttgcataatgtttgcttttcctgggtcttgtttcaacggtatgttgccaatggtcaagtggataacgatcttttgtttgcatcgagtaatctgcttgcacaagttgagaatgatgccaaggcgatgaatgatccgtttatctcaaaatctttgagctacgcattgaatttgatgttaagttgggcagaagaaaggctccttgcctaccatgacactttccataatggtaatattgaatcaatgcaaagtgttgtttctcttgcagtatcctcagcaaaaatattggcaggagatatttctcttgggtgtaataaagaagctcataaattggagaaactggatcctcgcatcagcaagcatgtacctagacaacacgataaagtcttttcaactctctccgttcttgcacgagacatcagcgaactggcttttaacgagaaggcaacatttagtcccatactgaagaggtggcatccacttgcggctggtgttgctgttgcaacccttcatgtttgttatggtcatgagttgaagcaatatgtcaagagtgttacagagttgactcctgatgctatagcggtggaagattcagttgacagtgaagatggtggaaaatccgttttaagggagatgtacccttatgaggctgaagctgtaattatcaatctggtcaagtcatggatcaagaccagaatggatggactggaggagtgtgtagacagaaatttacaagaagaggtatggaatccgcgtgcaaataaagagtgctttgctccttctgttcttgagattctaggaatcatagatgactctctggaagcgttctttctgttgccaatacccatgcatgcagccttgcttcctgaattgatgtctgctcttgacaaatctctccaacaatacattttgaaggccaaatctggctgtggatcaaaatttcatggtgttttcaggaaaaaaggaaagtcacaagtgactgatcagagaaggatatttcatcatggaactacaaacgtagacagctcatttgcattaccccagttttgtgttcgcataaataccatgcagcgcattggcatgggactaaaggttttggaaaagaggacaatttcccgtcttgggaattctaaatcaacaaaagagtatggtatagaggacaagttcaagctttctaaagctgcgtctgtggaaggtatccgtcaactctctgaggccatgacatacaaagtgattttccaggatctgcgttatgttctttgggatggcctgtattttggtgaagtttcatccactagaattgagccttttcttgaggagcttaatcaatgcttgaagattattttgtctactgtgcatgacagagtcataacgcatgtaattactgaggtgatgaaggcttcttttgatgggttcttgttggttttgttagctgggggtccagcacagggtttacctgctgatttgatagaaaagcagtgtaccactgttaaagaagtgcttcccctgttccgcatggatactgaagacttgattgagctattcagtgagcttattctgggaatcactaagttccttaagaagaactacaacttgcccaagaagtctaaccgctaa

SEQ ID NO: 54751 - DNA, 126 bp, Glycine max
  Peptide Sequence Number=SeqID_146436
atgctgccgccgccgaggaacaaagctaggctcaccaccgatgaggaggagtttcacatgttgtcgttgggaagctccagcaaaaccagagagattgcagcaatggagatcaagcacatgaacgtg

SEQ ID NO: 54752 - DNA, 1005 bp, Glycine max
  Peptide Sequence Number=SeqID_146437
atgaccagagtcgaattttcagaacaacagttcatgaaatgggtgaaatttgtaggtggcctcaaacattctgtctttaggacagcaaagaataagctttttccttctcacactttgcacgtttctaagaagcatggtaagggaggtttttcgtcaattcaagcagccattgattcccttccattcatcaatgtagtgagagtggtaattaaggtgcatgcaggggtttacacggagaaagttaatatttctcctttcaaatccttcgtaacaatacaaggagaaggtgcagataagaccattgttcaatggggtgacactgctcaaagccagccattaggaacctatggttctgcaacttttgctgtgaattcaccttatttcatagccaagaacatcacattcaaaaacactgccccaattccagcaccaggagcagttggaaagcagggagtggcattgagaatttcagcagacacagcagtattcctaggctgcaaattcttaggagcacaggacacactctatgatcatattggtaggcattactataaggattgctacattgaaggctctgttgatttcatatttggcaacgctctctctctctttgagggatgtcacgtgcatgccatagcacaacttacaggggccttaacagcgcaaggaaggaacagtttattagaagacacgggtttctcgtttgttcactgtaaggtcacgggctcaggggcactttaccttggaagggcttggggtcccttttctcgcgttgtctttgcttacacttacatggacaacatcatcattcccaaaggctggtataactggggcgaccctaaccgtgaaatgactgtattctatggacagtacaaatgcacaggaccaggagcaagctacgcggggagagtatcatggtcaagggagctcagtgatgaggaagctaagccttttatttcacttagctatattgatggctctgaatggatcaatctctctctttga

SEQ ID NO: 54753 - DNA, 2301 bp, Glycine max
  Peptide Sequence Number=SeqID_146438
atgggaacgatcgcgcttcctagaagcagcagcagcataatcagccaatttcttacgccttcctaccctctgacgaagaaccacgacgccagtgccattacgaaacaaagacaaagacaaaacaggggaaaggctttggacaaaattcaacttgagagtttgtcagacaagagcaagcttgacgctcagccagagttcttcatccacattattcctgacaagaccaacaacacattgtctatcattgacagcggtattgacattggctggtctgggaccaaggaattcatggaagccctggctgctggtgctgatgtcagcatgataggacagtttggtgttggtttctactcggcttatcttgtatctgataaggattttgttaccactagacagaatgatgatgagcagtatgtctgggagtcccatgctggtggctcattcactgtgacaagggacacatctgctgagaaccttggtaggaaaacaaagataactttgtttctcaaggaggatcaacttgagtatcttgaggaacaccgtctgaaggacttgatcaagaagcattctgaattcattagctatccaatttctctttggattgagaagactactgaaaacgagatttctgatgatgaggatgaggaagagcagaaagatgaggagggtaaagttgaagatgtagatgaagataaggacaagggggaggagaaaaagaagacaattaaggaggtatctcatgagtggtcattggtgaagaagcagaagcctatttggaggaggaaacctgaagagattacaaaagaagaatatgctgctttttataagagtcttaccaatgattgggaagagcatttggctgttaagcacttttctgttgagggtcagctggagcttaaggctatcctctttattcccaagagggcaccttttgatctctttgacacaaggaagaagcctaaaaacatcaaactgtatgtctgtcctgtcttcatcatggacaactgtgaggagttgatgccagaatatcttagctttgttaagggtattgtggattctgaagatcttcctctccacatttctagagaaatgctgcagcagaacaagatcctaaaagtcatcaggaagaacttggtcaagaagtacattgagatgttctttgaaattgctgagaacaaggactataataagttttatgaagccttctctaagaacaagtcaaagctagccgaattgctcaggtatcattccactaagagtggtgatgagatgaccagtctcaaggactatgctaccaggttgaaggaaggacagaatgacatctactacattactggcgaaagcaagaaagctgttgagaattcccctttccttgaaaagcttaagaagaaggggtatgaggtgctctacatggttgatgctattgatgaatatgctgttggtcagcttaaggaatttgagggaaagaagttgttctctgccaccaaggaaggcctgaaacttgatgagagtgaagatgagaagaaaaagaaggcagaattgaaggagaaatttgatggtctttgccatgtgatcaaggatgtgttgggtgacaaggtggaaaaagttgtagtgtctgatcatgttgattctccttgctgtctcgtgactggtgaatatgggtggacagccaataaggaaaggattatgaaagcacaggcattgagggaccgcagtatggctggatacatgtcgtgcaagaagacaatggagattaaccctgagaaccccatcatggaggagctgagtaagcgagcagatgctgacaagaatgacaaatctgtgaaggatctcgtgctattgctctttgagaaagctcttttaacttctggcttcagccttgattatcccaacacttttggtaacaggattcactggatgttgaagctcggactgagcattgatgaagatctggtgatgctgatgctgacacgccttctctggaggatgccgatgctgagggtagcaagatggaagaagttgattaagtgcatgtttggattaaagtttgcaaactcaagcgattacagatttacagcaccccatgttcatagaatatgtagagaaaaagaaaataagtacaaggtcctacggacgggcatacttaaggacaattgtggagacatcattaggacgatcataaaaataaacataacgtatattctgaattgtgaacagctcctgatggaaactgcaagcttcgttgatgcgaccttgttgcgtctccaacgactcatcttcagcaacgaaacacatgcataa

SEQ ID NO: 54754 - DNA, 1524 bp, Glycine max
  Peptide Sequence Number=SeqID_146439
atgggagcggagtgctgtgcagcctccggcaattgcgcacgcacccatgacccaacaagtacttcagtttcagatgctatgaagaataaagtctgtggtctcgaactcccacatgggatcaaaaacagaggaagtagtagattacacgttgatggagggagcagtagaaaaagaggggcagcactgttggagcataaggagagaagtgaaagcggtgggggagctggcgtttccgatagccttaacggcgctgatattctacgcgcgttccatggtatcgatgctgttcctgggacacctaggagagctagaactggcagcagggtccctaggaatggcgttcgcgaacatcacaggctattcggtgctgtcgggtctagcactcgggatggaaccgctatgctcccaagcattcggcgcaaaacgcgtgaatgtgttgtcgttgaccctccaccgctgcgtcatgttcctgaccccaacatcaccctaatggcccacacctacctcctcttctccctccccgacctcctcacccactccttcctccacccaatccgcatttaccttcgcgcccagggcgtcacccaccctgtcaccttagcttccctcgccggaaccctcctccacctccccttcaactacctcctcgtcacgcgcctccgcctcggcctcgccggtgtcgccgctgcctccgccgcttccaacctctccatcctcctcttcctcggtgccgccgtcttcttttccggcttgcactgctccgcgccgagccgagaatgtctcagcggctggaagccgctccttcggctcgctgcgcctagctgcgtctccgtttgcttggagtggtggtggtatgagatcatgatcattctttgcgggcttctcgtggaccccaccgctaccgttgcttccatggggatactcattcaaatcacttcactcatctatgtttttccctcctcgcttggtttcgcggtttcgactcgcgtcgggaacgcgctgggagccaatcgtccctctcgggccaaactatccgcggtggtttctgtttttctcgcagcgattatgggattctcggcgatgtttttcgccgtcgggatgcggcggcggtgggggacgatgttcaccgccgacgaggacatattaaggatcacgtcgatggcgctgccgatcctcggaatttgcgaactcgggaactgtccgcagacggtggggtgcggcgtcgttagagggacggcgcggccgaacacggcggcgaatgtgaacctgggcgcgttctatttggtcgggatgcccgtggcagttggacttgggttctggtttgacgttggattctgtgggctatggctgggcctgctctcggcccaggtgtgttgcgcgggtcttatgttgtatgtgattgggaccaccgattgggagtttgaagcccatcgggcccagttgctgacgttggtcgaagatggagtgatggacggacagaaacagccgttgacgggtgttgttactgagactccctcgtcttga

SEQ ID NO: 54755 - DNA, 1275 bp, Glycine max
  Peptide Sequence Number=SeqID_146440
atggatccttgccccttcattcgcctcattgtggaatccctcgctctcaaactcccttcctctccggccaaacccccacccctctccggcgtccacccttccaccaccccctgcttctgcaaaatccgcatcaacactttcccttctcacaccgccatcctccctctctcctcctctgcctcctcccccgacaccaccacctccgcccccgccttccacctcgaccccgccgcactccgccgcctctcctccaagcccctcaccctcactctctccgtctacaacggcccaatgggccgctcctgcggcgtccgcggtgccaagctattgggccgcctccacctcaccataaacctccccgctgccctctctcgctccagcgccaacaccttccacaacggctggctcaacctcggtgggggtgggccccacaataacaataaaccctccgcccagcttcatctcgttgtccggtccgaaccggaccctcgcttcgtctttcagttcggaggtgaaccggaatgcagccccgtggttttccaaattcagggaaatataagacagcccgttttcagttgcaagttcagcgccgatcgcaactacagatcccggtctcttccatcagattttacaaagaatcgaagtgggtggagaagatcctccacaggtgagaaagagcatcaaggaagggacagaaagggttggatgataatgattcatgatctctctggctcaccagttgctgcagcctccatggtgacaccgtttgtcccatcccctggctcggatcgcgtgtcccgatcgaacccgggtgcctggctcattctccgccccaacggcgcctcagagagtagctggaagccatggggtcgtctcgaggcgtggcgagaaagaggtcccgttgatggcttgggctacaaggttgagcttttctctgacaatggaccagccaatagaatacccattgccgaaggcacaatgagtgtcaaaaagggtggccagttctgcattgattacaaggtcataaaggatgctggattgggttcaaggttgccaggggaagaaggctttgtgatgggttcaactgtggatggtgaaggcaaagttagcaagcctgttgtgcaagttggggcgcagcatgtcacgtgcatggctgatgctgctctcttcattgcgctctctgctgctattgatcttagcatggatgcttgcagacttttctcacataaacttagaaaagagctttgccatcatgaacaggattccttttcatag

SEQ ID NO: 54756 - DNA, 996 bp, Glycine max
  Peptide Sequence Number=SeqID_146441
atggagaagcttatcaaatacgttccttttagtaactttaaaatagctcatttgtctgtgattgaggaagccatctctgcaacatattttggggtaaggccacaaggtatttcactcctgaaggtcttcactgctgagtattctttgatatgcaaaatttctgattacaagaagccatatataagcttcatggatggaataactatgggttttggaattggtttatctggtcatggccgctatcgcatcataacagagagaactgttcttgcgatgccagaaaatggaattggtttgttcccagatgtaggttttgcttatatagcggctcaaagtccaggggaaggatccgttggtgcttatcttggattgactggaaagaggatttctactccctcagatgcaatatatgctggccttggaacacattatgtgccatctggaaagttaggttcattcaaggatgccctcttggccacaaacttttctcaggatccacatcaggacatcaaagtacttttagcaagatatgagtccaaccctgagtccgaggcacagttgaaattgcttttacctcagctagtttctacatttggaggaaataaatcagtcactgaaattattgaggagctaaaaaaacaccagtcaagcactgaccctaatgtcgtggagtgggctaatgaagctctccaaggcctcagaaaaggtgctcctttttcccttttcttgaccaacaagtacttctcttcggttgcctctgcagtggggaataatgacggtggactatccacgcttagtggcgtaatggaaactgagtatcgtattgccttgaggtcttcactacggcatgatttttcagaaggtgtccgagcagtgctggtggacaaggatcagaacccaaaatggaaaccatcaagcttggaggaaattgatccgagtgaagtggaagccgtctttaaacctttaggaccggaagttggggagttgagagtgtaa

SEQ ID NO: 54757 - DNA, 1915 bp, Glycine max
  Peptide Sequence Number=SeqID_146442
atggctaaatttagtgcacaggaagttagtgcacttcaagaaggaggaaatcagcgtgcacaggaaatctatcttaaagaatgggatccacaacgtcattctttgcctgatagcagcaatgttgacaagctccgggactttattaagaatgtttatgtggatagaagattcagcggtgagaggacctatgacaaacctccaagagtaaagggtgacaaggatgatttccacgaaaacatgagaacaaaaacgtatcagggaagcccttcatatgaggacacacatgaacgtcgttacagtgacaggtctagtcctagtggaagaagtcccggatatgatcaagaaaacaggcaatatggtgattacaaaaaaagccctgttcgtcctccaataatcaatgattggcgtcgagaagatagatttggggatggacggaaatttgaagatcatagaatatctgatggaaatcataatgtggaaagagcttctcctgagcgagccaaggatctggattcttccagcccacctgtggtccgacctgttagagagatcttgggagaaaatgtagtacctcttcgaataagtgaaccacccaaaacaaacagtggacaggctgctaatggctcagcactcacacaggttaagttattaccgatgatgttccatatgctccaaccatctgtgttgggagttaggacagttaattggactgttctaatgagaactgcatcttccagtagcttagcatccagcaatggaacccctgcagaagttaagcttgagactattaagagccttattgattttgatgatgatcctgaaccacctgttgcttcagcagctcctcaagcccagcaaactactgtggctcaacatgggatgcctgcaaattccaatgataataattgggcctcttttgatgttgctcccgaggcaaaagcacctcagggtccttcgaatgtaaatccacttgaatccatgctgacacaattgtcagtaccagtatctttaccttctcatgtttcaggagcccaaggtgattcccgtgttgcaacagctaattctgggagctgtgtgacaatattgttaatattcaatgacccgtctgtttctcctgcaggacttgtgatgggatcagctcttaccgctactgctgcaggaacaccaattattagcagcttctcaacattcccagccagtggtgcttcagtaacatcttttggattaacaccagcatcaactcacaataatgcaggacagtgggctactttgcagtatcagcaacaacaacctttgttcactgctgctgctagtcagcctactattcaacaatccacatcaccagttggtggagctttgaataatcagccctggactgtaccactggtacaagggaacccaagcacaccaatgcctcatacatcacacctcgtcccaaagcctgccaatgaggctaaatcccgtgttgttttacaaccttctacagcagacataaaaccaagtggaagaagtgagcttccagaggatctattcactgtaaaatattcaccgttccctgctccagtcccaggttggcaaatgggtccaccacctagcatgggtatctcaattcaatacaataatgtggtgtttccttccatgtcatctttgcaaggtgctctgcctagtgtaacaccttcagctacaatgcacccgtcaaacatgggtaatatatctcatgcttggaatccaccctcatcatcatcttatgtatcgcctcctcaagtacaaactcttgcaccagcaatgggaccaggggcatacatgggacaacaaatggcaactaacatgccaatgccaaggcatcaaggaattgggagttttgctactgaggcaactgcttttgggttctcaaatccagatcaacagctgactg

SEQ ID NO: 54758 - DNA, 411 bp, Glycine max
  Peptide Sequence Number=SeqID_146443
atggcttcccaatctcaggttcagatgagcaagctccgtgtttctgtaataccggaaagtgacagtggcaatggaacgacgtcgtcgcccaaagggcagtgcctctgttctccaacgacacatgaaggctccttccggagaacaataaaattgggaaagaattacaatgagattgagcatgtaaactcgctagcagcaaatattggaacaaacaagttgaggtggaaattgttgtggatgaagctcaagaaagagaagaagaagaagaagaagctttttgagtctgcatcaccctttcaggttccttatgatcaatacacttactctcagaatttcgatcaagggactgcacttgatgaaccagatgatctttctctgttcggtttgctgatccttccatggtacttgtga

SEQ ID NO: 54759 - DNA, 786 bp, Glycine max
  Peptide Sequence Number=SeqID_146444
atgaagggttcatccaaagtgattatgggtgcaaccttggtaatggtggtaacccttgcagtggtcctagtccttatatttgtgctgctagctgagctctactgctccctcttacggcggcggcgccacctcagaaacagaaactccaacaacactattccctctgccaccacagccagagccaatgcttcaccttctcacacagcctcacaaccccaacaagagtctactccaccattccgcagcatttatgcacaaggagtcctccaagctccaagaaacatccttctccccgcagtttcttccaaagaagagaaagctggaccaaggaagcagaatcactattctcaacttgatcaatttcttcaagttgaaagcccttccccaccaccatccttcatatccatagcaccggcctcaaaaccaaatctttgccatgatgatgataaacaagcaccttgcactggtggagaacaacagcttgtgtacatttccaaccccatttatgaaaacgagagccaagggagtggagcagacactcccccatttgagacaccagacacttcaccttcgcgcttggaaagaagtggttcttctgaggaagatgatgaggcaacccttgcttgtgttaccccacctttgactccaatgaagaagctccctgcagaggcttcttcagtttccctaagagacgcaaggtccttggccacttcatgcagtgattcacgtagcaacaatggcctctcttcatcatccgcttccccttgcacttctcctttatggtaa

SEQ ID NO: 54760 - DNA, 273 bp, Glycine max
  Peptide Sequence Number=SeqID_146445
atgacatggttttgctctgatgtgtggacactagaaagtgggctaagcgcgcatccaccactaagcatagcttcagcgtgcttagcacgaccgaagaatctggaagagcatcaatatcaaggctgcgcgctaagggcgagatcagtgtgttatgcgcagcagttgtcttcagccaggctcagtgcaagactggcgctaagctcaaatccacttactcgcgctaagcgtgagggtggcgctaagcgcaacgtcacggattcagagcctatttaa

SEQ ID NO: 54761 - DNA, 519 bp, Glycine max
  Peptide Sequence Number=SeqID_146446
atgaaagaaataaaaaaagaaaaacacgcctcctatagttgtcatgactcttgcaagagtttaagtgaagaacttagcaactattatagagggcaccatagttcgcatactaaacaccattcccaaagaagcgaaaaggatagaaggcctcaagaggctaacattaacctaccatacttccatgggaaggacaatgtagaggctaacttaaattgggaaataaggaaagaccaaggtctaggcatcttaggggcagcaccttctaagcccaaagatgataaggggaagacaatagaaaagcaaccccttaaggctagtatgcaagaaaagactagctctataaagtgttttaaatgtcttcgaagaggacacattacttctcaatgccccaccaagaaaaccatgattatgaggagccaagacatttatagtagccaagatgaggctactacttcaccttcctctagtgaaagtgaagaagcaaaaggggaagaatctagtgcagaaatctacccctaa

SEQ ID NO: 54762 - DNA, 490 bp, Glycine max
  Peptide Sequence Number=SeqID_146447
ggtagaagtctccatggaaccaattgcctccctcgcccagtattatggtcagccgttgaggtgcttcatctttggggacttccagctatcaccaatggtggaagaatttgaagagatcctaggatgtcctctagggggaaggaaaccatacctcttctcagggcaagttgaaaatggggtggtcggaataccgagaaaatatttggaggtaaaagcaagaatcttggcagataaaggcgagtggaccccattcatagatattctcacactgttgattttcgagggagtcctctttccaaatgtggatgggttggtggacctggaagcgatcgacgtttttctcgcctatcataaccacaaggaaagtctggttgtcgctatgctagccgacctatatgacaccttcgaccgaagatgcccgtctatctgctacaaggtcaccgctcgtgcgtcgaaaaagaaagacgaattgggaccaactcttggctag

SEQ ID NO: 54763 - DNA, 776 bp, Glycine max
  Peptide Sequence Number=SeqID_146448
tcagacctttatgtggatcgacaccgtcaacaatctgatcatcgtcgactgcgccagcgcgaagaaagcggaagatacgctggcgttactgcgtaagagcctcggctcgctgccggtggtgccgctgacgctggaaaatccgatcgagctgacgctgaccgaatgggtgcgctccggtgaattgccggcgggtttcaccctgatggacgaggctgagctgaaggcgatactggaagatggcggcgtgatccgctgtaaaaagcaggatctggtttccgacgagatcgccacccacatcgaagccggtaaagtggtcaccaaactggcgctcgactggcaggagcgtattcagctggtgatcgccgatgacgcctcggtcaagcgtctgaagttcagcgacacgctgcgcgagcagaatgacgatatcgatcgcgatgatttcgcccagcgttttgatgccgatttcattctgatgaccagtgagctggcggcattgatcagcaatctggtggaagcggtcagcatttatgctgaccgcagcccacacacctcatgctggcgcataaaaaaaaccggtaacgccgcacaggctttaccggtggaattcgctgtggcccggcacgttaaataccgatccggcttcgtaccatttccactcggcttcgcccggcagcagcactttcagcgcgccgctcactaccgtcatctcttctggctggccggtaccaaaggtgtattcgccttccgccatcacgccaacgctggcccggccaatg

SEQ ID NO: 54764 - DNA, 336 bp, Glycine max
  Peptide Sequence Number=SeqID_146449
atgagtgatggattttgtggtactcatttgcagatcatggttaggactagaggattagatcatgccttaggtcaggtcactgacataggtctgggtagaggagatcgtgatgattccgatgatgctccgcagggtctacggcctactgcatccgcacggaggctgcgagtcgctgtgactgcggatcacgtcgatgagccagtcatccttgcgccagatgttcaggatgacccgatggaggcaccagctgctgtggaggacattcctgcggacgcaggcgcagaggcggctgaggatcagtaccagggatttccgggtggttcgagcgacccatcc

SEQ ID NO: 54765 - DNA, 201 bp, Glycine max
  Peptide Sequence Number=SeqID_146450
atgcggagatacccgagaggttatccgtttaaaatttcttttgctatctctaagactcaaagcatgatagcactgcagagactaacgtcgtcttctgcaccctttgtcagatcagcggccaacaagcccgttgacacgcggagatttacgtcatcttccgcgtcagacaatttctgtcatactgacactggagtcacgtga

SEQ ID NO: 54766 - DNA, 264 bp, Glycine max
  Peptide Sequence Number=SeqID_146451
acttatcaaggtaatccttgtggcgtctaccttgacttatcttccttcactggaagtggcgtctacccggacttatcttccttcaccggaagtggcgtctaccctgacttatcttccttcaccggaagtggcgtcatccaaaaactctacagcttgtatcaagtgatccgccccgtaaggttcacatcatctttgtcatcatatcttttaaaaatttggcatatagtggcatctattgaagtgcttctccaaagggtaaagtaa

SEQ ID NO: 54767 - DNA, 730 bp, Glycine max
  Peptide Sequence Number=SeqID_146452
atgagtcatcattcatctggtgttaatggcgagggtactagtcataaagaccctttatctagaatcttagatgagttgagttccctcaagctatggaaagaaaaacaagagagaaaagaaaaaggaaaaaaaagagtggaagaaataagtcaagatgaaagaaagaaaataagagaggaagaaagaagaaaaataataaaagaaatgaaaagagaaaagcatgcctcctatagtagtcataactcttgcaagagtctaagtgaagaacttcgtgactattacgaaggaaggcataggtcacatcttagacctcactcccatagaagagaaaagaaaagaaagcctcaagaggctaacattaacctctcatacttccatgggaaggacaatgtagaggctaacttagattgggaaataagggtagagcaacaacttaaaaacaagtatacttcaaaatcttatagctctcactcttatccaaagaaagaccaaggtcaaggcatcttaggggtgacaccttctaagcccaaagatgataaggggaagacaatagaaaagcaagcccctaaggttagtaagcaagagaaaactagctctataaagttctttaaatgtcttggaagaggacacattacttctcaatgccccaccacaaaaaccatgattttgaggggccaagacatttatagtagccaagatgaggctactacttcaccttcctctagtgaaa

SEQ ID NO: 54768 - DNA, 902 bp, Glycine max
  Peptide Sequence Number=SeqID_146453
tggaacctctacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatctatcttggctgaatatttcagcagctctaccgattgacccaaggcaacattttctccatcacggttccataatggttggtggtacaaggactaatagatggaagtgctggtggcttgctgtaacttggacaatatggcagaaaagaaataagatcatcttcaacaacgaatccttggacagcaacaaactgattgacgatgcttcttttcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 54769 - DNA, 93 bp, Glycine max
  Peptide Sequence Number=SeqID_146454
tattcaagccatagtggagttcaaaagacagtgtgccaaaactaacagtaaccagaatttcaacctagaaatcaagagtagtgtttatgttgc

SEQ ID NO: 54770 - DNA, 318 bp, Glycine max
  Peptide Sequence Number=SeqID_146455
atggcagaggtctccacagaggccattgcctccctcacccagtattatgaccagcctttgaggtgtttcacctttggggacttccagttaacactcacgaatttccaaaatagtcaaaatctcggcacaggaattggaccgggggaagcaagtcgaaaatggggcggttggagtaccaaggaaaggtttggaagcaaaggcgagaaccttggcaagtcaagacgaatgggctctgttcatggacgtcctgacgctcttgatcttcgaagtggtcctctttccaaacgtagatgggttggtggacttggcagcaattga

SEQ ID NO: 54771 - DNA, 222 bp, Glycine max
  Peptide Sequence Number=SeqID_146456
atggcaccagaacatgcatgtgtcttggctgcttcaaccaagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgag

SEQ ID NO: 54772 - DNA, 266 bp, Glycine max
  Peptide Sequence Number=SeqID_146457
atgcagagaaactcgcttgcttcctctagcgacacttccttcttgccgcagccatcccttttctctggaagacctttcactggtgtcgcaacctacccttcggtgggagggcgacgcgtgactcgcgggatgcgtgttccacgaaaggaatacgcgcggagtcgccaccaacgtttatttgaggaaaacgtcggaaaaaccggaaaggacgcgatctacgatcttttaagtgaaaggttcgggagtcgtatttacgcacggggaag

SEQ ID NO: 54773 - DNA, 441 bp, Glycine max
  Peptide Sequence Number=SeqID_146458
atgaagaaggctgttgaaccaggaaacaagcaggactttgctcaaggtaagctcgtgaaggagtcacacgaggatgtagaagagggcttccgaccacactggtacctgaaatctgaagaagcatgggaggaagccaacagggatttgtcaagcacttccaactcatccttggaagtccatgttacattttggctcaagataggagctcttataaggattgaacagaggctccaagagcttggtatgcaaaggatgtcgaatgaagatgttcagaacattttgtcaacgggagacaatgaatttgagatgagtcttgttggagagctgattattttctgggactcaagtgaaaatgcagagaagactcctgattctctacaagcatatgaaagaacatcaatcaacctgcaaggagtccctccattagaaatccagccataa

SEQ ID NO: 54774 - DNA, 409 bp, Glycine max
  Peptide Sequence Number=SeqID_146459
gatcctttacatgtaagacctatagctcatgcaatttgggatcctcattttggtcaaccggctgtagaagcttttactcgaggagggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaagtttatggctgaccgatattgcacaccatcatttagctattgcatttctttttctagttgctggccatatgtatagaaccaacttcgggattggtcaca

SEQ ID NO: 54775 - DNA, 540 bp, Glycine max
  Peptide Sequence Number=SeqID_146460
atgacgaacaaaagaaaagttttaggaaaaaataatgaggaaacaagaagttattttacatggaatttggaaatggaacgtgtattggctgatgtacttagagatcaaaggaatttgggcaacaagggtgacggaggttggaaaagtgacatccttggccagagtggatttgattgggatggcactaagcacatgatcacaattgagaatgaaaatgcttggaatgaatattgcacttcgcataaatcggctaaaccgtttcgatacaaggtgcttcaaaattgggatgatatagtggatttgtgtgctaaagatagagccaccggtcatagagctgaaactgctatggatgctgatgaagcgacgagtagagaaacaaatgaagtggaattcatggggttaggtgctactgccatagatttagaagaaccaagctctaatacaaaaggaaaaagacaaggttcgacttcttctggcacacatcctcacaagagaaagaaagatgggagaaaaagaaggaatagcagcttctttggataa

SEQ ID NO: 54776 - DNA, 312 bp, Glycine max
  Peptide Sequence Number=SeqID_146461
atgaatgtcattgcctggcgctgttcatgtatcctccaccaacgactctggagccccgcgaagttattgcgtagcgctcttcgccaattgtctattctccactttttaacggagccccatgaatgtcattgcctggcgctgttcatgcatcctccaccaacgagtctctggagccccgcgaagttattgcgtagcgctgttcgccaattctccattctccacttttttacggagccccatgaatgtcattgcctggcgctcttcatgcatcctccaccaacgagtctggagccccgcgaagttattgcgtag

SEQ ID NO: 54777 - DNA, 413 bp, Glycine max
  Peptide Sequence Number=SeqID_146462
caagtttgcgaagttggacaagtttgaagggcagaatttcaaacgatggcagaaaaagatgcactttctcttgacaacattgaatgtggtgtatgtgctgagtacactgatgccggtgtatatggaagacgaaactctggatcgaacaaggaagcattcgaaatgggagaacgacgagtcgtggacacattctgaacgggattgccgggtgttcaaaggaaagaacaaggctggtccaagtgggtctaatgatcctgaaaagcaaccggatgatgacgttgcttggtggtttgattcgggagcaacaagccatgtgtgcaaagatcgtcgttggttcaaggaatttagaccaatcgatgatggctctattgtgaagatgggcaatgttgcaactgaaccaatcctaggattag

SEQ ID NO: 54778 - DNA, 264 bp, Glycine max
  Peptide Sequence Number=SeqID_146463
atgtcagaattcacaagagattatcctcctcaaattttagccagcccgcatcaattagaccttgcaccttatgcttcagggtcatacaatactcaacggaatgccctggaactcctccatgataagcacatgttgcattcgagttgtatcctcagaaaaatggaggttgaggaaccttggctggggttatggccaccattgaattatcgagttgatatgggagcaggctttgtggctgatttaaggggtggcctttgtggttga

SEQ ID NO: 54779 - DNA, 508 bp, Glycine max
  Peptide Sequence Number=SeqID_146464
gtcgactctagaggatcccacctatcgcaacctccccttttgcgggtgagtgaggtgaggctcacgggtgcgtcttccaaaggaggaaaatgcgcggagtcgccaccaacgaaggtcgacaaaagcagggctcttgctcctacgtaccctccatcgaagaggaaatcagacctacgtagttctttcaaaaggggctgtcataccctaatttcgtccggggattattacttgatgacatgcaatctttggtttgcgcgatccgtgaaagtccgtaatgtgacggaagtcgaaaagaggcccacttgggccttccagaaggctgttgcttctggaggaagcaacctggctcgcctgggcgagctgggcggcaagcatctcccctattttgctataaataggggaggaaccgaggcgcttccgaaacgcttccgtaacgtttccgtgaagaatttcgcaaaaggtttcaaccgttcttcggcgttcttcattgttcttcgatcttcaacgg

SEQ ID NO: 54780 - DNA, 302 bp, Glycine max
  Peptide Sequence Number=SeqID_146465
aagaggaaaggttgaagcaaggaaggactgaaagtgctcatgttgtgagtacctctaaagacaagggcaaaagaaaaagaactgaggagcccaagaatgaagctgctaagggtctaggacaaaagaaacaaaatcagggtgacaactgtttcgtttgtaatattgttggaactggttcacccttggttaatgataatctatatttacttgatactgtagcttcctatggtgaatcctattgcatggtactaagcgtagaattgataatacaaactcaggagcattatggcataagcgcttag

SEQ ID NO: 54781 - DNA, 651 bp, Glycine max
  Peptide Sequence Number=SeqID_146466
atgaggggagcgccaaccgaagaaagtctctcgcctttccttgtgaggaatctaggcgcacaaagtctcaaggcgatacaaagaatccacaaggcgtggagaagtccgttgaggaaagacaaggagcttagggggatccgtaatggcgtcatcggaggttatcatggatggctaagaattcacacgcgggggttagattggctcaccaaattgaaagttatcgatgaggagaacttcgaagctccggaggaagatgaagaagtccgagctttaaaattagagttaggaaaggcaagactcgccaaggagaagttcaagttagctgctacacacatccggaaggagtgcgccgagttacaagaggaaaacgcggccactgcaaaagcccttgaacaagaaaccaaaagggctcgcaaggaggaatatggccgagagaaattccgaggagcattgtggggtagcaacaatgagctcaagctccgaagagaggagagagatcggtcacgggtgcatggcatgatcttaaaagaagagttagttgcttgcgaggtccaaaaggagtttggctcaacacttggaagccacggagcaaagcatgctagctatcatagggcaatacaaggaagagttgaaccagtctgtggcccatga

SEQ ID NO: 54782 - DNA, 675 bp, Glycine max
  Peptide Sequence Number=SeqID_146467
agggttcaacattcaatttcgagcgtctcgatatatgacgggactcaatcagacatccgagtaaaaagttattgtcgtttgaattggctcggagattcaacattcaatttcgacggtctcgatatattgcgggactcaatcagacatccgagtaaaaagttattgtcgtttgaattggctcagagcttcaatcattcaattttgagcatctcagctatattacgggactcaatcaaacatccgagtaaaaagttattgtcgtttgaatttggctcagaggttcaacattcaatttcgagcgtctcgatatattacgggtctcaattcagacatccgaaggttcaacattcaatttcgagcgtctcgttatattacgggactcaatcagacatccgagtaaaaagtatattgtcgtttgaattggctcagaggcatcaacattcaatttcgagcggtctcgatatattacggactcaatcagacatccaagtaaaaagttattgtcgtttgaattggctcagaggttcaacattcaattgcgagcgtctcgatatgttacgggactcaatcagacatccgagtaaaaagctattgtcgtttgaatttgctcagagattcaacattaaatttcgagggtctcgatatgttacaggactcaatcagacatccgagtaa

SEQ ID NO: 54783 - DNA, 336 bp, Glycine max
  Peptide Sequence Number=SeqID_146468
atgggtgaagtagagaaggtgcaagagcagatgaaggccgacatggaggccatgaaagagcaaatggccacaatgatggaggccatgatgagcatgaagaagataatggaagccaatgcggttgcaattgccgctaccagggctattgctaaggtgaacctgatgccctcatctggcctcaaccaaatgaatcatccaacctcagatatggtagacaaagatttgggaagtacggacggccccctattatgtgcaaattcaaaacaagcacgccttcccgccatatggcttgcctcccaactaagcaccacccaatgtggcgtacactcccaataa

SEQ ID NO: 54784 - DNA, 699 bp, Glycine max
  Peptide Sequence Number=SeqID_146469
atgtgccttagagacattaggcataacaaatttgaagattccttgataggaacggtagagacaagtttaggacatggtccagtctacttcaattgctatccaaacaaaatagtgagtctgatggacagaaacattcttgactctctgttcttaaacatccactttcatggccttgacatgaaagaaggatcaattccagcagcactaatctataggattcagtacaaggtcatgaatacttgtgcatcaagattccttctgaaaccacaaagaggagagacaaccttgtttatcatcgatatgacaaaggccaatgtttctcttccaagaaccataaaatgggatgaggccatgccgtcagttccccgacccactccaaccatagagaagatcaaacaggataactccagaaaggtagaaataacctttaattggagaaattatttctcatcaagaatagaagtctctaggtctgaatatgagtcaacaagaaggttttttttgatgagaactcgttcaattccagtaggattaaccagatctgagtcacacaaccagttccctatggtaaacctccaaggtttagataccacttctagtatacctagaacaacatacaaccaagaacaagaggacgaccgaaagtcaatccaatctccaacttactcctctatgcatgaaccttatgatgttatctga

SEQ ID NO: 54785 - DNA, 333 bp, Glycine max
  Peptide Sequence Number=SeqID_146470
atggatcgcacccacaagacacccagtggacccggaaaagtccaacaaggccctggggtttccagctctggttacgggcctctatcagtcctacagggtgctcggcaaggttatgtcatcatagggatcgcacctgcaagacacccagtggacccgaagaagtccaacagggtcttggagttgtcaagctctaattacgggtctctgtcagttctacagagtacctacgcaccgccaccacctttagagttcacctctgctcatccacaaaaaggtttgagtattgcctatgacacatggccgaccaataggcaaccaagtccaaagccaaag

SEQ ID NO: 54786 - DNA, 737 bp, Glycine max
  Peptide Sequence Number=SeqID_146471
gcaaatggctacaccgcttagctctcctcctactccttctcctactggtgcagcatcacagatcgccatctaccttgaagcggacaagaaaagtcacacggctaagatcattggcgaatagacaagttggggcagagagaccgttggtccatgtcaatcctgcaaccgggaaggctgacggtccccacagaaagaagttgagaacatatttggggatcgttgctcatgataaggctgaatatgatatccctgaagcatttgatctgaggacaaaaaaagaaaatacttcagactgtgagagagtgctgacaaggaaagtgtcgacgacactatatgcaaaaagtatggcattagcaacgagaagtgggcctaattttgtcaaactcgcaaagaccctttgtgggaggatgtacgaaaaaaggcataggcaatccagaagcaaaacactacccctcacgtgttgtctcgtggggaaaagaaagaaaaaactggaggaagttgctcaatccagaagcactaacactatgattgatcctccatctcccatcagacgacacatgaaatggaagatgacctgcaccaagaaaactgggcaaatgatgtctcaggcagcaaaggaaattgctaacaagattgaccagacctcacagggttcctttgtcacccatggacgtcaagatgtactaactgctgtcattgggcaaccagaacaccctggtcatgtgcgtgctgctaga

SEQ ID NO: 54787 - DNA, 180 bp, Glycine max
  Peptide Sequence Number=SeqID_146472
atgaagaccgacatggaggccatgaaagagcaaatgaccacaatgatggaagccatgatgagtatgaggaaaatgatggaggttaacacaactatagtcattgccgcaagtaccgccactgaggtggacccgacttacccatttggtctcaatcaagtaaatcgtctagtctcggatatg

SEQ ID NO: 54788 - DNA, 393 bp, Glycine max
  Peptide Sequence Number=SeqID_146473
atggtgagggtactagtcataaggaccctctatctagaatcttatatgagtttaagttccctcaatttatggaaagaaaaactagaaagaagagaaaaaggaaaagagagggtagaaataaatcaagatgagagggaacaaataagggaagaagaaagaagaaaaatactaaaagaattaagaaaagaaaaacatgattcctataatagtcatgacccttgcaagagcctaagtaaagaactttgtgactattgtgaaggaaggcataggtcacatcttagacctcactcctatacgagagaaaaggaaagaaagcctcaagaggctaacaataacctcccatacttccatgggaaggacaatgtagagggttacttggattgggaaataagg

SEQ ID NO: 54789 - DNA, 597 bp, Glycine max
  Peptide Sequence Number=SeqID_146474
agaagagtagattgggaccaacatttggccgggataggaggcagaacaatcaactggtttcctcgatggaaggaaggaaaggagggagttctcttcccatgtggggactacccaaacatcctattgataggaacgaggggttgcattaactacaatcccgcgcttgctataagacaattaaggtactccatgaggggagcaccaacggaagaaagcctctctcctttccttgtgagcaatttcggtacgcaaagtttcaagattatacaaagagtccataaggcgtgggaaagcccgttaaggaaagataaagaacttagggccattcgtaatggcatcatcgatggttatcatgaatggctgaaaattcgtacacgagggttagattggctctccaagttaaagattatcaacgaagagaacttcgaagctccagaagaggatgaagaagtccgagctctacaaaccgaactagggaaagcgagacttgccaaagaaagattcaagttggtcgctacagacgtccggaaagagtgtgccggcaacggtgagctcaagcctcgaaagggaagagagagaccaatcatgagcacatag

SEQ ID NO: 54790 - DNA, 249 bp, Glycine max
  Peptide Sequence Number=SeqID_146475
atggcgatgggatctttttcacaagcacgaggagccttgggcaaaattgctagattccaactcagcaacaagttcagcctcatagggaagataaatggatatggaagcatgaccacagtggacattactcatcataaagcgggttatgtccattccgtggacttaaagatgaggaggcagagcacttattttttaactgcacctgtaccttacccctgtggtgggagtctatatcttgggctaatttaa

SEQ ID NO: 54791 - DNA, 276 bp, Glycine max
  Peptide Sequence Number=SeqID_146476
atggtggggtatgcaccttcaagctttgcggatttggtcttcgccggggaaaggatcgaagcgggtctgaaaagagacaaatttgatcatcctgctttgatgaatgagaaaattggggcaaatgaagaggatgagaatgaggaaggaacccatgttgtggctgccattcctacatggccaaacttcccaccagcccaacaatgtcatcgctcagccaatattggtctttctcattacccatctcccaatcatccacaaaagccatccccaaattag

SEQ ID NO: 54792 - DNA, 637 bp, Glycine max
  Peptide Sequence Number=SeqID_146477
atggccccaaggaagcttgcctcaaagagatccaggaaagacaaagcggttgaaggaaccagttccactcccgaatatgacagccatcgtttcaggagcgctgagcaccagcaacgcttcgaggccatccaaggatggtcattcctccaggagagacgcgtccaactcagggacgacgagtataccgacttccaggaagagatagctcgccggcggtggccattgctggttacccccatggccaagttcgacccagacatagtcctcgagttttatgccaaagcttggcctacagaggagggtgtgcgagatatgcgatcttgggtgaggggtcagtggatccctttcgatgcggatgccttcagccagttcctgggataccctttagtgcttgaggagggccaggagtgcgagtatggccagaggaggaaccaggccgatgggtttgatgaggaggccatcgctcagttgctatgtataccggggaaggattttgcctggactgctgttgggagacgggtgcggatcatgtgcaccaacatgaccaccctgacccagatatggatgacattgctgctcagcaacatccagcccagcgatcataattccgaccttccccctgccgaagtgtcagctg

SEQ ID NO: 54793 - DNA, 186 bp, Glycine max
  Peptide Sequence Number=SeqID_146478
atggagacatctctattcttcgctaagttgtatggggcttgtggcacaacctttcatgatcatcaccaatggaaaagccacaaaattagtgcaagtgaaaggaagaacagaagtaaaaagaagatgaagaatgaagaacaattgagagaaaaagagagaaaagagaaaaacttgcacaacaagtaa

SEQ ID NO: 54794 - DNA, 270 bp, Glycine max
  Peptide Sequence Number=SeqID_146479
atggctagcacaataatgaatattaacaaaaaagcagaggaaatgtcatttgttgaaagatggaaggatgaactagagcctacttggcatctgctacactctagtggcaacatgcactttgtcacatataaccaagatctggtgagcccaactctacttgcgagatggacagaacttcaagagttctataggctcactggaaatcatcaggtgaccttgacccactatggacaatgttttcctcttcaccatcttcaaaagcacctttga

SEQ ID NO: 54795 - DNA, 186 bp, Glycine max
  Peptide Sequence Number=SeqID_146480
atgaaaggaaaccaacaaagggaggagtcgccaactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaactttttaggtga

SEQ ID NO: 54796 - DNA, 98 bp, Glycine max
  Peptide Sequence Number=SeqID_146481
atgaaagaagcagttgattattgcaaaaagaatttttccaaggacaagaaacagttgaaggatttttcagttgatggattaagtcaaatgactcctat

SEQ ID NO: 54797 - DNA, 162 bp, Glycine max
  Peptide Sequence Number=SeqID_146482
atgaatttaagaaggttcagagcccaagaaatcaagcaagattcttcacaaggtgtaatcgattataatatattggtaatcgattacaaaaacagttatcctgaacgtaaattcaaattcaagtgtgaagagtctacactttccataaaatgcattgtgtaa

SEQ ID NO: 54798 - DNA, 171 bp, Glycine max
  Peptide Sequence Number=SeqID_146483
cgagcatccgctaagtgcaacactcagtggctaagcacgaggaagaatccagaagaagatgagttgtacaggttcgctgagtgcactgctccaggtcatcaagcgcaccgcttcagctcatccgctaagcgaaagaagcgcgctaagccaagaatcactaacatgcgctaa

SEQ ID NO: 54799 - DNA, 282 bp, Glycine max
  Peptide Sequence Number=SeqID_146484
atggctgaggatgttgctgacatgattgaggatgtccctgatctggctgaggaggcacctgagatgactacggacgtacagggtactgagggtgctgaggggtcaaatgttgatgatgctgagggattccctggtgggccacgtgacccgtcagtgctgacatcatttgcggaccatgttgcacacgctgtttggagtggacaagaacgtcctgatttgaagttggtgtcacatgggaggaaggtgacattgattgggaggtcagcgcctgagattgaatga

SEQ ID NO: 54800 - DNA, 675 bp, Glycine max
  Peptide Sequence Number=SeqID_146485
atggatggtaatataactttaatattgcaacatggaggaagattcactccacgtgccagcgatggaaaggttgaatatataggcggagaatttgatgtttgggaggatatatctgcaaattacatgaacacatttatcctatatgatctggtgaaaagcatgagttgtacaatagatggagatatattatacttagtgaaggatgctttggaaaatgagaatgagataaacgtttactttcatcatgaagtagatccaattccaaaagaagtcccacagatgttgtacttgaaatgtcatccaattccaaaagttgttgagaatgaggatgatttagatgatgtacctgttgatggccatgaggaagatgttggtggtggagagaaaggtattaatgtggacgttggtggtggtgaggagaaagatgttggtggtggtgaggaggaaaatgttggtaatcctaacgatgaagatgacaatgataaggatgagtgtgatgatgaagatgaggatgttgacaaagtttattctcaatataatgaaagtagtcaagttggtggagaaaagttggaattagggatggagtttggtactctgactgaatttaaatcttccttgagagagtatagcatattcatggacagggagttcaagtggaagaagaatgataaatag

SEQ ID NO: 54801 - DNA, 489 bp, Glycine max
  Peptide Sequence Number=SeqID_146486
atggcttccaactcccaacaattcagtgcaagaaatgatgctattgtccttagaggagtccatgaggtggccacagattcatcttcatctgctgaaaataaaaagcttgagggaaaacttgatgccttggtcaacctagtaactcagcttgccatgaatcagaaatctgcacctgttgcaagagtctgtggttggaggaatcatccaaatctgagatggacaagtcctccacaacaacaacagcctgtccctcctttccagaatgctgctggtccaagcaagccatatgttcctcctccaatgcagcaacaacaccagcagtcacaacaaagacaacaagcaactgaggctcctcctcaaccttacttagaagagttagtgaggcaaatgacaatccagaatatgcaatttcagcaagagacaagagcctccattcagagtctgacaaatcagatggggcaaatggctactcagttgaaccaaacttag

SEQ ID NO: 54802 - DNA, 261 bp, Glycine max
  Peptide Sequence Number=SeqID_146487
atggtcatctgcaccctttccgaagatgtagacatcttctggtggagactttttcaagtctcacaagttatccagaactacgtaggtcatgtgacgtgcacccttgtatcatccagaggcggcgggcccgatgatacgcggagataccttacggttatccgcacccttttgtcatccagaggcggcgggctcgatgacaagcagagaccaagtttggtcattctgcatccttgtatcatccagaggcggcgggcccgatga

SEQ ID NO: 54803 - DNA, 290 bp, Glycine max
  Peptide Sequence Number=SeqID_146488
atgcagatcctataggtttcggttaccctctctggtcacctttcattcgatatgccctagacccaggaaagagagatatctctctttggtcaatgagggattcttaccctctttgccaatcccaggtcgaagaaaagagggtatacggaatccctagctttggctctcccgggagactagcccagtccaccgattcaggtgctggtaaacgtcggatatttgccattggcaactacgtcaaccaacggttgctaaagcctcttcatgattggttaatgaaagctttataa

SEQ ID NO: 54804 - DNA, 698 bp, Glycine max
  Peptide Sequence Number=SeqID_146489
atggcctggcgcgccggctgccgggtcgccaacctggagttcaaccagttccacccgacctgcctgttccatccgcaggcgcgcaacttcctgctgaccgaagcgctgcgcggcgaaggggcttacctgaagcgcccggacggcagccgctttatgccggatttcgacccgcgcggcgaactggccccgcgcgatatcgtcgcccgcgccatcgaccatgaaatgaagcgcctgggcgccgactgcatgtacctggacatcagccacaagccggcggagttcatcacccagcacttcccgatgatccacgagaagctgctgacgctgggcttcgatctgacccggcagccgatcccgatcgtcccggcggctcactacacctgcggcggcgtgatggtcgatcagcacggccgcaccgatctcgacgggctgtacgccatcggcgaggtcagctataccggcctgcacggcgccaaccgcatggcgtcgaattcgctgctggagtgcctagtgtacggttggtcggcggcggaagacattctgcagcgcctaccgttcattcagcaggccaaacaggtgccacactgggatgaaagccgggtggacgatgcggacgaacgggtggtgattcagcacaactggcacgagctgcggctgttcatgtgggattacgtcggcatcgtgcgcaccaccaagcg

SEQ ID NO: 54805 - DNA, 318 bp, Glycine max
  Peptide Sequence Number=SeqID_146490
atgacccctactcatgatgccctgctatattacaatgggaggtggaacatgccacaccaaaatgagtttgttggttactcgttcataggaaaaaatcccaaaaagtttgacattccttccaaatgtaccatggatgaactgaaggatttgatcaagcaagttgtgcttcatgggattcccccttatggtattcatgaaacacaaacggtgttagtgcagtctaactactggaaaaaatttgggccaatagaaattttggctgtttttagtaaacatgtaatggaaatggaagacgacgtgtccttgtcgcaaaattag

SEQ ID NO: 54806 - DNA, 300 bp, Glycine max
  Peptide Sequence Number=SeqID_146491
atgcacaaaaaaagatcttctgttggtgagttgattcccattgatttggagattaacgccacttgtagaaggcgtaatcaggagagaattagaaattttttgcaggacttagaggcagcagcaattccagaggaagaacctcaatcttctgaggcatcttctagttttcctattgcagaacattctcatttagatcctagtgaagactacatcatggctgaagagccaagaagagttactctggaagattattcaagttctaatctgccacaatttttcaccagcattgcacaaccataa

SEQ ID NO: 54807 - DNA, 267 bp, Glycine max
  Peptide Sequence Number=SeqID_146492
atgtttgtatttgtgggaggaggttatatgcctttttgttttaagagtaatgtcccactggaatggccccgaggaagcttgcctcaaagaggtccaggaaggacaaggcggccgaaggaactagttccgctccggagtacgacagtcaccgctttaggagcgctgtacaccagcagcgcttcgaagccatcaagggatggtcgtttctccgggagcgacgcgtccagctcagggacgacgagtatactgattttcaggaggaaatag

SEQ ID NO: 54808 - DNA, 213 bp, Glycine max
  Peptide Sequence Number=SeqID_146493
atgggaaatgtgagatttcttgaggaagttgagtttgggaaggaagagaacataaagaatgttgtctttgaggaagaacctgttatttatagtgatcaagtcctcatacctattactgttcaagacacaactccagtaatagaagacaatgttcaaactattgacattgttccggaacaagacaacatgaggatccccctcaaatacctttag

SEQ ID NO: 54809 - DNA, 528 bp, Glycine max
  Peptide Sequence Number=SeqID_146494
atgtcgcgggggtcaggagaccttggggacgtcaggtggggtgctattgcccaaaaccaagcttgggtggttgatagggcactgataatcgattaccagttgggtgtaatcgattacacagtgttacctgctactggtaatcgattaccatttatgtgtaatcgattacacaatatcgcgatggcagcgcagttgatccatgatcgcgttgtgacggagtgcctaaagggtgtttgggagaccctcgaaggcaatgagaggtgccgattccgtggcacaattcgacttactgctacttcattaccggttcaagtgatagaggtgtcatcctctgaagaagatcttgaagaggaccaagaggagttacctcctgaacctgttgtggatgcccttgacttcccggaggatgatgaggacccactccctgatgttgattctccagaggatattatgtcagcatctgaggcagactctacagaggagagtggtcctggagggacagcgaatagtgatgactcttcatcatag

SEQ ID NO: 54810 - DNA, 150 bp, Glycine max
  Peptide Sequence Number=SeqID_146495
atgtgcacatgtgcaacttttggtaccccaaaatgcttggagtatacatcaatcactacgcatagctccaaactcgaaggtggaggacacatgaacgaaaacgcaattcatggggctccgaaaaaggttgagaatagagaattgcactaa

SEQ ID NO: 54811 - DNA, 464 bp, Glycine max
  Peptide Sequence Number=SeqID_146496
gactctgccagtcgttcggagtccccgtcgtacctagcaaggtgattcggccgcccatcacccgagcttttattgagaagtattgcacgcagagacaagcccagggtgatgctccgcaggccgcagacgcgccgccacctcatcaggttggcccagctggatcatttgatacggagcagtatttacggcatttggttcgccagcaggcggccaaccaccgggcgcatgtacagacccatgattgtctttaccagttgagtctcagcctgcaaagcaagggttttacttcttttccatgccctactccggatcagtttagggcagaggtcgcatggcccggagattggcctgaggcccgggcaggagaggcaccagcagaggctcccgacgaggcagatgaggcccgcgaggacgaggagatgaccgatttgcttgatttcttgggagggagcggagccacatga

SEQ ID NO: 54812 - DNA, 456 bp, Glycine max
  Peptide Sequence Number=SeqID_146497
atgccaagtctctatgaccgaaccacaaatctggaagagactctagctcaattcatgcaagtgtcaatgtctaaccaaaagagcactgagtctgcaattaagaatctagaagtccaggtgggccagcttgcaaagcaattagctgaaaaatcatcaaacagctttacaacaaacacagagaaaaatcctaaagaagagtgcaaagctgtgatgactagaagtaaaatggcagttcaagcggaggacagtaaagctgataagaaggtggagggatttaaacaaccgctagttgatgaattggcactggaactggttgatgatttagttgaacttgaagaaattgttgaggaagtagaaggggatgaagaaggagagaccccaataagagattgtcaagagaaaatgaagaagaaggaagaaaaagaaaaaagaagaagaaacagtgggatcctctag

SEQ ID NO: 54813 - DNA, 150 bp, Glycine max
  Peptide Sequence Number=SeqID_146498
tttagggcagaggtcgcatggcccggagattggcctgaggcccaggcaagggaggcgcccgcagaggctcccggggatgcagatgaggcccgcatggacgaggagatgacagatctgctcgattttttaggaggtagcggaaccacatga

SEQ ID NO: 54814 - DNA, 396 bp, Glycine max
  Peptide Sequence Number=SeqID_146499
atggaggaatcccatcgggaaaataacaaatataacatttcccagtcaagagggtccgctcttgacggtgaagaacacattggagaatggaggaatccaatcgggaaaataacaaagatcagcatttcccagtcaagaggtttcgtccctcttgacggtgaagaacacattggagaatggaggaatccaatcgggaaaataacaaagtataacatttcccagtacaagaggggtccgctcttgatggtgaagaacaccttggagaatggaggaatcaatcgggaaaataacaaagatcacatttcccagtcagagggtgctgctcttgacggtgaagaacacattggagaatggaggaacccaatcgggaaaataacaaagatcacattttcctag

SEQ ID NO: 54815 - DNA, 325 bp, Glycine max
  Peptide Sequence Number=SeqID_146500
atgacagaaaccgtttgtacggaaagccgcttgggtatctctgtacgtcacctgacttcacgggtcaggatgacagaaagtgcggaagacgatggtgcagaagacgacgttagtctctacatgctactggactctgagtctgacagacagcgaaagagtgtttatacggataaccaattgggtatctccgcctgccacctaacttcacggatgaccacattggcctctgcttgtcaatcgaacttggggtctccgaatgacgaggtgcggataaccgaaaggtgtctccgcatgctaccagactcttgggtcatgatagcaaaag

SEQ ID NO: 54816 - DNA, 426 bp, Glycine max
  Peptide Sequence Number=SeqID_146501
atgcgtctaccagggaaggagagtctgctgatgaaatctcccataaccataaatgagattttggatgttagcattttgtttctaaatgaccatttagaggaaacactgggttcgacaaaaatagaagaaatccactcaaagtgtatcaatcttgcacagggtaaggattacggtgagtcaggattttggctcaaggtttgtagaatggctagacatgatacatgtcggggtttggtttggctcaaggtttgtagaatggctagacatgatacatgtcggggtttggtttggctcaaggataaaagggatgccccacattatttccatgacacaaatgcaaaaatgatgatttggaaactttatgcaaaactggtcatgcatgcatctacgcggacactcaaatgtcaactttttatggtcatgtga

SEQ ID NO: 54817 - DNA, 237 bp, Glycine max
  Peptide Sequence Number=SeqID_146502
acttatcaaggtaatccttgtggcgtctaccctgacttatcttccttcaccggaagtggcgtctaccctgacttatcttccttcattggaagtggcgtctacccggacttatcttccttcaccggaagtggcgtctaccccgacttatcttccttcactggaagtggcgtcatccaaatatccgtagcctgtatcaagcgatccacgcccagtaagattcacatcaatgttggttga

SEQ ID NO: 54818 - DNA, 198 bp, Glycine max
  Peptide Sequence Number=SeqID_146503
atgggccatatagcaaagatatgttggtgggtgtccaagaaaccaactcaatctgatgatatacctcaagcacttgcagcccttaccttagacaacacaattgctgaaacaaaatggacctctgacaccggggcctctaatcacatgacaggaacgagaaacagggaaaccgattatcaccgggaggcacaagggtga

SEQ ID NO: 54819 - DNA, 249 bp, Glycine max
  Peptide Sequence Number=SeqID_146504
atggggaaccagccaagaccaaactttaatgcagaccagggtgggccacctaacaggccacaacaacaagggcctagtctctatgacagaacgatgaagttggaagagactcttgctcagttcatgaaagtatccatgtccaatcaaaagagcatagggtcaaccatcaagaatctagaagtccaagtgggacaattggcaaaacaattggcagaccgaccattaagcagctttggagccaacacatag

SEQ ID NO: 54820 - DNA, 175 bp, Glycine max
  Peptide Sequence Number=SeqID_146505
actccaagaagtttgggccagagatgcaagagaagaccctaaggttctcatgagccttaaggtagattttgagcccatgggcaaagtgtcataccctaatttcgtccggggacctttgcttgatgacatgcgaccattctttggtcctcgtgaggtgcttggcacccatcattag

SEQ ID NO: 54821 - DNA, 399 bp, Glycine max
  Peptide Sequence Number=SeqID_146506
atgttgcagggatcacgcccgcaggacacccaatggaccaaagaagtccaacagggtccgggatttccagctctgattacgggcctctgtcagttctatggagtgcccgtcatccctagcaaggtcatcaggcctcctgctaaccgagtttcatcaagaagtattgcacccccagacaggcagagggcgagacaccataacagcctgggggatggccggcaacaggcaacaaatgcaccgccgccacctccagagcccctcagctcatccacaaaaagtaggacacacctagttgctcatgatcctaggaatttaaataaaacaagcacaagctcggaaggtagtgaaaataccttagatatgcatgtagaaagataccttggatatgcatgtatgtaa

SEQ ID NO: 54822 - DNA, 681 bp, Glycine max
  Peptide Sequence Number=SeqID_146507
atgaacttaatcattgttatcaaaaggaaagaacacgctttacaacgcccttaccgaacccgtgctagagctagagtaatgggtgaagaagaggaggtgcaagagcaaatgaaggccgacacggaggccttgaaagagaaaatggccacaatgatggaggccatgatgagcataaaggagataatggaggtcagtgcgactgcaatagcggctaccagcaccattgttgaggtggacctgaccccccccccccccatatggcctcaaccaaataaatcatccaacctcatatatggtaggtctagaaggcaaagagttgggaggtatgggcgaccctcatttagtgcgaaaaacaagcatgccttcccaccatatggcttgcctcccaactatacaccacccaatgtgacatccactcccagtgaggatgtcaataactccgctcccatactcattgaaaggcaacaacctcaatctgatcatgcatatgtctctcaacccatgggggagacacatgaaatgccccgccacaatctagccgacttcgagccttgccacggatatgccactaaagggcaagcagttggtggtatacccctgcaaaacactttggaggcccctcagtatcacccacaaccacaccccttgcatttcacagcgagtaaaaactctcatgctatg

SEQ ID NO: 54823 - DNA, 567 bp, Glycine max
  Peptide Sequence Number=SeqID_146508
atgcaatttcgagcgtctcgatatattacgggactcaatcagacatccgagtataaagttattcgttgtttgaattggcttagagcttcaacattcaatttcgagcgtctcgatatattacgggactcaatcagacatccgagtaaaaagttattgtcgtttgaattggctcagagcttcaacattcaatttcgagcgtctcaatatgttacgggactcaatcagacatccgaagattccacattcaatttcgagcgtctcgatatattacgggactcaatcagatatccgagtaaaaagttatggtcgttgaattggctcagagattccacattcaatttcgagcgtctcgatatattacgggactcaatcagatatccgagtaaaaagttatggtcgttgaattggctcagagattccacattcaatttggagcgtctcgatatattacgggactcaatcagacatccgagtataacgttattgttgtttgaattggctgagagcttcaacattcaatttcgagcgtctcgatatattgcgggactcaatcaaacatccgagtaa

SEQ ID NO: 54824 - DNA, 507 bp, Glycine max
  Peptide Sequence Number=SeqID_146509
atggcttccaactcccagcagtttagcgccagaaatgatgccatagtcattaaaggagtgcatgaggtagctataaactcatctgcatcatctgaaactaagaagcttgaaggcaaactagatgcattggttaacttggtaacccaactggccttgaatcagaaatctgtaccagtcgcaagagtctgtggtttatgctcctctgctgaccaccatacagacctctgcccttccatgcagcaacctggaataattgagcagcctgaagcttatgttgcaaacatttacaatagacctcctcaacctcagcagcaaaatcaaccacagaatcaccctaatctcagatggtctagccctcaacaacaacaacagcagcctgctccttccttccaaaatgctgctggcccaagcagaccatacattcctccaccaatccaacaacaacaacagccccagaaacaacaacagttgatgctcctccgcaaccttccctcgaagaacttgtga

SEQ ID NO: 54825 - DNA, 549 bp, Glycine max
  Peptide Sequence Number=SeqID_146510
atggttatgggggatttcatcaacatactctccttccccgaaaacaccgagaccttttcaagtctcacaagttatccagaactacgtgggtctgagttcctcattggaggatacgtaggagcaagagcctcgcttttgtcgacctgcaccctttttgtcatccagaggcggcggagcccgatgacatgcggagacaaaatcttaggtcatatccgcacccctttgccatttaacacagccgtgcccaagtggcgcgcagagacaaaaatgtggtcattctgcaccctttgtcatccagaggcggcgggcccgatgacatgcggagataaaatttgtcattctgcaccccttttccatttagacacagccgtgtccgatggcgcgcagagacaaaaattggtcattctgcaccctttgtctcgaggcggcgggcccgatgacatgcagagacaaaatttgtcattccgcacccctttgccattcagacacagcagtgtccgatggcgcgcagagacaaaaattggtcattctgcaccctttgtcatctag

SEQ ID NO: 54826 - DNA, 231 bp, Glycine max
  Peptide Sequence Number=SeqID_146511
atgtctctttttcaagggtttttcaaagtaagtgtaaaaacatcgaataatgcaagcaaaggcgactcgtggcgatcatcggtggtcaatggtggtggaggaggaggttggggtgttgggggaggatttaggggaagagaaggaggaataaatggctcttttacgctactagacgtatttgtagcctacaacactcgcccaggcaaaatttggctcgcttgggcgagctga

SEQ ID NO: 54827 - DNA, 306 bp, Glycine max
  Peptide Sequence Number=SeqID_146512
atgaattcattgccgagcgctattcatgtgtcctccgccatcgagtctggagccccgcgaattcattgcctagcgttgttcgccaattctctattctccaatcttattcggagacccatgaattcattgcccagcgctgttcatgtgtcctccaccatcgagtctggagccccgcgaattcattgcctagcgttgttcgcaaattctctattctccaatcttattcggagacccatgaattcattgcctagcgctgtacatttgtctccaccaacgagtctggagccccgcgaattcattgcctag

SEQ ID NO: 54828 - DNA, 441 bp, Glycine max
  misc_feature (21)..(21): n is a, c, g, or t
  Peptide Sequence Number=SeqID_146513
atgtctcctttccttgtgagngatctcggcgcacaaagttccaagactatacaaagaatccataaggcatgggaaaccccgttaaggaaagatcaagagcttagaggcattcgtaatggcatcattggtgggtaccacgaatggatgaaagttcatatacgaggtttagattggctcgccaagttaaaagtcgtcagcaaagagagttttgaagcaccggaagaggacgaagaagtccaaactctcaaaagcgagttaggaaaggcaaaacttgccaaggagaagttcaagttggccgctacacacgtccggaagaagaatgccgaactaagggatgtaaatgtagctaccaccaaggcattggaacaaaagaccaagagggctcgtagggaagaacacgaccaaagcaaagttttgaggggctttatagggcagcaatag

SEQ ID NO: 54829 - DNA, 570 bp, Glycine max
  Peptide Sequence Number=SeqID_146514
atggatcgattattcacaatgatattggggtttacttccaaacttcaactccggtgcccattcgagtaccaaacagctgtgattttgcaagctaaaaaatcagaatacacaataccctccagctatccgacaaacaatttttggatgaaatttactaccggaagccattcacccatacagttattatgcaccgttggaagaacaccagatggaataataaacttacttcaacgcactatgccccgtactcatgatgcgatcctgtattacaatagaaaatggaacatgccaccgcagaacaaattttttggatgcgtgttcacaggaaaaaatcctaagaaatttcaaattccttcagcatgtaccatcgatgaactgaaggatttaataaagcaagttgcacctaaagggattccccctcttgcaattcacgaatcacaaacggtaagacaattgttttttcgccaatcaggtcgctttgagtattcagatacgcttataaaatatgaaattaatgagctgaagaccaacgaagaactgttgaaggtgttagtacaatctaactactag

SEQ ID NO: 54830 - DNA, 114 bp, Glycine max
  Peptide Sequence Number=SeqID_146515
ctatcaagaactacgtaggtctgagttcctcatcgcaattgaggatacgtaggagcaagagccttgcttttgtcggccaccccacaatctctgtcatactgaccctgaagtcag

SEQ ID NO: 54831 - DNA, 657 bp, Glycine max
  Peptide Sequence Number=SeqID_146516
atgattgcacatgaaggaaaggctagggctgcagttgaagagttgaaaaagtttctggtagctgactcattggaagaaatgaatagaaaactgaataaattttacatggtcctcatcctgaggagtccacactctgactttgatcatgtgcgtgatcaagttcttgctggagatcaagttccatcaatggactctctcatcactaggttacttcgtgtgcctcatgcgctgaaagaagaaaatccagctgatgtggtggaaactttagcaatggttgcatctcgtggaagagggggaggccataatagtagaggaggccgcagtggaaaatgcggacgtcctcaatgcacatattgcaagaggatgagtcacactcaagagaattgctattccctgcatggatttcctgaaaaagttgccaagggagctcagacagaaaaatcagagtctaagttctctgatgaagagtaccaagagtatttgaagctgaaatctgagaaatccagcagcccggcttcaccttcctccgtaccatgttattcaacagcatgtatttctcaatctattgacggttctagtccttggatacttgattcaggtgcctctgatcatatttctggaacatggcacaggtcgagtgattggagaaggacgtga

SEQ ID NO: 54832 - DNA, 273 bp, Glycine max
  Peptide Sequence Number=SeqID_146517
atgttacgggactcaatcagacatccgagtaaaaagttattgtcgtttgaattagctcagaagttcaacattcaatttcgagcgtctcgatatgttacgggactcaatcagacatccgaagcttcaacgttcaatttcgagcgtctcgataagttacgggactcagtcagacatccgagtaaaaagttattgtcgtttgaatttgcacagaggttcaacattcaatttcgagcgtctcgatatgttacggggctcaatcagaaattcgagtaa

SEQ ID NO: 54833 - DNA, 417 bp, Glycine max
  Peptide Sequence Number=SeqID_146518
atgtataggaaaagaggtcttcctgttacaggtgggatgagcaccggggggtttgcgaggctctgtttgatcttctcaaaggcctcttggcagtcgctgttccacaggaccgcctggttcttacgtaatagcttgaagatgggctcacatgtaggggtgagttgcgagataaatctcgcgaataagggacaccttagtgatcaagggcttccgatggaccctaagagaataaaggtcattcctgagtggtctactccaccatgtataagggaaatttggggcttcaatgacttaaaaaacttttacaaaagtgttgatgaaagaatccctgagtttcaagaacatatggatttgaggtcaaatccttttcaagggatagggaatgatgcaatcctaccccgcaagggcatcagatag

SEQ ID NO: 54834 - DNA, 1029 bp, Glycine max
  Peptide Sequence Number=SeqID_146519
atggaccggcggcaatggagtatctatctgacgccagagcaggtgaatgcagccgtatcgctgaatgtcggttatcagaacgcgatcgttgttgccccggaaagctcgaactttcaggtcagcgtgaacaatgtcgggcttggtgcagcgcgtatcgaggcgccggacagtcaggggaatatttcccttaaaattccgcccggtgtccttcaggtcggcgcgaatgtcgtgtcgctcggggtgcagcagcgccacagaacagattgcacgatccagtccacttacgatctatggaccgatgtcgatccggcaaataccttcataggctttaacgccgatgttgcgggcagtttcgccaacatcgacgacatccaggcgaccggaccggatggcaaggcgacgacgtcgatcgaaatcgtggcaccggcgctcggcaatccggcatttgcggattctctcctgcgtctttcgcaggcgctggcgctcagaacccagatgccgaaccagacggtccgttttgtgacggcccctcccgtcgaacggaaagcgggaacgctttcggtcctcgtcggcaccgctcgggaaatcgccggcatggccggaactttgccacctgaagcatcagcgggcgctttcgcaggcttcggcagcgccgtcgcgggcggagcgtcgccgcttctcgtcactggtccgaccccccaggcggtgcaagcggcgatagagacgctgttttcctcgatctcgcgaacaccgggcgctcagcgagccactttttcgacgcgcagctggcacgcacccgatgtgccactgatcatgtcggaccgtcggatcgcgctttcggaactcggtatcgaaagcagcgagttcagcggccggcgtttccgcaatgaattttacatcggcatgcccgccgatttttatgcgtcggcctatggcgaagcgtcgcttctcctggatgcggcctattcctcgcaggtgttgcccggcagccatgtcgacatctatgtcaatggccagatcgcctccacc

SEQ ID NO: 54835 - DNA, 274 bp, Glycine max
  Peptide Sequence Number=SeqID_146520
atggatggtacatccactaggttcaaagagaacaagggagggaataggtcatctcaagattatgatgaagaccaagcaaacttgtgtctcatgacaaaatctcatgaaagcaacaaagaagaatctgtaaggacgaagtggtacatagacagtggatgctccaagcacatgacgggagatgtatccaaattcacaaccatttcccccaagaaaagtggacacattacatatggcgacaacaacaaaggcaaaattattcgagtcggtaaaatag

SEQ ID NO: 54836 - DNA, 384 bp, Glycine max
  Peptide Sequence Number=SeqID_146521
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgcacatgactacaccaccgatctccctttctcctcctaa

SEQ ID NO: 54837 - DNA, 297 bp, Glycine max
  Peptide Sequence Number=SeqID_146522
atgaagtataaaggcaaagggaacataagggagtacattatggagatgtccaatctcgcatcaaaactcaagtcacttaagttagagcttggtgaagacctgctcgtcttctcaaagaagcttgttgagaaagcttctcaaagaaaccacgaggaagcttctggaggaagcctcttaatgaagcttctagagaaagctacatggagctgcctcgaggcttgtgtggaatcgacaagcaaggacaaaaaggaatcttcaagtgacgcgacgaggaatccgtggggtagctcactatag

SEQ ID NO: 54838 - DNA, 348 bp, Glycine max
  Peptide Sequence Number=SeqID_146523
atgtatgataatttaaatgacgcgtcgaagagcacagcgagacaacttgtagaatatatcactctattacagtgttggatctacgagcatttttcatttgttggttccgttgtacctgtcgaggattatgatgagaggagaccgcgtgcatgtcgatggacctctggcaaggcactgctcgtttccacgtatcacaagcgtctggatagactgactcctgacgtggtgtgctggatttcgtacgatgaccaccattcatttagagaatttgaagtcatctcattatttttcggccatctcagatggggccccttgacggtcatttaccgaccggagagggttgtatga

SEQ ID NO: 54839 - DNA, 482 bp, Glycine max
  Peptide Sequence Number=SeqID_146524
aggactgcacgtcctcctcttcaaagggctgcttgccctcgccttcgagaggactacgcgtcctcgccattagaggactacacatcctcacctttagagggctacacgtcctcaccttcagagggctacacgtcctcaccttcagaggactacatgtcctcaccttcagaggactacacatcctcaccttcagaggactacacgtcctcaccttcaaaggactacacgtcctcaccttcagaggactgcatgtcctcaccttcagaggactacacgtcctcgccgtcagaggactagacgtcctcgccgtcagaggactagacgtcctcgccttcaaaggactacacgtcctctactttagaggactacacgtcctcgccttcagagggctatgcgctctcgccttcagagggctatgcactctcgccttcagtgggctccatatccgcaccttaagagaatttaaggtcctctatccttaa

SEQ ID NO: 54840 - DNA, 360 bp, Glycine max
  Peptide Sequence Number=SeqID_146525
atgggtgaagtagaggagatacaagagaagatgaaggccgacatgcaggccattaaagagaaaatggccacaatgatggaggccatgatgagcgtgaagataatggaagccaatgcggttgcagttgccgctactagcgctgtcgctagggtgaacccgatgctcccatctggcctcaagcatatgaatcatccaacctcaaatatggcacatatctctcaaaccatgggggagacacttgaaattccccaccacaatctagccgacttcaagccttgcctcggatatgccactgaagggcaagcagttggtggcatacccctgcaaaacactttggagggccctcagtgtcacccataa

SEQ ID NO: 54841 - DNA, 479 bp, Glycine max
  Peptide Sequence Number=SeqID_146526
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccacttgtgaaaagacacgcagctgagattttcacctctgtcatcatctcaaccttattctcactgtactcaacagcctttgttggacgtcttgttcaattagaaccatctttaactgtgtccattctacccagatgtatcacagtggcattggccctcagcattgtatccttgtttgacggtaaatattatgctcacactgcaaccatttatccccataaatccataatcttgtctacgctggaacttggggtaccgagctcgaattcgtaa

SEQ ID NO: 54842 - DNA, 198 bp, Glycine max
  Peptide Sequence Number=SeqID_146527
atgggtttacatcagcaagtgagggtgagaggtcatttgattaagtttgatgaggacacacttaacacatttttgaagacccctgttgttgtggaagagggggaaactgatatgaatggcagcagaatggagaaggaagagagagaggagacgccacttcaaggagaagatgagtctagaagaagctcaccaccatag

SEQ ID NO: 54843 - DNA, 659 bp, Glycine max
  Peptide Sequence Number=SeqID_146528
atgggtcaacttcaacggcaagccttccgcaaagcctatggtaagatttgggacctagctagggacttccagctagtgccgactgtgaaagagtttgaagaaatcctgggatgcccactgggaggaaggaagccatatcttttctctgggttctatccctccacgataagagttgccaaggtggtgaaaatctcagcacaagagttggaccgtgcgaatgggctttcttttattgacattttggcgcttttgatctctggagttgtcctctttccgaatatggaagggttagtggacctagcagcggttgacgctttcctcgcctttcatcatggcaaggaaagcccgatcgtcgccattttggccatgtatgacacgttcgaccggggatgtgaaaagagcagcgcaagaattgtttgttgtgcactggctctctatgtgtggctggtttcacacctttttctccaagaaggtaggcccgtctatccactacaaggtcaccgctcgtgcgttgaaaaaggaaaggcgaattgggaccaactcttggctagcatggaggggcatctgttaattggttccctcgctagaaggaaggaagaatcaggattctatcttcatgcgaagtggatgtccgaatgttcccttgatgggaacaaggg

SEQ ID NO: 54844 - DNA, 231 bp, Glycine max
  Peptide Sequence Number=SeqID_146529
atggagcagcgtggccatggaatgtattacacgccattaacattttctcagtatccttcgcagatgtatcagtatcctttcgaaggtgttgatttgcgtcatgagttttctgctgaggctgagcaacaagggcggagacagcgcgcaagaagaaatcctgatcgtgaagcccgaaggtgggatcgaccatatggcacatcctcacgccatcacggacaccataatgactga

SEQ ID NO: 54845 - DNA, 561 bp, Glycine max
  Peptide Sequence Number=SeqID_146530
atgaatttacagcatcactttcttattgccatgcctgctctccaggatccgatttttcgccgcgccgtggtttatatttgtgaatacaatgaagacggcgcgatgggcattatcatcaataagccgctggaaaacctgcaggttgaagggattctggacaagctgaaaatcccggctgaagcacgactgcaggagatccggcttgataagccggtgatgctgggtggaccacttgcagaagatcgcggctttatcctgcataccccgccggtattctcttccagtatccgcatctccgataacaccgtgatcaccacctcgcgcgacgtgctcgaaacgctgggcaccgcagaacagccttccgaagtgctggtggcgctgggctattcgtcgtgggagaaaggccagcttgagcaggaaatcctcgataacgcctggcttaccgcaccagcggacatgaatattctgtttaaaaccccgatagccgatcgctggcgcgatgcggcaaaactgattggcattgatattctgaccatgcctggtgtcgcggggcacgcctga

SEQ ID NO: 54846 - DNA, 174 bp, Glycine max
  Peptide Sequence Number=SeqID_146531
atgggcccatcggtggctaccctaccaccaaagccttggaacaagaaaccaagggggctcgtaaggaagagcatggctagaacaagttccgaggggctctgtggggcagcaacagcgagcttaagctccgaagggaagagaaagaccaatcacgagcacatagcatggtcttga

SEQ ID NO: 54847 - DNA, 198 bp, Glycine max
  Peptide Sequence Number=SeqID_146532
atgggaagaacaaagcaattaagtctcaagctaatcagaaaggggaatggtaaaataccacctcaagctgatattaagaatgtggcaaagtgtttcttttgcaagaagaagggacacatgaagaagaattgccccgggttccagaaatggcttgagaaaaaaggatatgcaaaacctaaggaaaccagtgggaagtga

SEQ ID NO: 54848 - DNA, 285 bp, Glycine max
  Peptide Sequence Number=SeqID_146533
atgctttcccctcctccactattggctgcactctcccaaactagtcaagcacaatgtcctcaatctcctcaccacctctctttccagcctcaactatgtgcctcacttccttctcctcatgctgcagcctttgaatctctatttatagctgatctagccaaagtgatgcaatcctaccccgcaagggcattggatagaagactccaagtagattgggccagagatccaagggaaggccctagggttctcatgagccttagggtatattttgagcccatgggctaa

SEQ ID NO: 54849 - DNA, 402 bp, Glycine max
  Peptide Sequence Number=SeqID_146534
atggccgagaaaaatttcgaggagcattgtggggtagcaacaatgagctcaagctccgaagagaggaaagataccatggtcacggggcatggcatgatcttaaaagaagagttagctgcgtgtgcaagatccaagaggagtttggctcaacacttggaagccacagagcaaagcatgctagctatcatagggcaatacaaggaagagttgaaccagtctgtggcccatgaacaaaagctagtggaggattttgcacaagtgtacgccgaaaaagaagcaagaggaagggtgattgatgcattgcatcaagaagcgactatgtggatggataggttcgccttgaccttgaatggaagtcaagacctcccgcgtctattagccaaagcaaaagccatggacgaa

SEQ ID NO: 54850 - DNA, 1002 bp, Glycine max
  Peptide Sequence Number=SeqID_146535
atggctacctcatcaaaacaaactgcagctcctggttcacccgctgtaccatcatctccgcaccaggaacaaccagaattcaacatccaacccatacagataattcctggtcaagcttctgtccctgagaaactggttcccagaagacaacagggagtgaagattgctgaaaaccctagccttgcaacaagtcctagggaagtagacacggagatggacaagaaaatccgcagtatggtgagtagcattttgaaagaagcctctgtgcctgaagctgatgaagatgttccaacatcttccaccccgaatgtttctatgcctgatgttgagaaagatgttccaacatcttccggcccaaatgatgaagtactctcttcccccagcaaagagagatcaacagaggaagatgatcaagccgcagaggagacccctgcaccaagggcaccagaacctgctccaggtgacctcattgacttagaagaagtcgaatctgatgaagaacccattgccaacaggttggcacctggcattgcagaaaggttacaaagccgaaagggaaaaactcccatcaagaggtctggacgaatcaagactatggcccagaagaagagcactccagtcactcctgccacatccagaagaagcaaggttgctatcccctccaagaaaaggaaagaaatttcctcatccgagtctgatgatgatgtcgaactagatgtctcgacatctaagagggccaagaaatctggaagaaaggtgcctggaaatgttcctgatgcaccattggacaacatctctttccactccattggcaatgttgaaaagtggaaatatgtatatcaacgtagacttgccttggaaagagaactgggaagagctgccatggattgcaaggagatcgtggatctcatcaaggctgctggactgctgaagactgtcagcaagttgggagagtgctatgaaggcttagtccagggaattcattgtcaacattccctctga

SEQ ID NO: 54851 - DNA, 390 bp, Glycine max
  Peptide Sequence Number=SeqID_146536
atggctggtacattcttccttttgaaaaagcaaaatagtttagagattacgagtgggctacacgccctcacctttagagggctacacgccctcgccatcagaggactgcatgtcctcaccttcgtagggctacacgccctcacctttagaggactacacgtcctcgccaacagagggctgcacgccctcaccttgagaggactccacgtcctcgccaacagagggctgtacgccctcaccttgagaggactacacgccctcacctccagaggactacacatcctcgccttgagagggctgcacgccctcacctttagagggctacgtgtcctcattttcaatgtgctccacatccacaccttaagagaatttaaggtcctctatccttaa

SEQ ID NO: 54852 - DNA, 1188 bp, Glycine max
  misc_feature (1064)..(1064): n is a, c, g, or t
  Peptide Sequence Number=SeqID_146537
atggtagccacggcttaccaaacctcccatgaatgttcggaagaaaccattatagatatcttagtggcaggattttccggacaactaaaaggatggtgggataattatctcactaatgaagagaaatcaaaaatttacagcgcagttaagacggatctcaatggaaaagtcattactaatgacgatgataaagagattcctgacgctgtgaacacgttaatttttacaatagcccaacatttcattggagacccatccttgtggaaagacaggtccgcagaattattatcaaatcttaagtgtagaaccttagcagattttaggtggtatagagatactttcctaactagggtttacacaagagaagatagtcaacaacctttttggaaagaaaaattcctagccggtcttcccagatccttaggagacaaagtcagagataaaatccgtagtcaatctgccaatggagacattccatatgaaaacttaagctatggtcaattaatttcctatgtccaaaaggtagccttaaaaatctgccaggacgacaagattcagaggcaattagccaaagaaaaagctcaaacaaagaaggatttaggttccttctgtgaacaattaggcttaccagcctgtccaacacaaaagaaaaaacagacctctaggaaagaagcccaggatcataagccagccaatagaagaagattttcaaaacgaagatactctcaaaaaccctcaaccagccacattagcaaatattgtagactaaaaaagaagttaagaaaccttaacctagaacccgcaattgaagagcaaataaacaatttgctcatagaaacctcggaggaggaaacagaaacttcatcctccgtgctttccaatgaaaacctaaacctaatccaacaagatgaccatctatcatcaacagatgatgatgggcaaatcaatactctaacgagagaacaagatctcttgtttgaagcaatcaattccatacctgacccccaggaaaagaaggttttcctggaaaaactcaagaaaacattagaggtaaagcctagacnaaaggattttatcacgaacaacaaatttgatgtaagtaacatactcaagagattagaaaattcttcaaccaaaccaacgacaatccaagatctccaaacagagataaacaatctaaaaagagag

SEQ ID NO: 54853 - DNA, 917 bp, Glycine max
  Peptide Sequence Number=SeqID_146538
atggatgtcctggtgctcttgatcttcggagtggtcctctttccaaacgtagatgggttggtggacttggcagcaattgatgcttttctcgcctttcacgatcgcaaggaaagcccggttgtcgctatcttagccgatctatatgacacattcgaccgaagatgtgagaagaacagtgcaaggatcgcttgctgtacaccagccctctacgtatggttggtttcacaccttttctgccaagaggtgaaacacgtttgcccgctagaagatcaccgctcatgcaccgagaagaaggaggcaaattgggaccgactcttagcaagcaaagaaggagcgtttgtcagttggttcccccgatggaaagaaggaagaaccaaaattcttatttcgtgcggaggatttccaaatgttcccttgatggggacgaggggttgcattaattacaataccgtcctttccataagacaacttggctaccctatgaggggggtaccattagaggaaggcctcacaccttttattgcgcaaggtttcaatagcaccaacgtcggggtgcttcggagggtctgcaaggcatgggaaatggtgcaaaagaaagacgaagaactttggggaagtagcaatgggcccatcggtggttaccataagtggttgaaagcctacgcacaaggtctgggttggctcccgaatttgagagccactaaagaggtggaggttgaagctccggaagaaggcgaagaggtacaagccctcagaatgaagctcgagcaagcccaagcggtcaaggaaaagttcaagtcagcagtcgctaggatccgaaaggagaatgccgaactaagagacatcaacatagccaccaccaaggccttggtgcaaaagaccaagagggctcgcaagaaagaacatggccggaacaa

SEQ ID NO: 54854 - DNA, 312 bp, Glycine max
  Peptide Sequence Number=SeqID_146539
ggcaaagaaggcctccttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggtgtgggcgttagagcattga

SEQ ID NO: 54855 - DNA, 362 bp, Glycine max
  Peptide Sequence Number=SeqID_146540
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtttcttacaggggataatattgattgcaatctagtatttcatgctgtcgggaaacctgtcgtgccagctgcattaatgaatcggccaacgcgcggggagaggcggtttgcgtattgggcgctcttccgcttcctcgctcactga

SEQ ID NO: 54856 - DNA, 365 bp, Glycine max
  Peptide Sequence Number=SeqID_146541
aaaccgcgcagcggaagatcctgaatttgagactttctacaccgaaaatattctcttaaacgaagctttaactggtcgtgaccaggaaactaccggtttcgcttggtgggccgggaatgcccgacttatcaatttatccggcaaactactaggagcccatgtagcccatgctggattaatagtattctgggccggagcaatgaacctttttgaagtggctcatttcgtacccgagaagcccatgtatgaacaagtattgggctttggcggtatttatcatgcacttttgggacctgagactcttgaagaatcttttccattcttcggtgcgtttcttctagtattcaaggctctttattttggag

SEQ ID NO: 54857 - DNA, 195 bp, Glycine max
  Peptide Sequence Number=SeqID_146542
atggtttttcacttaaggcttgtagtgagcttcaaaacaaggaaagggaaacaaggctcaaaagggctatcaaaggaattaattcaaggacgcatcaacaagaatcaagccacccgctattgtgcaagcaatcaatgcccgcaaaacacaccaaatgattataatgatggatggctcaaattctcacaaaggtaa

SEQ ID NO: 54858 - DNA, 135 bp, Glycine max
  Peptide Sequence Number=SeqID_146543
gagggagagaccctgacggactcttcggagtgtaagcctttgggggagcagatgaataggtggatgattaggaagaacctcatgctagaggacacggaacacaacgctctgataggatgtgacattaggatataa

SEQ ID NO: 54859 - DNA, 1032 bp, Glycine max
  Peptide Sequence Number=SeqID_146544
atggccccgaggaaacttgcctcaaagagatccaggaaggataaggcggccgaaggaactagttccgctcctaagtatgacaatcaccgctttaggagcgctgtacaccagcagcgcttcgaggccatcaagggatggtcatttctccaggagcgacgcgtccagctcagggacgatgagtataccgatttccaggaagaaataggtcgtcggcggtgggcatcactggttacccccatggccaagttcgatccagaaatagtcctcgaattttatgccaatgcttggccaacagaggagggtgtgcgtgacatgaggtcctgggtgaggggtcagtggatcccgtttgatgcagatgctatcggccagctcttgggatatccgttagtgctggaagagggccaggagtgcgagtatggccagaggaggagccggtctgatgggttcgatgaggaggccatcgcccagttgctctgtataccggggcaagattttgcccggactgctgccgggagacgggtgcggatcatgcacaccaacatgaccaccctgactcagatatggatgactttgctgctcagcaacatcctgcccaccgatcataattccgacctccccctgccgaagtgtatggcgcctaccaggcaccctttggatccagataagtccaacagggccctgggatttcccgcactgatcacaggactctgccagtcgttcggagttcccgttgcacctaccaaggtgattcggccgcctatcacccgggcttttattgagaagtactgtacccagagacaggctcagggtgatgctccacaggccgcaggcgcgccaccaccacctcatcaggctggccaggctggggcatttgacatggagcagtatttacggcatttggttcgccagcaggcagccaaccaccgggcacatgtgcagactcatgattgtctgtaccagatgagcctcagcatgcagagccagggcttcgcatctttttcatgccctactccagaccagttcagggcagag

SEQ ID NO: 54860 - DNA, 372 bp, Glycine max
  Peptide Sequence Number=SeqID_146545
atgattatgaggggccaagacatttatagtagccaagttgaggctactacttcacctttctctagtgaaagtgaagaagcaaaagaggaagaatctaaaacttcccttcttaaacaacctccacatcttctcctttgtaaaaagaaacttgttagcattgccacacctcttgggcttgagattattcctcaagtaaaggagttgttggatgagtgtttggttcgtaagagcttaaatccttgcgctttgttggtgcccaaaataggtattgagggaagaagcctattgtttcaagaacctctggatttgagatcaaatccttttcaagggggagggaatgatgcaatcctaccccccaagggcattggataa

SEQ ID NO: 54861 - DNA, 295 bp, Glycine max
  Peptide Sequence Number=SeqID_146546
ggatcgcgcccataagacgcccagtggaccccgaagaagtccaacagggtcctggggtttccagctctggttacgggcctctgtagtcctacagggtgcccgttcccccggcaagggaccccgccccgcaagacacccagtggacccaaagaagtccaacaaggtcttaaagtttccaagctctaattacagcctctgtcagttctacggagtgcctgtcgcccccagcaaggttatcaggccccctactaatcgatctttcatcaagaagtattgcgtccccaggcaggcgtag

SEQ ID NO: 54862 - DNA, 574 bp, Glycine max
  Peptide Sequence Number=SeqID_146547
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccgaaggttgtacttatgtgatgcacaattttagagttagcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 54863 - DNA, 108 bp, Glycine max
  Peptide Sequence Number=SeqID_146548
atggcaactcgcccaggcgagcaggtgcttactcctgaagtaacaggcttgcccaagcgagttggttcctttaggctgaactggtgtcaaataatgcagtttggctag

SEQ ID NO: 54864 - DNA, 499 bp, Glycine max
  Peptide Sequence Number=SeqID_146549
gatccccctcgtcttttacgaccgcaaggaaagcccggttgtcgctatcttagccgatctatatgaaacattcgaccgaagatataagaagaacaatgcaaggatcgtttgctgtacactggctctctacgtatggttggtttcatacttcttccgccaagagatgagacacgtttgcccgctagaaggccaccgctcatgcaccgagaaaaaagaggcaaactgggatcgactcttagcaagcaaagaaggagcgtctgtcaattggttcccccgatggaaggaaggaagagtcgggattcttatttcatgcggggaatttcccaatgttcccttgctggggacgagggattgcatcaattacaaccccgtcctcaccataagacaacttggttaccctatgagaggggcaccatcagaggaaggcctcacaccttttattgcacgaggtttcaataacaccaacgcggaggtgcttcagagggtccacaaggcatga

SEQ ID NO: 54865 - DNA, 329 bp, Glycine max
  Peptide Sequence Number=SeqID_146550
atgaccgaccctctcgatgagtcgatctcttgctttctcgtaagggtgaacccttgggtactagtaccctcgccttcagagggccgcacgccctcgccttcagaggactacacgtcctcgccttcagaggacttcacgtcctcacctttagagggccgcacgccctcgccttcagagggccgcacgcccttgccttcagaggactacacgtcctcgccttcagaggacttcacgtcctcacctttagaggactacacgtcctcacctacagaggactacatgtcctcgccttcagagggccgcacgccctcgccttcagaggactacac

SEQ ID NO: 54866 - DNA, 360 bp, Glycine max
  Peptide Sequence Number=SeqID_146551
aatgtttatacggataaccactcgggtatttccgcccgtcagcgtgactcaaaagtcagtatgacagatcttgtgagcgtggaagatgacatagcaaaaaagaatgtttatacggataaccacttgggtatttccgcccgtcagcgtgactcaaaagtcagtatgacagatcttgtgagcgcggaagatgacggcgcagaagacgacgttagtctctgcgtgctatcaggcttttcgtcttacagacagcaaaaagttttgaaagtgcggacaaccacttggtctccaccggaagatgctgacatctccgaaaagggcgcagatgaccacattggcctctacccatcaaccacacttggg

SEQ ID NO: 54867 - DNA, 300 bp, Glycine max
  Peptide Sequence Number=SeqID_146552
atgtctcagaaaaacgatgatcttggactcattcatcgttggatcatcgtgaaatttaagcaccaagttcgcaacccaattccgagtattctcactgttgggaatttcaaatcatgtctgagctcagaggaaaacccttcgcattttagccttttattttcccacagaaacctaaaactgtcttgggagaaaaaggaatcgcatgaagatagtacaaatgaaggcttcaatcccttctcattctctctaacgtttgggaaccctatcagagcaaccagaggaatctcaagaacttattag

SEQ ID NO: 54868 - DNA, 954 bp, Glycine max
  Peptide Sequence Number=SeqID_146553
cgctcttgcgccgaagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggccgaagggcgtagtcgatggacaacaggtgaatattcctgtactaccctttgttggtcccgagggacggaggaggctagggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggtctccgcaaagtcgtaagaccatgtatggggctgacgcctgcccagtgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcg

SEQ ID NO: 54869 - DNA, 1074 bp, Glycine max
  Peptide Sequence Number=SeqID_146554
atgtcctcaccttcagaggactacacgtcctcaccttcggaagactacacgtcctcgactttagacggctacatgccctcaccttcagaggactacacgtcctcgccttcagagggctacatgccctcaccttcagaggactacacgtcctcgccttctaaggtctacatgccctcacctttaaaggaatacataggactacacgacctcgccttgaggactacacgtcctcaccttccgagggctacacaccctcaccttcagaggactacacgtcctcgccttgaggactacacatcctcaccttcagagggctacacgccctcgcctttagaggactacacgtcctcgccttcagagggctacatgccctcgccttcagaggactacatgtcctcgccttcagaggactacacgtcctcgccttttagaggactgaacatcctcaccttcagagggctacatgccctcgcctttagaggactacacgtcctcgcctttagagggttgcatgcacttgccttcagagtactacatgtcctcgccttcagaaggctgcacgccctcgcctttagaggacaacacgtcctcgccttgaaagggctgcacgccctcgccatgagagggctacacaccctcaccttcagagtactacacatcctcgccttcagagggctacacgccctcgccttcaaagaactgcacaagactacacgtcctccccttcagagggctacacgccctcgccttcaaaggactacacgtcctccccttcaaaggactacaagtcctcaccttcagaggatacacatcctcaccttcagagggctacacgccctccctttcaaaggactacacgtcctcgcctttagagggctacacgccctcgcgttcagagggctacacgccctcaccttcaaaaggttgcacgccctcgcctttagaggactacacgtcctcaccttcatagggctacacgccctcacctttagagggctacacgcccacgccttgagagggctacacttcctcgccttgagagggctgcacgccttcgtcttcagagggctacaa

SEQ ID NO: 54870 - DNA, 477 bp, Glycine max
  Peptide Sequence Number=SeqID_146555
atgccgatctccccctacggaagtatcagttggtctgtgacgtccgaacataggggtcatgcccacaagactcccagtggacccgaagaagtccaacagggcccaagggtctccagctttggttacgggcctctatcagtcctacagggtgcccgtactccccggcaagggatcgtgcccgcaggacacccagtggacccaaagaagtccaaaaggttcctggggcttccaactctaattacgggcctctgtcagttctttggagtgctcgtcacccccagcaaggtcatcaggcctcctactaaccaagctttcatcaagaaatattgcacttgcaggcaagcaaagggtgagacaccacaacagcctggggatggccagcaacaggcaaccaatgcaccgccgccacctccagagcccctcagctcatccacaaaagggttagagtattgcctacgaaacatggccgaccaatag

SEQ ID NO: 54871 - DNA, 348 bp, Glycine max
  Peptide Sequence Number=SeqID_146556
atggaccaattacgagtagacaatttgatcttaaaggatgaattgagtatttgcctaaggtccaagagaagcttgtctcagcggttatgccagaccgagaccaacatgttagccatcattagcaagtaccaagaagaattaaatctagccacggcccacgagcacaaagtggcggacgaatatgcccgagtgtacgcggaaaaggaggctagaggaagggagtcaagaacttccccgattgctggccaaggccaaagcaatggcggacgcctactctgcccccgaggagatccatggactcctcagctattgtcagcatatgatagactttatggcccatataattag

SEQ ID NO: 54872 - DNA, 462 bp, Glycine max
  Peptide Sequence Number=SeqID_146557
atgaaaaccttggtcattgcgttgggcggcaacgccctgttgcagcgcggagccgtgctctctgcggaaaatcagtataagagcatcgcccttatcgccgacgccatcggcaagctggcgcagaaataccgcatcgccatcgtgcacggcaacgggccgcaggtggggctgctggcgttgcagaacctggcgtaccgcgacgtgccgccctatccgctggatattctggtggccgaaagccagggcatgatcggctatatgctggcgcagcagttgagcgccagccatccgcagcggccggtgtccacgctgctgacgcgggtgctggtggatgcgcaggatgcggattatcaggcgccgagcaagttcatcgggccggtgtatgcgccggaacagcggcaggcgctggaggcaaaatacggctggacgctgaaggcggacggcaactacatccgccgggtg

SEQ ID NO: 54873 - DNA, 811 bp, Glycine max
  misc_feature (779)..(779): n is a, c, g, or t
  Peptide Sequence Number=SeqID_146558
atggaaggaaggaaaagaaggattccttttctcatgtggaagatacccatacattccgctgatcaagagcttagaggcattcgtaatggcatcattggtggctaccatgaatggctgaaagttcatatacgaggtttagattggctcgccaagttaaaagtcgtcagcgaagagagttttgaggcaccggaggaggacgaagaagtccaagctctcaaaagtgagttaggaaaggcgaaacttgccaaggagaagttcgagttggccgctacacacatccggaaggaatgtgccggattacgggaagagaatgcaactaccgcgagagcccttgaacaagagaccaagagggctcgcaaggaagagtatggccgtaacaaatttcgcggagctctgtggggtagcaacagtgaactcaagctgcgaagggaagagagggaccagtcgcgagcacatagcatggtcttgaaagaggagttagttgcctgttcaaggtccaaatggagcttgtctcagcgtttatgcgagacggagaccaacatgctagctatcatcgccaagtaccaagaagagttaggtctagccacggcccacgagcataggatcgcggacgagtatgctcaagtatacgcggaaaaagaggctagaggaagggtgatcgactctttacaccaagaggcaaccatgtggatggatcggtttgctcttactttgaacgggagtcaagaacttccccgcttgttagccaaggccaaggcgatggcggacacctactccgnccccgaagaaattcatgggcttctcagctatt

SEQ ID NO: 54874 - DNA, 807 bp, Glycine max
  Peptide Sequence Number=SeqID_146559
atgaactttccagtcctggacagactcggtaagctgattccgtgccgtgtaagagcccgaaacgtggtggaacagttttcagccgcattgcaatatggcgtacggcatggacagggaacgcccaatgctagtaatctaggggcacgtctaatggctgcgagggatggtggggtactcacagggaagcaattccgcgacaacctgaacgtgctttttgtcgccggacaggagaacccgcaactgctcctgatttcgatgctgtatttgcttgcgaagcatccggtaagcgtgtcatgtcctctgaagtcgatggagctaatgtcacaggatgtccaatcccggctgaggcgagaaatcgacgcgtgcagtacgctcgatccctcgaacgttgctttcagcgagcttccctatttgacatgcgtcatttacgagagcctccgcctcctgccgcctatatcgcaactgatcaatcgcaggacatcgcaagacgtcatcttaggaaatcagatctacatacctaagggcacatacgtcggatacaactgctactctaccaaccgtgaccctgcagtctggggaccgatagcggacgagttccggccggagcggtggggtcagaataacacggagatttcgcagtgctaccgccagaggagagcccgtgcggaattcgtttctttccatggtggcagccgagcctgcttaggggagaaattcgcgctcctcgaggcccgcgtggcgctctttgtcctggtcagcagactctcatggtcactggatccagaatggccagatcggaagactccg

SEQ ID NO: 54875 - DNA, 319 bp, Glycine max
  Peptide Sequence Number=SeqID_146560
atgagtcttcattcttcatctagtattaatggaaggcatagggcacatcttagacctcactctcataggagagaaaaggaaagaaagcctcaagaggctaatattcaccttccatacttccatgggaaggacaatgtagaggctaacctagattgggaaataagggtagagcaacaacttaaaaggaagtctacttcaaaatcttatggctctcactcttatccaaagaactaccaagggcaaggcatcttaggggtgacaccttctaagcccaaaaatgataatggaaagacaatagaaaaacaaccccttaaggata

SEQ ID NO: 54876 - DNA, 867 bp, Glycine max
  Peptide Sequence Number=SeqID_146561
atggtggaaccatcaaagaagcgcaaaggttcttcgagtagaagccaacggcattccgaggttcaagatactccaattccttcctccatttcctcctcttcattgttctcatcaaaagaacaacgtatacagtacacaaacctcttctcctctcgttctatcattgaccctaagttcatagatatggatttcttttctgatgagagtttcgaatgcattcaagcatttcaaaactcaaatctcattccctttatgtctctaaaattgtctgtgtattctgaattggtaaaagatttttattctaatcttgaaattcaagaaagtaccttgatttcagaagtttatgggataaagatggtcattgaccaatccctcttctatgatttgacccaattgtctagtgacggtgtaccatttgaaggtgcactggatgatgattggaagtttgatttttctatgcataatgcccgccagttggttggcaccaaccaagcggatatgaccagaaggcttcttgccggttcattggctctcaaaagtcgcatccttcactatcttattattcgtatcttactcccaagatcttcaaaccttgcacaggtttatgaagatcttattgtcatgtgggcctttcatatcggccgacaaattgattgggcacatttagtctggtatcgcatgcataaggcattgcgattaaatgctcctttaccatatccacatttagtcactcttttccttcaacactttaacatccctcttgattttgaaccttatgttccaatcaagagatctttcttggtcggtgctgttgtggttgcgtcctttggttactgcaaagagcgtgatgcttcttgggtaaaaaag

SEQ ID NO: 54877 - DNA, 129 bp, Glycine max
  Peptide Sequence Number=SeqID_146562
atggaatacttacttgttggtgatgaacaaaagcgcgaaacggaatcaaaaaatgcgaaaaatgatgaccctagtactgcaaactcaggtggctcgcccaggcgagctcagctcgcccaggcgagctaa

SEQ ID NO: 54878 - DNA, 840 bp, Glycine max
  Peptide Sequence Number=SeqID_146563
atgactacaattttgggtattcacttaatcttgttaggtataggtgcgtttcttctagtattcaaggctctttattttggaggtatatatgatacgtgggctccggggggcggagatgtaagaaaaataaccaatttgacccttagtccaagtattatatttggatatttattaaaatcaccttttgggggagaagggtggattgttagtgtggacgatttggaagatataattggggggcatgtatggttgggttccatttgtatacttggtggaatctggcatatcttaaccaaaccttttgcatgggctcggcgtgcacttgtatggtctggagaagcttacttatcttatagtttaggtgctttatctgtttttggttttattgcttgttgctttgtctggtttaataataccgcttatcctagtgagttttacgggcccactgggccagaagcttctcaagctcaagcatttacttttctagttagagaccaacgtcttggggctaatgtaggatctgctcaaggacctacaggtttagacttgagtagactgaaaaaagatatacagccttggcaagaacgccgttctgcggaatatatgactcatgctcctttaggttccttaaattccgtgggtggcgtagctacagagattaatgcagtcaattatgtttctcctagaagttggttagctacttctcattttgttctaggattcttcctatttgtaggccatttatggcacgcgggaagagctcgcgcagctgccgcaggatttgaaaaaggaattgatcgagattttgaaccagttctttccatgactcctcttaattga

SEQ ID NO: 54879 - DNA, 276 bp, Glycine max
  Peptide Sequence Number=SeqID_146564
atggtgaacgacattttcacaccatctaggtacaaagaaaccatcatggtgcagcctaaaccaagtgctggcctaaaggggaaatctctccaacatgctctcactttcatgccttctcgcattcaaaaatcaaaggcttgggtccctaggcctaagtcatgttttggcatctatcctaacttccgcaaaatttccatatatccaaaaatggtaatcatacatgcacaagcccaatctataagcaatattcacaaacttaggcgcaaacagcattga

SEQ ID NO: 54880 - DNA, 594 bp, Glycine max
  Peptide Sequence Number=SeqID_146565
atgttggtgcgcatgatccgcactcgtcccttagcagcggcacgagtgaaatcttgcctcggaacgcatagtagctatgtgatagcctccctctctggttgtactcgcatagttggccctcctccaatatcagggggtgacccaggaccattaaaaggaaactactggaccttaaattctcttaaggtgcggatgtggagcacactgaaaatgaggacacgtagccctctaaaggtgagggcgtgcagccctctcaaggcgaggatgtgtagtcctctggaggagagggcgtgcagccctccgaaggtgaggacatgcagtcctctgatggcgagggcgtgtagccctctgaaagtgaggacatgtagtcctctgaaggtgagggcgtgcagccctctgatggtgaggacatgtagtcctctcaaggcgaggacgtgtagtcctctcaaggtgagggcgtgcagccctctgttggcgaagacgtgtagtcctctaaaggtgagggcgtgtagccctacgaaggtgaggacatgcagtcctctgatggcgagggcgtgtagccctctgaaagtgaggacatgtagtcctctgaag

SEQ ID NO: 54881 - DNA, 309 bp, Glycine max
  Peptide Sequence Number=SeqID_146566
atgtccccagtggagtcgccaactgtcgcaacgtgcccttcgcgggcgagcgagggcgaggctcatgggtgcgctttccaaaggaggaaagatgcgcggagtcaccaccaacgtttatttgtggaaaacgtcggaaaaaccgaaggaaactgcggggcttttgctcctacataccctcctttggagaggaaatcagacctacgtagttctttcttaagcgtgaatcaagcgattctttttactttgaggggtgatcatcttaaggcgttggaccttaaaaatgatccattttacttattaagaaactga

SEQ ID NO: 54882 - DNA, 177 bp, Glycine max
  Peptide Sequence Number=SeqID_146567
atgtacctccaatgtgttaagacaaaaaattctcaggcggttagtcctttgaatctttgtaagtgggaagcaaaagatatctcaggcgaattttcacttgtagaagaacaaggtttggaaaacagaaaacttagaaagctttttgggcaaaggaagaagaagaagaaggatgagtag

SEQ ID NO: 54883 - DNA, 297 bp, Glycine max
  Peptide Sequence Number=SeqID_146568
atgttaggattcacaagtgattctcctcaaatttcagccagcccgcatcaattagactttgcaccttacgcttcaaggccctacaatgctcaatggaatgccccggggctcctccatgataagcacatgttgtgttcgagtcgtatcctcggaaaaatggaggtgggttttgtggttgatttaggtatgacctttgtggataactgggtggcaggaatggcagtcacaacatgggtttctccctcatcctcaacctcttcatttgccccagttttctcattcgtccaagcaggatga

SEQ ID NO: 54884 - DNA, 455 bp, Glycine max
  Peptide Sequence Number=SeqID_146569
gctctgtggggtcactcagactttgattggaaatggtttcctgcggtcaatacagctggggggcttctctgtgtcaggaataacaataacttccagggggtatggctggtagaaagtcagagggtagtggtggctaatatctatgcttcttgggacttcaactgcattaaacacccagctgaaagaatgggaagcactctttgtaatgcagacactaatcttatagctgaatttaatgagtggctcgctgaaatggaggtagatgatattccttgcttgggcaagccctttacttgggttaggcctaatggttcttgtaagagcaagttagacagagtgctggtctttgatgattgggacttcaataaggtggtgagggactgctggtttgctaatcagcctatgggatgggggggatatgccttgaaatgcaaacttcagaaaattaagcaaag

SEQ ID NO: 54885 - DNA, 720 bp, Glycine max
  Peptide Sequence Number=SeqID_146570
atgggatcaagtcaaatgccttcactcaaaaaaaggttctatcaagtcaaggtcaagagcctagggatcaccagtctaagagagttagggcagttgatgggtcagctccagcggcaagcttttcacaaagcttacagtaaaatctgggacctagccatggtagaagtctccacagaggccattgcatccctcgcccagtattatgatcagccgttgaggtgcttcacctttggggacttccagctatcacgtagaggcgaatgggccccgttcatagacatccttgtgcttttgatcttcggaggagtcctctttccaaatgtggatgggttggtggacctggcagcgatcgacgattttctcgcctatcatgaccgcaaggaaagcccggttgtcgctatactagccgatctacatgacaccttcgaccgaagatgtgagaagagcagtacaaggattgtttgctgtacttcggccctctatgtatggttggtttcacacctttttcgccaagaggtgaggcatgcttgcccgctagaaagccactattcatgcacagagaaaagaggggcgaattgggaccgactcttagcaagcaaagaaggagcgtctgtcaactggttccctcgatggaaagaaggaagaaccggcattcttatttcatgcggaggatttccaaatgttccctttgatggggacaaggggttgcatcagttataa

SEQ ID NO: 54886 - DNA, 267 bp, Glycine max
  Peptide Sequence Number=SeqID_146571
atgaaaagtgataaagcctcacaagatatacactctatctctcaagcttgtagtgagcttcaaaacaaggaaagggaaacaaggctcaaaagggctatcaaaggaattaattcaaggatgcatcaacaagaatcaagccaaggctattatgcaagcaatcaatggggcaaaacacaccaaatgattataatgatggatggctcaaattctcacaaaggtaaaatcatcactttcaaattgagctttcaaaactatcatgacatgtag

SEQ ID NO: 54887 - DNA, 782 bp, Glycine max
  misc_feature (51)..(51): n is a, c, g, or t
  Peptide Sequence Number=SeqID_146572
ctgaggactacacatcctcgccttcagaggactgcacgtgctcaccttcangaggactacacaccgtcaccttcagaggagtacacgtcctcacctcaagagggctacacgccgtcaccttcagaggactacacgtcctcaccttcaaagggctacacgtccttgccatcggtggactacacgtgctcgccttcagaggactacacggcctcaccttcagagggctacacgccctcaccttaaatggactacacgtcctcggctttagagggctacaaaccctctcctttagaggtgtacacgccctcgccttcatagggctacacaccctgaccttcagagtactactcgtccttaccttcaaaggactacacgtcctcgccttcagcggactacacgtccccgccttcagagaactacacgccctctccttcagcggactacacgtccttagcttcagaaggctacacgtgctcgccttcacagggctagatgccctcaccttgagagtacttaacgtcctcgcctttggaggactccacgccctcgctttcgtggggctacacgccctccccttcagaggactacacgtcctcaccttcagagggctacacgccctcacgttcagtggactacacgtgctcgccttcagaggactacatggccttaccttcagatggtcctcgcctttagagggctacacaccctcgcctttagaggtgtacacgccctcgcctttagaggactacatgtcctcacctttagagcactacatgtcctga

SEQ ID NO: 54888 - DNA, 315 bp, Glycine max
  Peptide Sequence Number=SeqID_146573
atgaagttgtatattgctgcgtctgacaagaccattggtagcatgttggctcaggaagatgatgatggcatagaacatgcaatttattatcttagttcgtattttattgtagatcactcagtgatcgagatgccgcaagactatgtcgatacagagccttggattttgtatttcgatggatcgaaacacaaacatggaactggaattggagttttaataatatcccccaataaagttccaactaagttcaaatataaatcaaagggctttgttctaataatgaggctgagtatgagctctaattacaggccttga

SEQ ID NO: 54889 - DNA, 909 bp, Glycine max
  Peptide Sequence Number=SeqID_146574
atggccgcggcgttgctgctgggcttcgtgctcatcctcatctgccaggtggcccatgcccaagcatggattgaactcaccgggccggcccagacatcctacacggcgcctgcaacctatcagttgcagctcaagagtggcgtcagaggcaccggccccaaggccgagtacctgtcgggcatacagctcttgcgtaacggccaggtgatctcgcggcttccgaacgggacgtacaccgaaaacgggatctcgcctggaagctatcagtatgtctacagggctcttgccgtacgcaatgtcaatggtgatgagttcacgcgagagctgacgtcgcctgtcatcacgatcacggtggccgcgccaccggcccccttcgatggtgcggagtatgtttccgcgagctggccgaggtcagccgacaggggcacgccgttcagcggtactgtcacgttccggaacaccggaaacacgacgtggagagcgggagatggctaccgcttgggtcaagccgaacgctatgtttccagtgctgtgagactagggatcaccgacgtcgccgttccccacgacgtgggccccggtgggacggttacctttgccttcaacggtgcggcggccaatgagaatggaccgagcaccctccagtggcagatgaaccgcaatggtgttcgctttggtagcaccagtagcgagcagacctttgaaacgaccggcaggctcaatcgcggcgtcatgtatgagcaggaggtcccgaccagcatggagaccgggcggacctatcgcgtcaagctgaagttcgtcaatacgggcaataccacgtggtcggcgtctgcgggctatgcactgggctcctggaatcccaatgacaatgtccggtggggcagggcacgggtcccaatgccgaatgac

SEQ ID NO: 54890 - DNA, 519 bp, Glycine max
  Peptide Sequence Number=SeqID_146575
atgtcggctctgaaagaacagatggcctccatgatggaggccatgttaggaatgaggcagctcatggagaagaatgcggccaccgctgccgctgtcagttcggctaccgaagcagacccaactctcttggcaactgcgcaccatcctccctcaaatatagtaggacggggaagggacacactagggcacgatggcagccctcacctgggatacaaccgagcggcttacccttatggattgccgcccaactactcaccacccgtcttgcaagacgatgcgggccatattgcttctcccgtccttgaaagagagcctccacaacagcccaaagaggtccacaaagaccctcaagactatgctcgaagggatgtcgagttccatcccccgatccccgaagggctggcacccagcacgttgcctcaacccaacatcgcgacacaaccaatagttttgtccacggaaggaccgcccccggcaactgaagaaaggaggaagctcgatctcctcgaggaaagatga

SEQ ID NO: 54891 - DNA, 219 bp, Glycine max
  Peptide Sequence Number=SeqID_146576
atgggagatagcttagaggatatgattcatgatcttggacaagagttttttcagatcaagattaatttcaagcttcatgaaaagaagtcaagaagattcaagattcaagagaagtttgatttcaagattcaagagaagatgaattcaagattcaagagaagaaatcaagaagacttcacaagggaagtattgaaaagatttttcgaaaaacaaacatag

SEQ ID NO: 54892 - DNA, 144 bp, Glycine max
  Peptide Sequence Number=SeqID_146577
atggatacctcaaagccctacactagggcaatgagaggcaccatgcatgagcctcaagtgaaccaaggggcagatcaaaagttctcacccaacagacgggaagagcaatgcaaagaacacatgcatgaagttgggcaacaatga

SEQ ID NO: 54893 - DNA, 276 bp, Glycine max
  Peptide Sequence Number=SeqID_146578
atggaagtaaaagaaataagctatgaaaacaaatggaagtttggtaacctattggaggctcccaacacacttccaatgaaaggccttttgttacaaaaacttgaaagcaatgaagtgcttcttagtccaatagctcttaaggtggttggccccttgcttctggactcaaattcttcaagggatggcaccaatcctccttccaattcctatatggcaacccacaaacaaggaaacaaagagacaagcaataaccaaagaccaaaaaaaataaaatga

SEQ ID NO: 54894 - DNA, 290 bp, Glycine max
  misc_feature (281)..(281): n is a, c, g, or t
  Peptide Sequence Number=SeqID_146579
gatcccacgtaaaaagacacttgttagcactgccacacctcttgggcttgaggttattcctcaagtaaaggagttgttggatgagggtttggttcgtaagagcttaaatccttgtgctttgttggtgcccaaaataggggttcccacgaaccctaagagaataaaggtcattcctgattggcccactccaccaagtgtcgagggaatgagcccagagtatgaagaacctcgggatttgaggtcaaatcctttccaaggtggaggggatgatgcaatcctancccccaatg

SEQ ID NO: 54895 - DNA, 1042 bp, Glycine max
  Peptide Sequence Number=SeqID_146580
agaattacacgtcctcacatttagaggactacacgtcctcgctgtcagagcactgcacgtcctcaccttcagaggactacacgtcctaacctttagaggactacaaatcctcaccttcagagggctacacgctctcaccttcagaggactacacgtccttgcatttagagggttgcacaccctcacctttaaaggactgcacgttcttacctttagagaactacacgccctcaccttcagagggatacacgtcctcaccttcagaggactacacgtccttcccttcagagggtttcacgcactcacctttaaaggactacacctcctcaccttcagaggactacacctcctcaccttcagaagggtacacgctctcaccttcagaggaccacacaccctcacctttagagggttgcacgccctcacctttagagaacagcatgtgctcacctacagagaactacacgtcctcccctttagagggatatacatcctcacctttagaggactacacatcctcgccttcaaagggttgcacgacctcatctttagaggactgcaggtcctaaccttcagaggattacacatcctcaccttcagagggctacacgctctcaccttcagaggactacacgtcctcgcctttagagggttgcacaccttcaccttcagaggactgcacttcctcaccttcagaggactacatgtcctcaccttcagaggactacacatcctcacctttagagggctacacgccatcaccatcagagggaaacacgtcctcgccttcagagggctacacgccctcgccatcagaggactacatgtcctcgcctttagagggatacattccctcgtcttcagaggactacacgccctcgccttcagagggctgcacctccttgccttaagagggctacgcgccctcgcctttagaggactgcacgtcctccccttcagagggctacacaccctcgccttcagaggactacacgtcctcccctttagaggactgcacgtcctccccttcagaggattacac

SEQ ID NO: 54896 - DNA, 180 bp, Glycine max
  Peptide Sequence Number=SeqID_146581
atgtggtatcatttttcagtgaaaaatctcgtcgggcgcctaggagtacatgacgggacatgcctcacaatggggagaccaatcagagtcactttattttacgagaatgctccaatcatatgggatcagcacagacttaaaggaacactcaaatcgggtgtatttacccccaaggcctag

SEQ ID NO: 54897 - DNA, 243 bp, Glycine max
  Peptide Sequence Number=SeqID_146582
atggataaagttgatatctttgtccctcatcctctcacaaacgcatgtttgcttattcaactttcaccggaatgtgggtgcaagccattggtctgtttgctcaagcgacctgcgctcctgagtgttgacttccaagactgttcaatcagagattactcgtcttgcacgttgagaagcgagttgtcaagaataggatattggacaaatggcctcagttatcttaagaatggggggttgaattaa

SEQ ID NO: 54898 - DNA, 297 bp, Glycine max
  Peptide Sequence Number=SeqID_146583
atgtatctcccaattcctcaggcattcaaaattgttgaaacaaatgcatctgatataggttatggaggcatactcaagcaaagaatccataaccaagaacatagtacatcaggggcacctcaaattctctacttgactatctcactcatgaattcttatagaaaaagagttatgccgcctagggcaacaggaacctccctgaggggagggaggagttcgggaaaaatcttcaagttggctctaccagagacaactgttaagaaaagttcatcaacatcatctgggtcacctacctag

SEQ ID NO: 54899 - DNA, 372 bp, Glycine max
  Peptide Sequence Number=SeqID_146584
atggcacaacctccaccccgtgagaggactctaagggaaatggctgcacctgatttcacctacgaaagcttgtgcatccaataccctgatgaggatgtcccatgtgttcttaaaactggactaatccatttgcttccaatgtttcatggccttgcaggactcagtaacatagagagaagtatgatagatgctgccaatggtggagcccttggagacatgacccctgctgaagccagaaatttaattgagaagatggcttcaaactcccagcaatttagtgccagaaatgatgctattgtcattagaggagtgcatgaagtagccacgaattcatcttcattagctgagactaagaagcttgaagtaaactag

SEQ ID NO: 54900 - DNA, 330 bp, Glycine max
  Peptide Sequence Number=SeqID_146585
atggataaccacttgggtatcctcgcctgccacctaacttcacgggttagtattaacagaaattgtctgtgtacggataaccacttgggtatctccgcctgccacctatcttcacgggttagtattaacagaaattgtttgtgtacggataaccactcggggtatctccgtacgtcatctgacttcacgggtcaggatgacacaaagtatggggtggtcgacaaaagcgaggctcttgctcctacgtatcctcaatttgtgatgaggaactcagacctacgtggttcttttaaaagtgagaccaaaatagtctcggtgttctttaactaa

SEQ ID NO: 54901 - DNA, 105 bp, Glycine max
  Peptide Sequence Number=SeqID_146586
atgggattctgggctagaagaaagaacagtggagctttcgatcaagacgttctcgcctcccctgtttgggctctcgctcgaatcggaacctttatgcgttggtag

SEQ ID NO: 54902 - DNA, 172 bp, Glycine max
  Peptide Sequence Number=SeqID_146587
ctccattggagcttgtaggccttggatcttcttcatcaatggagtcccttgcttcttaaagtttgatggtagcggaatggagaaggagaaggatgattggagacgccacttcaaggagaagacgagtctagaaaaagctcaccaccatagggagccatggataagagcttaa

SEQ ID NO: 54903 - DNA, 495 bp, Glycine max
  Peptide Sequence Number=SeqID_146588
cgatcaacgcttttctcgcctatcatgaccacaaggaaagctcggttgtcgctatgctagccaacctatatgacaccttcgaccgaagatgtgagaagagcagattttcgaatgttcccatgatggggacgaggggttgcatcagttacaatctcgttcttgctataagacaacttggctaccctatgagaggggcaccactggaggaagagatcgcgcctgtcatttcacgaggtttcaataaggccaacgtggagacacttcagaaggtccgcaaggcatgggaggtggtgcgaaagaaggacaaagaactcaggggcagtaacaatgggcccatcggtggctaccgtaagtggttgagagcccacgtgcaaggtttggattggctcccatgtttgagaaccgctaaaagggaggaagttgaggcaccaaaggaagatgaagaggtgcaggcccttagaacagaactcgagaaagctcaacagtcaaagaaag

SEQ ID NO: 54904 - DNA, 336 bp, Glycine max
  Peptide Sequence Number=SeqID_146589
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgcgtcccattcgccattcaggctgcgcaactgttgggaagggcgatcggtgcgggcctcttcgctattacgccagctggcgaaagggggatgtgctgcaaaggcgattaagttgggtaacgccaagggttttcccaagtcacgacgttgtaaaacgacggccagtgaattgtaa

SEQ ID NO: 54905 - DNA, 162 bp, Glycine max
  Peptide Sequence Number=SeqID_146590
tcgatccaacggttaacgaattggatcgaaggaattgttactggggtctttgagtgggaaaaagctcttgggaggattgatggggacccggtgttgagagaaacgaggatatgggctacgtgggagtacgtgagctcagttggaggtgggcaacaggggatg

SEQ ID NO: 54906 - DNA, 801 bp, Glycine max
  Peptide Sequence Number=SeqID_146591
atgtggatggatcggtttgctcttaccttgaacaggagtcaagaacttccccgcttgctagccaatgccaatgcgatggcggacacctactccgcccccgaagagattcatgggcttctcggctattggaaaaacaccgtaactaaacgcgccacaaggcatccctatcgcaccagatccaaatctagaacgatgggtgatcaagaggagacacatgaacagatgaaagccgacatgtcggctctgaaagaacaaatggcctccatgatggaggccatgttaagtatgaagcagctcatagagaagaacgcggccaccgctaccgctatcagttcggctgccgaagcagacccgactctcttggcaactgcgcaccatcctccctcaaacatagtaggacggggaagggacacactggggcacgatggcagccctcacctgggatacaaccgagcggcttacccttatggattgccgcccaactactcaccacccgtcttgcaagaagatgcgggccacattgcttccccgtccttgaaagagagcctcctcaacagcccgacgaagtccacaaagaccctcaagactatgctcgaagggtcaaaccccagcaaacgcctcatggtacccatcagtacgcgcaacatcacccgagcttctcggctcataccgggaacgcctctagttcaacacccgtgcagcctaaggcactcacccagagggaagctccccaagggatcctctagagtcgacctgcaggcatgcaagcttggcactggccgtcgttttacaacgtcgtga

SEQ ID NO: 54907 - DNA, 792 bp, Glycine max
  Peptide Sequence Number=SeqID_146592
atggatgccaagcacctcacaaggaccaaagaaaggtcgcatgtcatcaagcaaaggtccccggacgaaattaggaggaggatagattgggaccagcttttggctgagataggtggtagaacaatcaattggttcccccgatggaaggaaggaaaagagggagtctttttctcatgtggagggtacccaaacattccgctgataggaacgaggggttgtattaactacaatcccgcgctcgctataagacaactagggtaccctatgaggggagcaccgatggaagaaagcatgtctcctttccttgtgagggatttcggcacacaaaatttcaaggctatacaaagaatccataaggcatgggaaaccccgttaaggaaggatcaagaacttaggggcattcgtaatggcatcattggtgggtaccatgaatggctgaaagttcatatacgaggtttagattggctcgccaagttaaaagtcgtcagcgaagaaagttttgaagcaccggaagaagacgaagaagtccaagctctcaaaagcgagttaggaaaggcgaaacttgccaaggagaagttcaagttggccgctacacacatccggaaggagtgtgccggattacgggaagagaatgcaactaccgcaagagcccttgaacaagagaccaagagggctcacaaggaagagtatggccggaacaaatttcgcggagcctctgtgggggtagcaacaatgaactcaagctgcgaagggaagagagcgaccagtcgcgagcacatagcatggttttga

SEQ ID NO: 54908 - DNA, 924 bp, Glycine max
  Peptide Sequence Number=SeqID_146593
atggcgagaatagccaaggtatttgaaatatcggcgcaagaattggaccgagtaaaacaaaataaaaatggggtggtcggaataccgaggaagcacttggaggagaaagcgaaggctttggcggatcaaggtgaatgggtttcattcgttgatgtcttggcgctattggtatttggagtcatcctttttccaaatgtggatgggctagtggatttagcagcgatcaacgccttccttgcttatcaccatagcaaagaaagcccggccattactattttggccgatgcctatgacatacttgaacgaagatgtgagaagagtggcacaaggattgtctgttgcacacccgctctttatgtatggttggtctcgcacctctttcatcatgaaagtagacctgtctatgccctgcaaggtcaccacatgtgcgctgagaaaggaaaggcaaattgggagcaactcttggctagtatggtaggggcatccattaattggttcccccgatggaagaaaggaagagttggggttttgtcctcatgtgaggggttctcgaacatccccttgatgggaatgaggggttgtatcaattataattccgtccttgccataagacaacttggctaccccatgagaggggtgccatcggaagaaagtatcacgcccttcatcgcacggggtttcagttaccccaatgcaatgatatttcaaagggtccgaaaggcatggagtgcggtgcaaagaaaggataaggagcttaggggaaacaaaaatgggatcgttggcggctattacaagtggctgaaggcttggacgcaagagttagattggcttccaaaggtaaaggtttcaagtgaggaagaggctgaaacccctgaggagagcaaaaaggtgcaagccttaatggccaaacttgaaagggcgtaa

SEQ ID NO: 54909 - DNA, 699 bp, Glycine max
  Peptide Sequence Number=SeqID_146594
atgggatcaagtcaaaagccttcacttaaaaagaggttctatcaagtcaaggtcaagagcctagggatcaccagtctaagagagttagggcagttgatgggtcagctccagcggcaagctttttgcaaagcttacggtaaaatctgggacctagtcgtggtagaagtctccacagaggccattgcctccctcgcccagtattatgatcagccgttgaggtgctttacctttggggatttccagctatcacccatggtggaagaatttgaagagatcctaggatgtcctctagggggaaggaaaccatacctcttctcagggttctacccctcattagccaaaatttctaaaatagtccaaatctcggcgcaggaattagaccgccaaaagcaagtcgaaaatggggtggttggaataccgagaaaatatttggaggcaaaagccagaatcttggcaggaaaaggagaatgggccccgttcatagatattctcgcactgttgatcttcggaggagtcctctttccgaatgtggatgggttggtggacctagcagcgatcgacgcttttcttgcctatcataaccacaaggaaagcccggttgtcgctatgctagccgacttatatgacaccttcgaccgaagatgtgaaaagagcatacaaggattgtttgctgtactccagctctttatgtatggttaa

SEQ ID NO: 54910 - DNA, 202 bp, Glycine max
  misc_feature (28)..(28): n is a, c, g, or t
  Peptide Sequence Number=SeqID_146595
gaagaagaaagtagaccttgtagagaancggataggagaggtagcctatagactcaagcgatcagctcggttaaaactcaccccgtattccatggccaacctgagagcgaggcaagctgggaacgggctgaaactgacgattctaagaccaagtcagagactactggacgtctcgcagagcgactctcaacgaggacgttga

SEQ ID NO: 54911 - DNA, 54 bp, Glycine max
  Peptide Sequence Number=SeqID_146596
gagttttacaaagagagtggaaatctcaagtggtttcttgaggactggacgtag

SEQ ID NO: 54912 - DNA, 81 bp, Glycine max
  Peptide Sequence Number=SeqID_146597
atggcgtgtgaagaaagggttgcttgtggagccgaccgccaagtgatgatgaaaggttcatctttgtgggtgatggcatga

SEQ ID NO: 54913 - DNA, 464 bp, Glycine max
  Peptide Sequence Number=SeqID_146598
atgacccgcactcgtctctttgcagcggcacgggtgaaatcttgcctcggtatgcatagtagctacgtgatagcctccctctctggttctgctcgcacagttggtctcgctccaatatcagggggtgggcacaagaccttaaattctcttaaggcgcagatttggagtcctctgaaagtgaggatgtgtagccctctaaatgcgagaacatgcaaccctctgaaggtgagggtgcgcagccctctgatggcgacgacatgtagttttctgaaggtgagggcgtgcagccctctgaaggcgagggcatgtagccctctaaaggtgaggatgcatagccctctaaaggcgaaggcgtgtagccctctgatggcgaggacgtgtagtcctctgatggcgaggacgtgtagtcctctgatggcgaggacgtgtagtcctttgaacgcgaggacgtgtagtcctcggaa

SEQ ID NO: 54914 - DNA, 150 bp, Glycine max
  Peptide Sequence Number=SeqID_146599
atggagttccggatgacgccacttccagcgaaggaagataagtcaaggaagataagttcgggtaaacgccacaaggattaccttgataagtctgataattggttcaacaaggaacccagagagaaactctcaccaaattttatcaaatga

SEQ ID NO: 54915 - DNA, 432 bp, Glycine max
  misc_feature (5)..(5): n is a, c, g, or t
  Peptide Sequence Number=SeqID_146600
ggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatcctactgctcaatactcagtgtcttatcctagtcttgcgcagtctccagttaatgctacagcagtcgctactgctatcggtactgaaaattgttacaccgttgattctcatgatcaacctgaagcagggggatcctctagagtcgacctgcaggcatgcaagcttggcactggccgtcgttttacaacgtcgtga

SEQ ID NO: 54916 - DNA, 128 bp, Glycine max
  Peptide Sequence Number=SeqID_146601
tatcagaatttcaacaaggtcatgacaaaagacaacaatagatatcttagagccttacactggggcaatgagaggcaccatgcaggagcctcaagtgaacctagaggcagatcagaagttctcacccg

SEQ ID NO: 54917 - DNA, 477 bp, Glycine max
  Peptide Sequence Number=SeqID_146602
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccacttctaattctggaaaggataggaagaagtctgtaggcaccaataaaggaaagattccgactcaaccaacaattaaaaaggagtcaaagtgtttcttctgtaaaaagaaaggacacatgaagaaggactgccccaaatttaaaagttggtttgagaagaaagggtatggaaagcctaaggaagccagtgggaagtga

SEQ ID NO: 54918 - DNA, 862 bp, Glycine max
  Peptide Sequence Number=SeqID_146603
cgaaggcatcgactttgcgcttgataccatcgaggaacggactggcgaaaaggagatcaacgccgtcggttattgtgtcggcggcacgcttttggcctcggcgctggcgctgcatgcacagcaggacaatgagcgcatccgcagcgccacgctgctcgccgcccagaccgatttcatccatgccggagacctcaaggtcttcgtggacgaaggtcagctggccgcgctcgacagacacatgcaggccgtcggttatcttgacggttcgatcatggccaccgtcttcaacatgctgcgcgcctccgatcttatctggccctatgtggtcgataattacctgcgcggcaccgaacccctgccattcgacctgctctactggaactccgattccacccgggtgacggctgccagccactcgtactatctgcgcaactgttacctcgagaacaatctcgcccgcggtctgatgcgcgttgccggcaagcgcatcaatctcggcgacatcaacatacccgtctacgatctcgccacccgcgatgaccatatcgcacccgcgaaatcggtgttcacgggtgctgccctgtttggcgggccggtggaattcgtgctcggcgcttccggccacattgccggcgtcgtgaacccgccgcagctcgagaagtaccaatattggacggggccatcaccagccggagacttcgacgcctggcaggccgccgccacacctcacaagggttcgtggtgggtgcactggcagaactggatcgaaagccagaacgccgagaaggtaaaggcgcggaaaccggaggacggcaagcgcccggtgctcggcgatgcgccgggaacctatgttcttttgtag

SEQ ID NO: 54919 - DNA, 558 bp, Glycine max
  Peptide Sequence Number=SeqID_146604
atgaggggcaccgtgaatgagcctcaagcgaacctaggggcagatcaaaaagggctgcatgtcctcgccttccgagggttatacatccttgccttcagagggctacgcgtcctcgactttagagggctacacgtcctcgacttcagagggctacacatcctcgacttcagaaggctacacgtcctcaccttcagagggctgtacgtcctcgccttcagagggctacacttcctctctttcaaagggatatacatcctcgcctatagagggctgcacgtcctcgcctccagagggctgtacgtcctcgccttcaaagggctacgtgtcctcgtccttcagagggctagcacgtcttcaactttagaggtctgtatgtcctcgccttcagagggttgtacagtcctcgccttcagagggctagcacgtcctcacctccagagagctgcatgtcctcgcctccagaaggttgtacgtcctcgccttcaaagggctacacgtcctcgccttcagagggctacacgtcctcaacttcagaggcctgtatgtcctcgcctttag

SEQ ID NO: 54920 - DNA, 624 bp, Glycine max
  Peptide Sequence Number=SeqID_146605
atgaaaatgaacccactcgccaatcatagaggggaagcagttaatgccatcgagtcgggtaggccgtgcaggtccaaacctttgaagaacgtgacgacccccaggaggtttatctacgaggccctacaaaagaggggcataattccccacggtgggcatgaagaggattcctgtttgttgcatcccggcgagctacacaacatggaaacatgtttagcaatggaggaccttttgcaacagatgatagatcgaggccgactggaagtcggtgatgaggggagtgaaaagcagcatatatccacgcagtttccgtggaggtatgcgcctccaagcaaaaggaaggaagaggccaccgacatcagctcgttgttagccaaagtgaccaatatcacggggctaagcggcgtgacccgcagcggtcgcgtgtttgtaccccctgacctgccgacacaacccgcaaacgataaagggaaggcaaaaataacagaaggacaaaatgacaaaatgatccccacttcgagcaaggatattccagtgaaaggtcttccggagaaaaaggatggctacggcaagaaagaagtatcgctagaggaggcaggcgagttcctccgcattattcagtaa

SEQ ID NO: 54921 - DNA, 156 bp, Glycine max
  Peptide Sequence Number=SeqID_146606
atgactgaagcacgtcaaaagggggtacggaaagtaaatgaaaacgagaacaaaggggaggagcttgccacccagctcacccaggcgagcaaggttgcttcctccagaagcaaccgccttctggaggaagaatctggaaggcccaagtgggcctga

SEQ ID NO: 54922 - DNA, 552 bp, Glycine max
  Peptide Sequence Number=SeqID_146607
atgggatcaagtcaaaagccttcgcttaaaaagaggttctatcaagtcaaaatcaagagcttagaggtcactagtttacgagagttggggcaattaatgggtcaacttcaacggcaagccttccgcaaagcctatggtaagatttgggacctagctagggtagaagtctccatggaaccgattgcatccctttcccagtattatggccagcccctaaggtgcttcacatttgaggacttccagctagtgccgactgtgaaacagtttgaagaaatccggggatgcccactgggaggaaggaagccatatcttttctctgggttctatccctccacgacaagagttgccaagctggttttgcacctttttctccaagaaggtaggcccgtctatccgctacaaggtcaccgctcgtgcgtcgaaaaaagaaagacgaattgggaccaactcttggctagcatagaggggcgtctattaattggttccctcgctagaaggaaggaagaatcaggattctatcttcatgcgaaggatgtccaaatgttcccttga

SEQ ID NO: 54923 - DNA, 369 bp, Glycine max
  Peptide Sequence Number=SeqID_146608
atgaaggagcggttagggcatgatcaaagtggtagaggaggaggatgggaagttgatgccgaagagggagcagggagaggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 54924 - DNA, 309 bp, Glycine max
  Peptide Sequence Number=SeqID_146609
atgtgggtgcaagccattggtctgtttgctcaagctacatgcgctcctgagtggttgacttccaagactgttcaatcagagattactcgtcctgcacgttgggaagagaggaatgcaaacttgatttatactggttcggccactttccgtgcctacgtccagtcctcaagcaacccacttgagattttccactctctttgtaaaactccttttacaaagtctgaactacacagggataacctttcccttgtgttcaggaatcctctacaacaagagactctcggtctcttaatcccttttcagaagtaa

SEQ ID NO: 54925 - DNA, 454 bp, Glycine max
  Peptide Sequence Number=SeqID_146610
cccgcatcaattagaccttgcaccttacgctttaggcccctacaatgctcaatggaatgtcccggggattctccatgacaagcacacgttgcgttcgagtcgtattctcggagaaatggaggttgatgaaccttggttggggctttctcgctgcaaaattcatttcttggttggtgttttggtttacgctaaagggatgacctttgtggataactgggcggtgggtaaggagaaggtttgttattggctgagtaatgacattgttgggttggtgggaaacttggctacccacatcgatcctttcactggcaaagaccaaatcctcaaagctttgaaggttctccacctttgggcgtattctttgaaagatttgtgcccctttttgcacatgttctgtagttgcatcctatccgaagacattatactgacactgcctaatgaaggcaaccactag

SEQ ID NO: 54926 - DNA, 105 bp, Glycine max
  Peptide Sequence Number=SeqID_146611
atggaggatcggaatgtagaagaagaagagttgagacaccacttcaaggagaagatgagtctagaagaagctcaccaccataggaagccatggataagagcttga

SEQ ID NO: 54927 - DNA, 189 bp, Glycine max
  Peptide Sequence Number=SeqID_146612
atggataggcacctcgggggcctatcctataaatccatggctccactttctgcagcacaacaatgggatgaaagtaacttgctggaagatgcactgtttttggcatggacatggttcagaacaatggaggaaaattttacaatgcatttcaactattggtctagcaatctaccagctggttttctgtaa

SEQ ID NO: 54928 - DNA, 276 bp, Glycine max
  Peptide Sequence Number=SeqID_146613
atgaagaagaagctggaggaagttgcacagtcaggaagcgttgatcgcgccatcgaccctccatcaccggtcaggcgccatgtgaagtggaagatggcccgcacgaagaaaacaagggagatgacaactgaggctgcaaaggaaatcgctgcgaagatcgattcctttgaggagcaggatgttctcaccgctgctattggacgtccagagcaccctggacgtccagagcaccctggacgtgtgcgtgctgctggagccggtgtcaccatcaagtaa

SEQ ID NO: 54929 - DNA, 762 bp, Glycine max
  Peptide Sequence Number=SeqID_146614
atgagcgactgcataatcttcgctacgctgttcgcaacctatgccgttctggtgaacggcacggctggcggcccggcgggtaaagatatctttgaactgccgttcgttctggttgaaaccgcactgctgttattcagctccatcacctatggcatggcggctatcgccatgtacaagaacaacaagagccaggtcgtttcctggctcgccctgaccttcctcttcggtgcagggttcgttgggatggaaatctatgaattccatcacctgattgttgaaggtatgggtccggaccgtagcggcttcctgtcagcgttcttcgcgctggttggtacccacggtctgcacgtcacctctggtctgctgtggatggcggtattgatggttcagcctgttctggcacttcctggacgtggtgtggatctgcgtgttctctgttgtttatctgatgggggcgatgtaatgagtcattctaccgatcatagcggcgcttctcacggcagcgtgaagagctacatgacagggttcatcctgtcgatcattctgacggcaatcccgtttgcaatggttatgagtggctctgcctcgcatgcagcgattctgggaaccatcctggtcacggctgtagtgcagattctggtgcacctggtgtacttcctgcacatgaacagtaaatctgacgaaggttggaacctgaccgcgtttatcttcaccgtaatcatcattgctatcgttgttgtcggctccatctggattatgtga

SEQ ID NO: 54930 - DNA, 549 bp, Glycine max
  Peptide Sequence Number=SeqID_146615
atgacgccccccgagagacgagttctctcctattcccatggcgtattccgagttatggccctcattattggaaaaccatttggtggtggccatacccgggaaggtcttccagtcaccataccccaatataaggtgcaacacctaataaatgccggctggctatcatttcaagaagaggtccccaacgttaagaccaatccactagccagtcatggaggagctagcgtaaacgccatcgaaaaggataggtcattagggttaaagagactagaagatgtggctacgtctagaagattcatctaccagtcgctgcaggcagcatgcatggtctctcgtggcgaagacaaaagcgacgaatgtctgtttcatctcggggaatcacacgacatggaaacctgctctacagtggaagagctacttcaacggctcatggactgggggcagctcgaagtgtctgagaggggtagggaagaatcgcagatttgcatgcagtcagcagaaaggaaggctcctcccaacccccaaagccctagtaatatgcttcactag

SEQ ID NO: 54931 - DNA, 204 bp, Glycine max
  Peptide Sequence Number=SeqID_146616
atgaaagaagaagtaaggaaggaagtgctcaatgttctagaagcagtgcttatctacctaatctcagacagttcatgggttagtcctgttcaagttgtccaaaaaagggagtggatcctcaagacaaagaaaagacagctttcacatgcccctttggtgtatttgcttatcgtcgcatgcctttcggtttatgtaatgccctag

SEQ ID NO: 54932 - DNA, 255 bp, Glycine max
  Peptide Sequence Number=SeqID_146617
atggcacaacctccaccccgtgagaggactctaagggaaatggctgcacctgatttcaccttgtcgcaatgtgcccttcgcgggcgagcgaaggcgaggctcacgggtgcgctttccaaaggaggaaagatgcgcggagtcgccaccaacgtttatttgtggaaaacgtcggaaaaaccgaaggaaaccggtcgacaaaagcggggcttttgcgcctacgtaccctccatcaaagaggaaatcagacctacgtag

SEQ ID NO: 54933 - DNA, 693 bp, Glycine max
  Peptide Sequence Number=SeqID_146618
atggccaagttcgatccagacatagtcctcaaattttatgccaatgcttggcctacagaggagggcgtgcgagatatgaggtcttgggtgaggggtcagtggatcccgtttgatgcagatgctatcggccagctcctgggatatcctttagtgctggaggagggtcaggagtgcgagtatggccagaggaggaaccggtccgatgggtttgatgaggaggccatcacccagttgctatgtataccagggcaagattttgcccggactgctgccgggagacgagtgcggatcatgcgcaccaacatgaccaccctgactcagatatggatgactttgctgctcagcaacatcctgcccagcgaccataattccgacctccccctgccgaagtgtcagctggtgtacgccatcctgacgcggatgagcattcacgtggctcagctaatcgttgatgccatctatatatttgcaggtatggcgcctaccaggcaccttctggacccggataagtccaacaaggccctgggatttcccgccttgatcacaggactctgcctgtcgttcggagtccctgtcgcacctagcaaggtgatttggccgcccatcacccgtgcttttattgagaagtattgcaagcagagacaggtccagggggatgctccgcaggccgcaaatgcgccgccacctcattag

SEQ ID NO: 54934 - DNA, 1164 bp, Glycine max
  Peptide Sequence Number=SeqID_146619
atgacttctcgcaagcgccgtgccgtgcccacaccaggggaagcgtccaactgggacacttcccgctttacatctgagattgcttggcacaggtaccaagacaacattcagctccggaacatccttccggagaggaatgttgaactgggacctgggatgtttgacgagttcctccaggaactcaggaggcgcagatgggaccaggtgctgactcaccttccggagaagcggattgacgtggctctggtgaaagagttctattcgaacctttatgatccagaggaccacagtccacgattctgcagggtgcgaggacagatacctcagcactcacccgatcctgacaccatcgcggccacactgtgcactccaggggggcgctttgtccttaatgctgatggtctcccctggaagctcctgaggaaggacatgacgacacttgctcagacatggagtgtcctttcttactatgatctcgcgcccacttctcacacttctgatgttaatcttgacagggctcgcttgatctacggtttggtgagtcgcatggacatggatgtgggcagctttatatcacagcagatcagccagattgcccagtccagcacctcgaggctcgggttcccagcgttgattacagcgttgtgtgacattcagggggtggtttctgataccctgatctttgagtcactcagccctgcgatcaacctagcctatgtgaagaagaactgctggaaccccgccgacccatcgatcactttccctgggcctcgccgcacacgtaccagagcttcagcatcagcttccgaggcccctctccctacccagtctccgtctcagccatcccagcgaccgcgacatccacctgcttccacctcagcatccatggacacgcatgggcagatgctgaggtcccttcacgtgggacagcagctcatcatggagaatatgcataggctgtccctacacctgcagatggaccccccgctcaccactccagaggcctatcgtcagcgagtcgcctggccaggagaccagccctccactgacaggggggaagagccttctggagccgctgaggatcctgctgtcgatgaggacctcattgctgacttagccactgctgactggggctcatgggcggacttgggcagaggcagttga

SEQ ID NO: 54935 - DNA, 954 bp, Glycine max
  Peptide Sequence Number=SeqID_146620
ttgatccttagtggagacatgagagacattgaggtggctagcttgaacttgctcgtgaacaaagtgatagtccaagaagatgtgctacatcctagagtgaagaacaaggcaggcaaactcgaagttcttacgttgtttcttggaaaaccaggatatcgggttgctgccaaagaagatgatgaacgtgaaggtggaggttctgtcgtaaacattccctcctcaatctgcatccgtgcatttgaggtgttggaggtgaagggtggtgggttgtgcattaattgggaaattttattgatggaaaaggataggtcaggtctagtgatggtgaaagtgaggtattgtaaggcaccaatgatgctccaatatagggttgcaccaacggtgggtgtgccatcatttaaaatgaaggtagcaattggagataaaggtgttcatgaggttaatgttgatgccgatgaggaaaagggagccttgaaggaaggcattgttgacgtcaagctgatgcatgggctagttatggtcaaaagcaatggtgaggacaattttgatgcaagcaacagagccgttgagatgtcttttgatacggaagagccacttgcaacccgcaatgttatgattttagggtgcaagaacaagagcgagtgggcatgggatgagtgtggatgggggggtgtgatatgggaagatgttgtcatggaagatgcttggtgtggatcttggttagagtttgttgttggtgtatgggcgaataagccatgggaaataaaggcaaccaaaggagtgaccagaaacatagggataagtgtgcatggtgtagaaggcctcaaccaatttcaattatgtggcgatgacatagctcaactattgcatttagttcaggtgttgaaaagctatttgtggcttttggctgtgctacatgaaatgcatggttgggttgagctcgaccttatttga

SEQ ID NO: 54936 - DNA, 201 bp, Glycine max
  Peptide Sequence Number=SeqID_146621
atggcattctcttacaagatgaccctcttcataatgctactaataatcttcaccattttggttgcttttcctcaatttggagcagctagcagggcattgcaagaagatgagtgtcttttcaacggggcactccggtcgtatccagtccagatccaattcgtccataacaaacctacaaactcacctgcatgtgctaactga

SEQ ID NO: 54937 - DNA, 915 bp, Glycine max
  Peptide Sequence Number=SeqID_146622
atggtcaaggccttgcagaaattggtggcattgacgacggtgacgatgcaacaaagacctttctgggcaggagcagccgcaaatgctgtaatcattgaggcagatgccttcaaagaatcagatgtcatctataaggcccttagctcaagaggtcaccatgacatgattcaaacagcagaactggtacatcaagcatccacagatgcggcctcatccctcctagtaacagcattaaacgaaggacgagatgttattatggatggcacactttcctgggtgccatttgttgtgcagacaataacaatggctaggaatgttcaccgtcgccgttaccgcatgggagaaggctataggctgaaggaggatggaactgtaattgaaaactattgggaaagaattaaagacgaagaacctgaacaagttggaggcaaaaagagaaaaccatataggatagaactggttggagtagtatgtgatgcttatcttgcagttgtcagaggcataaggagagctatcatgtgcagaagagcagtgagaataaagtcacagttgaaatcccacaggagatttgctgaggcatttatgacttactgtcaactagtagataatgcacgactatacttcacaaacgcattagaaggcccagctaagttgataggatggaaagatagagacaagacactgcttgttgatccagatgaattcgactgtatgaagaggctagccaagttgaatgaagatgccaactccatttatgaactttacaagcaccccaacccagcttgtgaagctggatcagtatggaaagacattgtattatctccttcaaggttgaacatccaacaggagctcaagtattcgatccaaaaaattgaaagcatgaactataataacgtcaccatggagaacagatga

SEQ ID NO: 54938 - DNA, 279 bp, Glycine max
  Peptide Sequence Number=SeqID_146623
atgacgatggttgcaataatagtgatgtcgatgaaaatgatgataatggtgagatggaataggggcggtgacgatggtgatgatagtggtggtatggtgacggtgatgatagtagcggatggaataatggtagtgatggtggaggcgacaataatggtgataatggtggcaaaggtgaggtgtaatggtagtggtgataaaatggtggaggcgataatggtaatggttatgcgacagtgcagtggtggtggtcgtggtggaatagtggtggtatggtga

SEQ ID NO: 54939 - DNA, 1722 bp, Glycine max
  Peptide Sequence Number=SeqID_146624
atgaagcgatcgggtcggtggcagaggactctgatcctcgctcttctctttctctccctcgttgctccgctcgtttacgtctctcacctcctcaacactctcacttccgacggtgctgaagaattagaagagccaaaggaaattgtttataaagaagaagattttgattcaacaaatagttacattttgcaaaagactaatgatactgcggcatctaaaagtgaggggtacagaaataacactttggaaagaaatgaattcgaccaggacaaaaaacaaggccaggaagctcagcaaaaaggattattctccatggacggggatgtgaatgtatttaatacaactgtcacacttaagcagaatatgcacactcagtctcaaagaatgacagatgtgaatgttgaagtgatagataagaaatctagtccaaaagcaatccaacatcgtcagagttcacgctctcagtctcagagagtgacaaatcagaaggttttggagattaaggatcaaattattagagccagagcatacttggggtttgctcctccaggcagcaactcacacttgatgaaggagttgaagctgagaattaaagagatggaacgtgctgttggagaagctactaaggattcagatctgtcaaggagtgaacttcacagtgctttgcagaaaatgagacacatggaggcttcactgtctaaagccaaccgtgctttcccagactgcactgctatggcagctaagctccgtgcaatgaatcataatgctgaagagcaactaactgctgattactttgccctgaaacccgaggaccggaagcttccaaatgaaaacaagattcatgatccaaaactttatcattatgctgtcttctctgacaatcttctggcatgtgctgtggttgttaactccactgtctctaatgccaagaaaaaggagaaacttgttttccatgtagtgaccaattcactcaactttcctgcaatctggatgtggttcttattaaaccctcctggcaaagccacagtccacatacaaagcatagagaactttgaatggttgcccatgtacaatacattcaacaaacataattctagtgatccaagatatacttctgagttgaactacctgcgtttctacctgccagatatcttccctactctaaataagattctgctctttgatcacgatgtggtggtgcaacaagatctcagtggactatggaatgccaatttgaaaggaaaagtaattgcagcagtgggcacctgtcaggaaggtggaacctcatttcataggatggatatgctcataaacttctcagatccattcattgcagagaggtttgatgccaatgcttgcacatgggcatttgggatgaacttgtttgatttacaacagtggaggagacataatttaaccgctctctatcacagatatttgcaaatgggttccaagaggccgttgtggaacattggaagtctgcctttaggctggctcactttctataacaagactaaggttttggacagacggtggcacattcttggccttggttatgactcaggtgtcgataaaaacgagattgaaggggctgccgttatacactacgatggaattaggaaaccatggttggacattgcaatgggaagatacagaagttattggaccaaatatatgaactttgacctccctattttgcaacgttgcaatctccaggcgtag

SEQ ID NO: 54940 - DNA, 330 bp, Glycine max
  Peptide Sequence Number=SeqID_146625
atggacctttatgatcataacaaacttgaagagaaaaagaaaatcaagcttttgaagtcagatttcatagagtatgatgacgatgcaactgtcatggttgtcttagcaccaaaagctgagtgttttaaagatcaaaaatggtttaaggaggttgcaagcattcctatttcaaattctgtggagcaaagggatgcaaatggtagtgtacttgtcagtgatcctccgtacataggtgtggagggggtggttttttccattggagtatataggatgaagaaagacttgaggggagtgtattttctgaggggtcatttgcatgagattgcttaa

SEQ ID NO: 54941 - DNA, 642 bp, Glycine max
  Peptide Sequence Number=SeqID_146626
atggacgcatctgaacccgacaatgtcgatgactactcgccttcttcaaccgtcatcaaattcgaccgccccgttcctttgctccggggaccgttaccggcgggtccctccgacgacccgtcggcgggaccgtacgtgctggcattccgagactcgcgcgcgtgggcgtcctcgttcgcggcgtgcgagcgtaaaatcgttgagcagtgcgaggagggggcgaggatcggttgcgccgtgagcgcgtccagaaagtgcaagcttccatggtggaagtccctggcgggtcccacgctctccgatctgaaggagcgggagcagtgcgaagtgcgcgagatggcggattgtgaagccgcggcgaaggagaagtgcgttggcttcgccagggacaagtgcttggttccctttagggatgcgaggattagggttgggaaagggtttttgagttccagggatgctgtgaagttgattggttgggcatccatgccggagagtgagaggagtttgaagttgatgagtctaatggggggtggtggtggtggtgatttgggagtgaccaattgcagggctagtgagttgctaggatttgataattatgtgcaatgcattttgggtgagcagcaacacggcactggaaactga

SEQ ID NO: 54942 - DNA, 447 bp, Glycine max
  Peptide Sequence Number=SeqID_146627
atgggaaatcgggttcatttgatatacctaactgtgttggctaatctcgaacgagtcagacggtataattggggctctgcttgtctagcaacgctgtacagggaaatgactttgaggcgaaaatcatgggcgggtgtgcgtcattgttgcattcttgggcatagtatcacatgtccttcagtgcagcaagagttaatcgcagaccatcgtatctgttggttacgagtagaatggaaacatgcggatagagttaaacttcaattccgcctccaacaaggcataccagatccccaaaaaaacatggacaaatttcacaaaatcgacatgcgaggtcaaactgacacaaattgggctgaaaaacatgcaaaatggataatgtattggcaacaacgtcaatcaatggttttacatggacaatcgattgtagggcatgcaaaacattcttaa

SEQ ID NO: 54943 - DNA, 735 bp, Glycine max
  Peptide Sequence Number=SeqID_146628
atgttccccactgctatttccaattcaacttctttgtctgaggatgccagtgtttcttctgggacaaaagttcaggacttgggaggactcaatccctgggtctcaaacatttctcctcaacaacaacaacagcctcaaaagatcaagaaaaagagaagcctacctggaaatccagacccagatgctgaagtgatagccttatctccgaagacccttttggccactaacagatttgtttgtgagatctgtcacaagggtttccagagagatcagaacctgcagcttcataggaggggccacaacctcccttggaagctgaagcaaaggagcagcaaagaggtgaaaaagaaagcctacgtttgccctgaaccttcatgcgttcaccacgacccctcaagagccctgggggatcttacaggaatcaagaaacacttctgcagaaagcatggagagaagaagtggaaatgtgaaaagtgctcaaagatatacgcggttcagtcagattggaaagctcactcaaaaacatgtggtactagagaatatagatgtgactgtggaatccttttttccagtggatctttggttttacataagaatggtaagcactcaccatggaatataagaatggcatttacaggtagcacgaaagtgggacaacatgcttctgttgcaagagagattgaaaccttacttatctttgaatcccaaaactgccaaatgaatatgcggcaataa

SEQ ID NO: 54944 - DNA, 3855 bp, Glycine max
  Peptide Sequence Number=SeqID_146629
atggaaccaaagtgcaccataaactgtcgccggccggagttcgttccgacccctctgccggagagtcctcgtgtgcccatggagtttctgtcacgctcatggagtgcctcagctcttgaggtctcaaaagctcttgcacctcactcttcttacaacaactcctcttccattccagaacaaacttctgcttctgctcccaaccacaacaacaaccctttttctgaggacttgtcaaccatctcttctaagaatcagttctcttttgcttcctctgccacctcccagctcgtccttgaacgcattatgtcacagtccgcaagagaggaagtgtctccattaacttctggaagattatctcacagcagcgagcctttgaatggtggtggttccttaaccggaacagatagccctccgatttcaccttcagatgaatttgacgatgttgttaagttttttcgggcaaacaattccattcacccattattcaatggtggaagagccagtgcaactattggcaatggcacggcttgctcaggacctaaaactgttggaagatggttgaaggaccgaagagaaaagaagaaagaagaaaacagaacccacaatgctcagttgcatgctactatatcagtggctgcagtggctgctgctgtagcagccattgcggctgcaacagcaggctcatctgcaccaagcaaggatgagaagatggcaaagactgacacggctgttgcttctgcagcaacattggttgctgcacagtgtgtggaggctgctgaagcaatgggggctgagcgtgatcaccttgcttctgtggttagctctgctgtgaatgtccgttctcatgatgatatcactactcttactgctgcagctgccacagctctaagaggggcagcaaccttgaaagcaagagctttgaaggaggtatggaatattgccactgtgacaccactagaaagaggcatagggggaattggactatgtggtaaaagtattaacagtaataccagtaataccagcaataccagcactagtgatagtggggaaattttcaaaggagaaaattttccagggtcctgcagccaagatctacttgctaagggcagtgaattactcaagcgcacccgtaaaggtgatcttcactggaaaatagtgtctgtttatatacatcgaacgggccaggtaatgctaaaaatgaagagcagacatgttgcaggaaccattaccaaaaagaaaaagaatgttgtgttagatatatgcgcggatttaccagcatggccaggaagacatcttcttgatgatggtgaaaagcgacggtactttggattgaagacagatgcaagagggattgtggacaatgaggaggacaatgtaaagagcaaggcctccgggggaggaaacgaagaaaagagcgatggggcgaacgaagacgacgacggaggcgacggcgatggtgaggagcaactgaatggtgaggatggtgtagaccttgcgaatgaaggcccaacggagttgagggttctcaagcatggcggggtagagtggcctgggattggcattgccatccccaccgctttcaacatctcttttcatcaacatgttttctttctttcctcagtgcttagcctactaaaagggtgtggtgctgttgtggagatccgagatttgtttcgtctcttatgccccatgaggagtttcttccctgctgaatcctgtaaagaggctcacccaaatgctttgaatcctcagtcttggcttcatattgaaagagggaaacttcccaagttgtcatcacacccctcatctgcctcaattgaatctctgatcaaggtcccacagccagctatactgcctttctttaagcctgttgattatgtggaagttttagctcgaatccatgaagaactcgagtcttgtcctccgcaagagagatcaaacttgtttttgttacaataccaggtcttcaggggccttggggaagttaaattgatgcgtagaagcctccagggagcttggcagagagctcacactgttcatgagaagattatatttggggcatggctgaaatatgagaagcaagaggaagagctaatggctgacttgcttgcagcttgtggtaaatgtgcgaaggagtttgcacctgtagatatagcatttcatcttccatttgatgtaaatgcaagttctgaggggagaacgaccaatgagaaccgcatttctcaaaatgttacttttacgattggaagtgaaaagatagtttgtgatagacaaaaaatttcagaactttcagcaccatttcatgcaatgctcaaggggcatttcagtgaatcactctctgagacaatagatttgtcagaaaacaatatctctccctcaggtatgaaggcaataagtgatttcagtttgaatggcagtttaattgaggtccctccaaatcttttgttggagatattagtttttgcaaacaagtattgttgtgaaagacttaaagatgcttgtgatagaagacttgcatccttagtttcctccaaagaagatgctgtggagctcatggaatatgctcttgatgaacattcaagtgtccttgctgcatcttgtttacaagtccttttgcgtgaccttccaaactgtatgaatgacaatcgggtggtggagatatttgttcatgctaataagcagcagctagaagtcatggttgggccaggtatatttgcacttttctgtttcttaagtgaagtttctatgaaccttaattctagttcagacacaacagctcatttcctggaacggttagttgagtttgctgagaatggcaagcagagacttctagctttacatcaattgggatgtgtaagactcttaaggaaagaatatgatgaagcacgttgtctttttgaaggggctgtaaatgcaggccatatgtattctgtggcaggtttagctagactggactatataaagggtgacaagctgctatcttatgggcaacttagctcagtcatttcatctgttacttcacttggatggatgtatcaggaaagatcactatactgtgacggtgacaaaaggtgggaggaccttgagaaagcaagtaatttggatcctactcttatatatccttacatgtacagagctgccactttaatgaggacacagaatgctcatgctgcactagcagaaatcaatcggattcttgggttcaaactttcactagaatgcttggaaatacgattttttatccacctttctcttgaggactataaagcagctctatgtgatgttcaaacaattcttactctgcgttcagattatagaatgtttgaggggcgtgttgctgcatcccaactctgtactcttgtgcgtgagcatgttgaacgttggacaactgcagattgttgggcacgattatatgattgttggtctgcagttgatgatattggatctctatctgttatctaccagatgcttgaatctgatgcagcaaaaggtattctatacttcagacagtcattgcttctcctaaggttgaactgtcccgaggctgctatgcgtagtttactgttagctcggcaacatgcatcaagtgagcatgaacgacttgtatatgaggggtggatcttatatgatacaggtcattatgaggaagggctccagaaagctgaagagtctattgacatcaaaagatcttttgaggcctttttcctgaaggcctatgcattggctgactctagtatagatccatcatgttcaccaactgttatttcacttctggaagatgccttgaagtgtccttcagataatctgcgcaaaggtcaggagagatctctccaagggtttccccttcgtaaatga

SEQ ID NO: 54945 - DNA, 2073 bp, Glycine max
  Peptide Sequence Number=SeqID_146630
atgggtaacgcagactatgcatacccttcgggtatgaacgtggagtgcgtgcaccgagtggccattcctccccctcaacccttcttcaagtccctaaagtactctatgaaagagacttttttcccagatgacccgtttaggaagttcaagaaccagccagcctctaagaggttcctgcttgggcttcagtacttcttccccatctttgagtgggcacccaaatacaccctccacttccttaaatcagacctcatctctggcatcaccattgctagcttggccattcctcaaggcatcagttatgccaagctagccaacctccctcctgttcttggactttattcgagctttataccgccattgatctatgcaatgatgggaagctcaagggatttggcagtgggaactgtggctgttggatcgcttcttatggcctccatgttgggtcgagtggtcaatttcaacgagaacccaaaccttttcctccacttggctttcactgctacgttctttgctggagttttgcaagcatcactcggtctcttcaggaaccatgtggaggagtgcaggttagggtttatcgtggattttctgtcacatgcaaccatagtagggttcatgggtggagcagctacagtggtttgtctgcaacagctaaaatcaatccttggccttgagcattttacccacgaggccgatctcgtgtcagtaatgcgctctgttttttctcaaactcatgagtggaggtgggaaagcgctgtgttaggttgttgctttattttcttcctcctcgtcacaagatacttcagcaaacgacagccgaagttcttctgggtgtcagcaatggcaccactgacatccgttatactgggaagtctgctggtctatctcacacacgctgagaagcatggagttcaagtgataggaaatttgaagaaggggctgaatccaccttcggtgacggatttggtgtttgtgtcgccttatatgggcactgccataaaaactggacttgtcactggcattatcgcacttgcggttaagtatctcaacctcatttcctttggtagaggtcatgtcagcaaggccttaaggacagaattaattgatcttgtgcaggaaggaatagcagtgggaagaagctttgcaatgtttaaaaattatcatattgatggcaacaaagagatgatagctattggaaccatgaatattttcggatcgttcacctcttgctatctcaccacaggaccattttcgcgttcagcagtgaactacaatgctgggtgcaagactgctgcatcaaacattataatggcaatagcagtgatgttgacattgttattcttaacacccttattccatttcactcccctggtggtgctgtcagccataattgtatcagcaatgctcgggctcattgattatcaagcagcaattcatttgtggaaaattgacaaatttgatttcttagtgtgcttcactgcttatgttggcgtagtctttggcagtgttgaaattggcctagtcatagcagttgcagtatctctacttcgagtacttttatttatcgcaagaccaaggacatttctcttaggcaacattccaaattctgcagtatacagaaatgtggaacaatatccaaatgcaaaccatattcctggaatcctaattcttgaaattgatgcacccatctactttgccaatgcaagctatttaagagaaaggatcacaaggtggattgatgaagaggaagatagaatcaaagctacagggcaaaccagtttgcaatatgtcataatggatatgactgctgttgctaacattgatacaagcggaattagcatgcttgaagagtgcaagaagactactgacagaagagggttacaacttgctttggtcaatcctggaagcgaagtaatgaagaagctgaacaaagccaagttccttgatgaactgggtcaaaaatggatctatctcacagttgaagaggctgttggtgcatgcaacttcatgctccatacatacaaaccaaacaccatgaaggatgaatcagaaggttggaacaatgcctaa

SEQ ID NO: 54946 - DNA, 1086 bp, Glycine max
  Peptide Sequence Number=SeqID_146631
atggaatccgaatccaagaacgacaccgaagtcgctccggccttaatcgccgttcaccccgaccaatcctccgtcgccgtcgctgtgggcccgcacctccgcgtcttcgacctcctgtcctccgagaagagagttactgcagttgcaattagcaacgacggaacattcgtgtgcttcgccgacaaattcggcgttgtttgggttgtggatgttgatcctccgttacacgataagaaaccggcaccgcttctttctcactattgcagtatcatcactagcttggaattttcaccggatggtcgttttattttaagcgccgatcgtgatttcaaaattcgcgttactaattttccccagaagcccttaaatggagctcaccagatacaaagtttctgtctcggtcatacagagtttgtttcctgccttgccttcattcaggctcaggaatgccctcaaggccttcttctctctggcagtggtgattccacagttcgattgtggaatattgactctggagcacttctagatacttgtgaggttgcaatcaaggcagggcttttagagtctaatggtaaagcagaggagcatggccatgctgttattgatttatgcactgtcctggatggtttgattgttgcagtggccattcagagcttgcaaggaatagtattgctgagttgcaatgtttgtgcacaaactctttcttttgccaaggtggtttctgttgctggagaggcctttgtccctacctgcttggggagcagcccctctataaggaaattgtggatggttacaggtgtctctggtctacctggttgtaattatctctctttggctcgtgtgcgagtaatttctggtattgatgttgagcaagagccagttgttccgggagatgataacatacccgggggagaaaaactactagaaacgctgcaaggatctgcatccgttgatgacagtgcttttctagcaacagctgaagctgtcaaaacagcaatgtgcaacctattgataaaaaaacaatacccttcagagaatagagaatataggaagaaaagcagaaatgatagaaaactaaagggctag

SEQ ID NO: 54947 - DNA, 351 bp, Glycine max
  Peptide Sequence Number=SeqID_146632
atgagttgtaacgagtgtcgcgtccttcgaaagggttgcatcgagtcttgtatcctgcggctgtgtctacaatggatcgatacgcatgaagcatctatgatatttttttcatctctgtttcaatctctgttgtgcgaagcgtgtggaagaacgatgaaccctgtcaacagtttgaggtttgataagggtggtttcgacggtaaacacaagcaatttgaagagctcgccaagcttcagacgacggaaattcactggtcaggatctccgtcaatgaactccaaggagtttgagacgatgacatcgtgtttggagagcggaattgaagataactatgcccccgacgaagactga

SEQ ID NO: 54948 - DNA, 1343 bp, Glycine max
  Peptide Sequence Number=SeqID_146633
ggctaagtacgggtctttcaacattcaagggtggtggggtgcatttgtttttaagaggtggagctcggagaggtttggtgatcctaaagcaaaattggatggtttgataagcaatatcaacatgttggatttgaaggaggaaatgatggtctttctttggagatggcatgaggcttatggaaataccaagttcttccacaacatgattaattggagaagaaggttcaaagaacaaggaagcatgcaagtattgttggatgaggtgcaattcaagtccattaatgatgaagacaacaacatgcttactcaaatcttttcgaaggaggagacaaagaatgtgatttgggatttgaatgttataacggccatcagtgagttccatggccatggaagattgccaagaggaaccgatgcttcgtttctcatgcttactctcaagaaggataatccacaagacttaggggaatttagacctattttccttatagttcttggggggaaggaatgttttgaatatggggttttggttgcaaataaagttgttcatgaggcaaaggcaaagaataagagatgtcttattttcaaggttgacttcgaaaaggcatatgatttcgcgaaaggaaaaaatgtactttctgatgttgggattaggaaaggaaagttgagggtgtctctcttgcaatatgtggaggacgacatgagggatacactcattttgaaagctacacctagatactttgaattagcattcaggcttaaggagtattccatttgtctatttgggactactggttggagcagatgcaaaaaagggaaatggatgtggagatttttgagtgaaaatgacagcttgtggagagatgtgtttctaaaaaaatataacatcaagtgtgaggatagccttgtgggagggtgttatgggaaaaagggttctcaatggtggtgtgaccttacgggtgcgagatggcttagtgtggagtgtcttaggtctacgcttaaccgtttgtttttgaatttggaacaaaaaagccacaagatttcggatatgggttattggtgtgaggggggtccaaacaacggacaatttgctaaaaaggaatatcattcctggtggctcggactcaaattgtgttttttgcaactcttgcttggagacagccgagcacctttttcttccattgcaagttttctgattcactgtggtctcaatgttatcaatgtgtataggcctcgatcgtttgagcaatatggaagcagcggaacgatattagatttaaccaagggctgtgctattctgaggcaacttttgatgcatcacggtacagagcctggacttggtgcag

SEQ ID NO: 54949 - DNA, 189 bp, Glycine max
  Peptide Sequence Number=SeqID_146634
atgacggaggagttgacgccagacgcgaccatggctggagacgcgaccatgtccttcattggccggaggtggtggcatgaagtgacgttgaggccagacgaaggtgttgcggtggtggccggagatgctgacaccgacaaaggtcatgcgagacaaataggccatggcgaagaggaagaagatagatag

SEQ ID NO: 54950 - DNA, 315 bp, Glycine max
  Peptide Sequence Number=SeqID_146635
atgaaaaaggaaagtgagagtgaccttgatggtgaggtcgggagggaggggccaggagagggaattgtggttggaagcgcgtttgcgggaggagtgtttggcggcgtcgaggaggagagaggccattttgagggcgcgatcgatgagatcggagtcggcgtcggaggggaccgattggaggagcctctcgaaggagagatcaagggagagagaagccacgtccgagagggagagaaacgcctcaagccgacgctccacctctcccaggttctccgctctagggttttgggacggacacggacgcttcgacattga

SEQ ID NO: 54951 - DNA, 1842 bp, Glycine max
  Peptide Sequence Number=SeqID_146636
ggtagtctagcaacgttaaagtttcgtgagattaatgtggaagatgacatagaagaggagcaagacatcggggtttttgtggcaaatgagatcaagaagagagtggacactatcaaatcaatattgggttccatggaagatggagagataacagtatctgcttatgacactgcttgggttgctctgatagaagatgttcatggaagtggtgctcctcaatttccatcgagtctagaatggatagcgaaaaatcaacaccctgatggttcatggggtgataaggaattattctcagcccatgatcggattattaacacgttggcttgtgttattgcattaaaatcatggcatatgcaccctgaaaagtgtgagaaaggaatgacattttttaaggagaatcttaaccagcttcagaatgagaatgtggagcatatgccaattgggtttgaagtagcttttccatcacttcttgacatggctcgtggcttgaacattgaagtgccggacaattccccaatcctgaacaaaatcttcgcaatgagaaacgtaaaactcacaagaataccaaaagcgatgatgcataaagtgcccacaagtctgcttcatagcttggaagggatgtcaggccttgactggaaagagcttctaaaactgcagtctcaagacggttccttcttgttttctccgtcctccactgcctttgctctcatgcaaactaaagaccaaaattgccacaattacttgaataaagtggtcaagaggttcaatgggggagttccgaacgtgtacccagtggatttgttcgaacatatttgggtggttgataggcttgaacgcctcggaatatctcagtattttcagcaagagatcaaggactgtttgaattatgttcacagaaattcaaatgttcaagacattgatgacacggcaatgggtttcagattactaagattacacggctatcaagtttcagccgatgtgttcaagaactttgagagaaatggtgaatttttctgcttcacggggcagactacacaagccgtgacaggaatgtttaatctatatagggccacacaagtaatgttcccgggagagaaaattcttgagcatgggaagcatttctctgccaaatttttgagggataagagagcagcaaatgagctagtagataaatggatcataatgaagaacctggcagaagaggttgcgtacgctttggacgtaccatggtatgcaagcctacctcgagtggagacaagattctacattgatcaatacggtggtgagagtgacgtgtggataggcaaaaccctttacaggatggcctatgtgaacaacaataactatctcgagcttgctaaattagattacaacaattgccagacactgcatctaatagagtgggggagaattcagaagtggtactcagaatctaggttgggagagtttggattgaacagaagaactcttctgttggcctattttctggcagcagcaagcatatttgagcctgaaaagtctcatgtgagactagcgtgggccaaaaccagtgtcttacttgagaccataacatcctatgttagtgatgcagaaatgaggaaagatttcatgaaaaaattcagtgactgcattaacaggcgagactactccatgggctgtgacagtgagatgatgtccagtaagaaagtgaaggtctacaattcagtgatcgatgttggatatactctagttgtagctagcacatggttgagagtgagtcatgactatgtcatcctaatagagaatgagcttcttttaaatactgaatattttgaaacccttgacatcggcatgaacaagtga

SEQ ID NO: 54952 - DNA, 150 bp, Glycine max
  Peptide Sequence Number=SeqID_146637
atggttagaagaagagaaagagggaaggtggcagtgagtggagaaagaaaggcagagtttaaaaggaagggaagaggcaagcagacagaaatgacttcccaagagattcccgctaatggttgcatggcatcatctaaaactaaagaataa

SEQ ID NO: 54953 - DNA, 375 bp, Glycine max
  Peptide Sequence Number=SeqID_146638
atgggaaagtatgaaacaggggcacgtaattcacagaatcacattattccacttcaatcagaagaccacaatccactagcaacaggcaatcacaatttcagttacaatctgctgaatcgttttgacgagtcaattgagcgtaacaaatccaagcagagaaaagaaaaggaacagttaaggaatatgaacgaactcttggtaagcggagaggatgaaacagaggcgaagaggactcggccgagaaaagaagagaacgccattttagagagagagagaggaaatctagggtgcttgaagaaagctgatttttcttttcccggtcagagtgagaacgaaagagaaggagcgagcggaccgaaaattgaaaaagggtga

SEQ ID NO: 54954 - DNA, 408 bp, Glycine max
  Peptide Sequence Number=SeqID_146639
ccgccatctccttcaacctatgaagcacggggacgggacgaggacgagatgggtacagcaaggggacggccaagagacaatgttgacttcttgggggtgacctttcgtagggacgtattgagattgcagctgattccgctccctctctccaccagccaattgcagagtgcagaacttccgcacgagctagcatcaacaggagaatcgcactctagaaggttgtgcggtggcagcggcgtacacgagcaggagaaccgcgcgcacgaagttggtggagtgcaggttgatgcggtgggaacacggtggagaaccaccagccaacctgccttgtcaccgaatgtggtgaaaaaggttggtgagaaatatagcctcgtgcgtgatttgaatggaaagttgaggcttttgtag

SEQ ID NO: 54955 - DNA, 2136 bp, Glycine max
  Peptide Sequence Number=SeqID_146640
atggtggaacatgctaatcagggatctaagtctcctgaattctggccactgcttttgggtttaactgggaatcttgcatctagccaattttcctccccctcctttgaccatgaagttcgtatatctactaagcaaggtggtcaaggtgctaaaggtttggcttggcaccatgccaagtgtctcatcgatctgtcaccatcaattgaagtggataagttatctggatggaacaatctctcatcttctgatcaatcagctgtcattgacttcgctaaaaagggtggtagtgatacaaaaattgagactgaggagggtaaagaatccacaccacaacaaacttccaaaggtggcataaaacgggggaaggatgttgatagtgagcggaaatcaaaagttgctaaggccaagggagatgtgtctgtgggcagcgcaatgtcagtgaaatcaggggaagcatgtgatctggagaagaaaatggagacccaaagcaaagaactctgggatttgaaggacgatctcaaaaagcacgttacaacaacagagttgcgtgaaatgttggaagccagtggtcaagattcaacaggatcagaacttgatttacgtgaccgctgtgctgatggaatgatgtttggagcacttgatctttgcccaatatgttctggctttctgcgttactctggaggaatgtaccggtgccatggatacatttccgagtggagtaaatgttcttactctacctgtgaaccaaaacgtattgaagggaagtggaaaatcccaaaagaaacaaataatcagtaccttaaaaagtggttcaaatctcaaaaagggaagaaaccagttaggatattgcctcttccatcaccaaggaaatctgctgaaagtcaaatgattgctagtcagcatcaatcatcaaatagtggaaatttacgagatttgaaagttgctatctgtggattacctaatgactctattgcggaatggaaatgcaaaattgatggcatatgtgggatgtttcatgcaaaagtaaataaagatactaactgcttggtggttggtggatcactcaattatgaagctgagatgcggaaggcaaggaggatgaaaataccaatagtcagagaggactatttgattgactgcttagcaagaaagaaaaggcttccatttgatatgtacaaggttgaaatgattggtgaggcttctagcatggtcaccattaaagtgaagggacatagtgctgttcacgaggcttctggcctacaggattccggccacatacttgaggaagggaaaagcatatataacacaactttgaatatgtctgatttgtctactggtattaacagctactacattctccagataatccaagaagataaggggtcagattgctatgtgtttcgtaaatggggccgagttggaaatgacaagattggaggaacaaagctggaggaaatgtcaaaatctgatgcagactatggagttaacaaacaggtctcaaaaaaggaaaaaaatgatgtcgacagcaaactacctcctccattaatagaattgatgaagatgctctttaatgtggaaacatacagagctgccatgatggaatttgagatcaatatgtctgaaatgccacttgggaaattgagcaaaagcaacatccaaaaggggtttgaagcattgacagagatacaaaatctgttaaaaattagcaatcccgatccatcagtcaaggaaagcttacttattaatgccagcaatcggttcttcaccatgatcccttctgttcatccacatattattagggatgaggatgactttaagtccaaggtgaaaatgttagaagcccttcaagacattgaaattgcctcaagattagttggatttgatgccaacaatgatgattccattgatgataattataagaagcttcactgtgatatatctccacttcctcatgatagtgaagagttttgtttaattgagaagtttctccataatactcatgcccccacacatacggactggagtcttgagctagaagaagttttttcacttgaaagggaaggtgaatttgataagtttgctccttacagggataaacttggaaacagaatgctcctatggcatggtaggttgtag

SEQ ID NO: 54956 - DNA, 138 bp, Glycine max
  Peptide Sequence Number=SeqID_146641
atgaatgaagttccttctggattacttgaccttcgcacctatgttggtgaacgctttgattccttggatggtcgcatagatgccattgatgctcgctttgaaggaatggatacccgtatcactcagcttgaagaggat

SEQ ID NO: 54957 - DNA, 153 bp, Glycine max
  Peptide Sequence Number=SeqID_146642
atgactaaagcacgccaaaagggagtacggaaagaaaaggaaggagatgcttgccacccagctcgcccaggcgagctaggttgcttcctccagaagcaaccgccttctggaggaacatcttggaaggcccaagtgggcctggttgctatttga

SEQ ID NO: 54958 - DNA, 225 bp, Glycine max
  Peptide Sequence Number=SeqID_146643
ttctacggagtgccggtcacccccggcaaggtcatcacctcccctactaatcaagctttcatcaagaagtactgcgcccccaggcaggcacaaggcgaaacaccacagcagcctggggatggctggcagcgggcaacaaacgcactgccaccacctttagagttcatctcagctcatccacaaaaaaggttagagcattgcctacgacacatggccgaccaatag

SEQ ID NO: 54959 - DNA, 266 bp, Glycine max
  Peptide Sequence Number=SeqID_146644
atgcgggaatatttttgttataggctgcagtcaagaaccaatgaagatcaaactatacttcatttaaaaagattgtttcaacaatggattgttgatgggtattgtatgattgagtctcaaaaaataaactatgttaggcaacatcaacaacaactcagagttgacaagtacatcaatttaaatacctctaataatgatcctgaaacacttggtagcgaaaaaggaaagagaattatactgccaagtagttttgttggtagccagag

SEQ ID NO: 54960 - DNA, 204 bp, Glycine max
  Peptide Sequence Number=SeqID_146645
atggagaactacgacgatcgcaactgtcagattctggacatctgtcctttgaacctccagaccacatttcaagaagatccaacgattaacgaatgcaggagagcgcttttaccaagatggttttggacaacttccttgagaagcttcattaagaggcttcctcgtaaggcttctttgggaagctttcttgagaggcttctttga

SEQ ID NO: 54961 - DNA, 360 bp, Glycine max
  Peptide Sequence Number=SeqID_146646
atggttgatcagaccaagagcatacaaaatttaagcactgaaagaagcattgaacacaagaaacacaatcaattagatattaaaaattctgcactcaaggccttgtaccctaattctgatgaagacatgaccaagaacaagggcaaggatccacttgaaggacttggaggacttatgacaagggctagagcaaggaaagcaaaggaagctcttcaacaagtgttgtccatactatttgaatacaagcccaagtttcaaggagaaaagtccaaggttgtgagttgtatcatggcccaaatggaggaggactcaatggcgccactccatcttaattttagagtgtttagttcgtctaaataa

SEQ ID NO: 54962 - DNA, 237 bp, Glycine max
  Peptide Sequence Number=SeqID_146647
gtgacgtcatccgaggaagaccctgaggaggatcccgaggagctacctcctgagcctgctgtggatgctcttgactttctagagggtgatgaggacccacttcctgaggtggattctcccgaggtagtcatgtcggcatctgaggcagactctacggaggatagtggcccgggagagatggcgaccagtggaggctcttcatcatactactacagtggacacctttgctctggatga

SEQ ID NO: 54963 - DNA, 228 bp, Glycine max
  misc_feature (35)..(35): n is a, c, g, or t
  misc_feature (47)..(47): n is a, c, g, or t
  Peptide Sequence Number=SeqID_146648
atgagaaagcgccacgcttcccgaagggagaaagncggacagggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtga

SEQ ID NO: 54964 - DNA, 419 bp, Glycine max
  Peptide Sequence Number=SeqID_146649
atgaatatcttgacggcacaggatcaagagtgggaacaggagttaagtccttacaatcattatgaagaagaaagaactcttaatcttgaaagtgtgtttgaggaattcatggtataccatgccagctcaaaagctaatcaaaactcaatggaaaatcatgaaattcattttgaaagaggatccaatctggataaattgttgatgcaattcatggaaacaactaaatcaactcagcgagcacttcaaagtgtagaaatccatgttggtgagctggcagaagcagtgactcaatttatggtcagacaagaaaaatcctttgtagaggttgaagctcaaaagaaaagcccagtaaaaaagcatgagtcaagagaaaaagatgaggagaaagatgaggaacaagcacaacaacaatgggagaa

SEQ ID NO: 54965 - DNA, 405 bp, Glycine max
  Peptide Sequence Number=SeqID_146650
atgccaatctccccctgcaaaagtatcagttggtctgtgtcgtcccgacatggggatcgcaccccacaagacaccccagtggaccccggaaaagtccaacagggccctggggtttccagctctgattacgggcctctatcagtcctacagggtgcccgtacccccccggcaaggtcacgtcatcatagggatcgaaactgcaagacacctagtggacccgaagaagtccaacagggtcttggaattttgtacggagtacctgtcacctccagcaagggcatcaggccccctactaatcgagctttcatcaagaagtactgcgcccccgacaggcgcagggcgcacccccccagccgcattgggatgatcggcagcgggaaacagacgcaccaccatcacctttag

SEQ ID NO: 54966 - DNA, 391 bp, Glycine max
  Peptide Sequence Number=SeqID_146651
atgccggagttggtgaacagcagggtcggatcattgcccggcaccagcggcgccgacggcacgatggtgtggcctttgcccttgaagaattcaaggaagtcgctgcggatctgggaagtcgtgaatttggcggatgcgttcattgggggctggcaggtatcaggcccggcgccgccagtctcagtcatccgggtcgtagcgggtcgcacggcggatgctgtcgccgtcgaagccgcgtcgggccagcagatcggcggccttgcgccgctgcgtcaggtcctgcgggccggcctcgccaaagcgtcggcggaccagatcacgggcattttcctgccagtcgccttcgtagctgtccatcgccgcggcaatcgcggcactgtccaggccgtgg

SEQ ID NO: 54967 - DNA, 240 bp, Glycine max
  Peptide Sequence Number=SeqID_146652
gggcaagaaatttatagtagccaagatgaggctactacttcaccttcctctagtgaaagtgaagaagcaaaaagggaagaatctagtgaagaaatctaccccaagaagaaggagtggatgatgcaatcctaccccctaatggcattggatagaagactccaagaagattgggccagagctgctgaagaaggccctagggttctcaatagccttagggtagattttggagctgtgggctaa

SEQ ID NO: 54968 - DNA, 570 bp, Glycine max
  Peptide Sequence Number=SeqID_146653
gatgtgcgcatgaaggcacatgccatccagaagcagaatactgccccccacgttttgtctcgtgggggttatgattatttggagcagaagctcctggctgagaagaccaagaagaagatgcaggaagctgcacaatcaggaagcgttgatggcgtcatcgaccctccatccccggtcagacgccacatgaagtggaagatggcccgcacgaagaagacaggggagatgacgactgaggccgcaaaggaaatcgctgagaagattgattcgtttgaggagcaggccacacagggatcgttcgtcccccatggacgtcaggatgttctggccgctgctattggacgtccagagcaccctggacgtgtccgtggtattggagccggtgtcaccatcaagcaatactttggatcggctccacggacatcccgcagcgcttcctccctgtctcctgaagaattacaccagctgactcaacagatcagggaccagctagaggagtccatcacagagaaagtgatgaggcaggtcatggcatcctttcaaccaccttcagtcgcagatgcaatctga

SEQ ID NO: 54969 - DNA, 396 bp, Glycine max
  Peptide Sequence Number=SeqID_146654
atggcgcctcctctcacatcttctcctttatcttccgccatggttcaaaagaaggacctcattgaagctcaaagatccaacctccataaaagcttctcaagcatgtttccatcaagtgatatcagagtacaagagcttcaaattcaattaggcttttactataatgttaagaaagtaaagaacaaaaatagaaacttaaccaaaaggaagaagaagacaaacacaagaattttatactggttcggcaacaacccgtgcccacatctagtccccaagcaacctgcggttcttgggatttctttcaaccttgtaaaaacctttacaagcaaagatccacaagggatgtaccctcccttgttctctttgaacaaccaagtggatgtaccctccacttga

SEQ ID NO: 54970 - DNA, 195 bp, Glycine max
  Peptide Sequence Number=SeqID_146655
atgagggatggtagaagatcttcgtacgtcattgggagcggggtgaattccggcaatggcctcggagggaagttccttgtcgtgttggaattaccggccggtcgagtcgtgttcggagttggaacttggggagcttccctctggaggcgttcccagcatgagccgagaagcttgggtgtatgttgcgcgtactga

SEQ ID NO: 54971 - DNA, 252 bp, Glycine max
  Peptide Sequence Number=SeqID_146656
atggagggggattcagtcatacacacagtggcatatgcagatgatgttgtcagggttccacaaagtattccacacaacgaggatgcacatgtgccgaagccggctaatgtggacgcagatgatccgttgcgtggattgataaagtacagtttcgatatttacgacaacccacttgaaatcagctttgatgggagctttctttggaattgtagatgcatctacatcgatattcatcacatattcagatgttag

SEQ ID NO: 54972 - DNA, 282 bp, Glycine max
  Peptide Sequence Number=SeqID_146657
atggggcttgggataagatttctgggtggaggatacacgaacagcgctaggcaatcaattcgaggggctccaaactcgatggtggaggatgcatgcaagacaatcaattcatgggtttccgaaaaagcaagcaattcgtggggctccagactcgatggtggaggatgcatgaatgacaatcaagtcatggggctcgggataagatttgtgggtggaggatacacgaacatcgctaggcaatcaattcgttgggctccagactcgatggtggaggatgcatga

SEQ ID NO: 54973 - DNA, 276 bp, Glycine max
  Peptide Sequence Number=SeqID_146658
atggcacgcagcgtgtttgcttcgtgcccctattttagggacctacatgggagggagctaaaaaggcttttagtgataattcccaaggtggtcatatctctcttgatggtctctagagtggagtcgccaactgtcgcaacctacccttcggtgggagggcgacgcgtgcctcgcgggatgcgtcttccaagaaaggaatacgcgtggagtagccaccaacgtttatttgaggaaaacgtcagaaaaaccggaaaagacgtggtctacgaactttaa

SEQ ID NO: 54974 - DNA, 354 bp, Glycine max
  Peptide Sequence Number=SeqID_146659
atggaggtccgtgacattgatgtcaagataggagatgaagatctgacaatgattctgttagcctctcttcctcattcctatgagaattttgtgagctctcttaggtctatgcattcggattatcggtggcttattctgctaaagtgtaggagaagaagaaagacaaaggacatatgtaattaccacaaagaacctagtcattggaagaaagattgtcctaagaaagcaaagaatgattttgcttacgccattgttcagaatgacccctcttctaaaaacgatttggttatgtctgttggtgaacaactagaacaacattttgaacaatgggtattggattctgttggaaaataa

SEQ ID NO: 54975 - DNA, 138 bp, Glycine max
  Peptide Sequence Number=SeqID_146660
atgggtgccaagcacctcacgaggaccaaagaatggtcgcacgtcatcgagcaaaggtccccggacgaaattaggggccctgttggacttcttcgggtccactgggtgtcttgtgggcgcgatccctgcaaacaatag

SEQ ID NO: 54976 - DNA, 516 bp, Glycine max
  Peptide Sequence Number=SeqID_146661
atggcagcaaatcggtggaatattttcgataaattcacggggaaattgaaaatgcttggggatggaaatgaaggaatgttcattgatcggggcttaccagaagggctttttaagtttccaaaaattgaggatacagatcaagaaattgaatttcaattatttgtagaaacatatcaattattagaacccttgataaacgaaaaagatgctgtatatgaatcgcttacatattctgctgaattatatgtatctgcgggattaatttggaaaagtagtagggacatacaagaacaaactatttttgttggaaacattcctttaatgaattctctgggaacttctatagtaaatggaatatacagaattgtaatcaatcaaatattgcaaagccctggtatttattaccgttcagaattggaccctagcggaatttcggtctatactggcaccataatatcagactgggggggtagattagaattagagattgatagaaaagcaaggatatgggctcgt

SEQ ID NO: 54977 - DNA, 612 bp, Glycine max
  Peptide Sequence Number=SeqID_146662
gatttcgctcggactgctgcaggaagacgggtgcggatcatgcgcaccagcatgaccaccttgacccagatgtggatgacattgctgctcaacgatatcttgcctagtgatcataactccgaccttcctctgccgaagtgtcagctggtgtatgtcatcctgtcacggatgagagtccatctagctcagttgattgctaacgccatctatttgtttgcaggtatgccacccaccaagcaccctctagaccctgataagtctaacaggactctggggtttccagcattgatcacgggcctctgccagtcattcggggttcccgtcacacctagtaacgtgatccgaccgtcgatcacccaggccttcattgagaagtattgcatgtctaggcaagtgcagggcaatgcaccgcaggccacagacgtaccaccaccacctcatcaggctgatcctgctgagtcattaggcatggagcggtatctacagcacttggttcgccagcaggcgaccaaccaccgggggcaggtgcagatacatgagtgtctctaccagctcagcctcagtcagcagggccagggtttcgttccttttgcgtgccctactccagattag

SEQ ID NO: 54978 - DNA, 249 bp, Glycine max
  Peptide Sequence Number=SeqID_146663
atggcacaacaagaaagacaggtgttttacgtccaagatccttgcgattcaagatattcagtggttctacaaggcagaccaagtggtttaaatgacagacatgatggttccacacttgacatttgtgaaactacacctttttccacaaaaattccttctactgatgactcattacacattgatgaggatcatggcaacaccaccagcatcccctccgcagtccaatcagcagtcagaggcgatgtctag

SEQ ID NO: 54979 - DNA, 678 bp, Glycine max
  Peptide Sequence Number=SeqID_146664
atgaatgaaccgcccggagctcgtatgagagttggtttaactgccctgactatggcggaatattttcgagatgtcaatgaacaagatgtacttctatttatcgacaatatctttcgcttcgtccaagcaggatctgaagtatctgccttattgggtcgaatgccttctgctgtgggttatcaacccactcttagtactgaaatgggttctttacaagaaagaatcacttctaccaaagaggggtccataacttctattcaagcagtttatgtacccgcagacgatttaaccgatcctgcgcctgctacgacatttgcacatttagatgctactactgtactatcaagaggattagcggccaaaggtatctatccagcagtagatcctttagattcaacctcaactatgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggtaatatcgatgaagctactgcgaaagctacgaacttagaaatggagagcaatttgaagaaatga

SEQ ID NO: 54980 - DNA, 882 bp, Glycine max
  Peptide Sequence Number=SeqID_146665
atgtgtagtcctctaaaggtgagggcgtgtagccctctgataggaagggcgtgcagtcctctgcaggtgagggcgtgtagccctctgatggtgaggacgtgtagccctctgaaggggaggacgtgcagccctctgatggtgaagaactgcagctctctaaaggtgaggacgtgtagtcctctgaagatgaggccgtgcgaccctctgatggtgaggatgtgcagtcctctgaagatgagggcatgcgaccctctgatggcgaggacttgtagtcctctgaaggtgagggcgtgtagccctcttaaggtgaaggcgtatagccttctgattgtgaggacgtgtattcctctgatggagaggacgtgtagtcctctgaaggtgagagcatgcagccctcagctggcagggacgtgtagtcctcttaaggtgagggcgtacaaccctctaatggtgaggacgtgcagccctctgatggtaaggacgtgtagtcctcagaaggtgacagcgagcatccctctgatggcgaggacgtgtagtcctttgaagatgagggcgtggagccctctgatggcaaggacgtgtagtcctctaaaggtgagggagtactgccctctgatggcgaggacgtgcagccctctgatgccaaggacgtgtagtcctctgaaagtgagggcgggcaaccctttgatcgcaaagacgtgtagtcctctaaaggtgagggcatgcagccctctaatggaaacaacgtgtagtcctctaaaggtggaggcgtgcagccctccgatggcgaagacgtgtagtcctctaaaggcgaggatgtctagtcctctgaaggtgagagcgtgcagccctctgattgcaaggacgtgcaatcctctttaa

SEQ ID NO: 54981 - DNA, 384 bp, Glycine max
  Peptide Sequence Number=SeqID_146666
atggcgggaaggcgtgccaattgctctttcatggcctccatgtcggccttcatctgctcttgcgcctcctctacttcacccattactctagctctagcacaggacatggggttgaatcaatttagatttttcaatatggttcatgacatcttggtcaaggtgaaactggaagtaacaaggacatcaacagtcctaaatgtgtttggcagtagacgaagcagtgatgtaactcgattcatcttttgccccaatttttgcaagatggttacttccatacttcaacttgacttgatgaacttttttcgaaaaagcatgagcttgcttcaacccgataatccaaggaatggcaatttcaatcgccaatactttgacaacatttcatag

SEQ ID NO: 54982 - DNA, 241 bp, Glycine max
  Peptide Sequence Number=SeqID_146667
atggtcgaaagaaaaaatccctatttgacaaggcttcttactatacctatgaattccattggacccacaaatgatacactggaagaatcatatgagtcttccaatatcaatagggtgattgttccgctcccgtatcttccacaaggggaaaagatctctgagagctatttcccggatccccaagagagtactcgggttctcccaacaactcaaaagtatatcatgcctgaatctaactggg

SEQ ID NO: 54983 - DNA, 213 bp, Glycine max
  Peptide Sequence Number=SeqID_146668
atgaagaagcaacaatggaatagaagcttctatggaggctggatctttgaacttcaaaggagaagaggagaggggaggcaccattcacaagggaatcagccatggaagatggagcttcaccaccaagaatgtgccttggataagaagcttgaagacgatgctttaatggaggaaaagaaagagagaggggggagcatgaaattgaaggagtaa

SEQ ID NO: 54984 - DNA, 274 bp, Glycine max
  Peptide Sequence Number=SeqID_146669
atggtcatggacatggctgacacatttggagaagattttggtattcatttcaaccaatggtcatccaatataagagcaagatttaatcatatattcttcagcactttaaagaaagattctcagagcagaatccttgcagaccaaccttggaagggatccaattctcttcccttgatcaaaggcagaaggaaagcctttgttgatagattcactgagctggaaatcaagtctgcagtttgggcttgcgggggagataaaagtcctggcctggatg

SEQ ID NO: 54985 - DNA, 333 bp, Glycine max
  Peptide Sequence Number=SeqID_146670
atggaccaattgagtcaaagctatggtctaggatcggtgtatggattccttgagccgcaggctatactgaatgcaaacgataaatgtggacaatgtcaagaatacattgaaaaatggcttaaggaatcgaaccgagatgtctatctaggcgcttatttgaatcatgcatttaacactttggaaaccaagagtgaggggaaatttggtcacagtacaccgcggtggattgaagtgaagagtcacgttcaaagcggaacctatgagtgtggctattatgtcatgcattggatgtggaacataatcgtcgggcagttgaagactaattggacgctg

SEQ ID NO: 54986 - DNA, 381 bp, Glycine max
  Peptide Sequence Number=SeqID_146671
gcgacaatgaccctcatttacatttcaaagacgacaatgtcttcagtcattgcatgctttcaaaaggcaacaatgaccttcatttacatttcaaagacgacaatgtcttcggtcattacatgctttcaaaaggcgacaatgaccctcatttatatttcgaagacgacaatgtctttagcaacaatgaccttcatttacatttcgaagacgacaatgtcttcggtcattacatgctttcaaaaggcgacaatgaacctcatttatatttcaaagacgacaatgtcttcagcggcaatgctgtcatttacgctttcaaagacgacaatgtcttcatctcaaagactccaatgtcttttgtccttgtgcttcataggactcgac

SEQ ID NO: 54987 - DNA, 397 bp, Glycine max
  Peptide Sequence Number=SeqID_146672
atgctagatctaggagcatcagttagtgtcatgcctctgtccattttcaattctttatctcttggacctttgcaatatacaaatgtagtgattcatttggcaaatagaagtgttgcttaccccgcaggtgttgtacctcttaatgttgattttttagagtcagaatgcactaaccatgttgcaagaagtacatatacttctgacttgctttatgagccaccacccacaccagagttgaagcccttaccagcaaccctcaaatatgcttacttggaggacaaggaaaaatttccagtgatcatctctgcctcccttgatgctaagcaaaaggagaagttgttgctagttcttaagaagcacaagaaggccattagatggactttagcagacattcctg

SEQ ID NO: 54988 - DNA, 423 bp, Glycine max
  Peptide Sequence Number=SeqID_146673
atggcagtgcagttaatccatgatcacgtggtgatggagtgcctagagggagtttgggagaccctcgaaggcaataagaggtgccgattccgtggcacgattcgactcactgctacttcattagtacatccggaggaacccgcacacacgcttcagcagcctgtggagtggatactacctacacctactccatatcgactagtggagccagttcaagtgatagaggtgtcatcctctgaacaagaccctgaagaggacccagaggagttacctcctgagcctactcttgactatccagaggatgatgaggacccactccctgatgtggattctctagaggatatcatgtcagcatctaaggcagactctacagaggagagcggccctggagggacagcaaatagtgaagacttttcatcataa

SEQ ID NO: 54989 - DNA, 141 bp, Glycine max
  Peptide Sequence Number=SeqID_146674
atgggggtgtgtgtagctaaagctctagcttctttaggaatcttttcaaggaagcttctcaaggagcttctcaaggaagttttctcaaagaagcttctcaaggaagttttctcaagaaagcttctcaaggccgctacctag

SEQ ID NO: 54990 - DNA, 246 bp, Glycine max
  Peptide Sequence Number=SeqID_146675
atgattcaagggactaaccgcctaagaattctttgtcttaacacattggagggtacatcctttgtggtactagtagagggtacatctacttgggttgttatacagagaacaagagagggtacatctcttgtggatcagttgaattggagggtacatccacttgattgttcaaagagaacaagggagggattttacaatgttattggaaatcccaagaaccgtgggttgcttggggactggacgtag

SEQ ID NO: 54991 - DNA, 216 bp, Glycine max
  Peptide Sequence Number=SeqID_146676
atgacggttgaaaacctcggacacatgcagctcccggagacgatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 54992 - DNA, 171 bp, Glycine max
  Peptide Sequence Number=SeqID_146677
gaggcttgcgatgcgatcgctgagaggttggagcgtcacctcaacctagggatagtcacgccaggcacatcgacacatgaggtcatcgaagaatgcctcaggattgccagaagtgtcaccgaagaccgcattgcgtacgtgaggtctcgatgtaggcgccgcatggattag

SEQ ID NO: 54993 - DNA, 336 bp, Glycine max
  Peptide Sequence Number=SeqID_146678
atgggaacaaatcaaactggaaaaaggttctatcaagtcaagattaagggcctagatgtcaccagccttaaggagttggggcggttgatgggacctctccaaatgcaagccttccgcaaggcgtacagaaagattttagatttgaccatagcagagatattcacggaagtcgttgtatcactcacccaatactatgaccagcctttgagatgcttcatgcttggagacttccaattagtaccgactattgaagtatttgaggagattctaggatgtcctcttgggggaagattgcaattgtggttggggattcggcaagagagttggatcgtgtaa

SEQ ID NO: 54994 - DNA, 432 bp, Glycine max
  Peptide Sequence Number=SeqID_146679
atggtaccgcagttaatccatgatcgcgtggtgatggagtgcctagagggagtttgggagaccctcgaaggcaatgagaggtgccgattccgtggcacgattcgactcactgcaacttcattggtacatccagaggaacccgcacacacgcttcagcagcctgtggagtggatactgcctacacctactccatatcgactagtggagccagttcaagtgatagaggtgtcatcctctgaagaggatcctgaggaggacccagaggagttacctcttgagcctgctgtggatgctcttgacttacctgaggatgatgaagacccactccttgatgttgattttccagaggatatcatgtcagcatctgtggcagactctatagaggagagcggccctggaggggcagcgaatagtgaagactcttcatcatag

SEQ ID NO: 54995 - DNA, 150 bp, Glycine max
  Peptide Sequence Number=SeqID_146680
atgtcatcggacttgccgtttcttgatgacaataggtgcagaagacgacggcgtctccgcgtgccaacagactcacaggtcacgatagtgaaaggtggggcagttgacaaaagcggggcttttgctcctacctatcctcaatcgcgatga

SEQ ID NO: 54996 - DNA, 434 bp, Glycine max
  Peptide Sequence Number=SeqID_146681
atgggatttcgggcttttatcggccaagtctgcaaggcggctgtgttggccgatggcaaatttcactccggtgaggcgctggcacagcgctttggcgtgacgcgtgccacggtgtataacgccattcaatcggttgaagcgctggggatcacggtgttttcagtacgcggacgcggttaccgcttacccaagcctgtgaccttgctggatgtggagcagattgcgcatgcctgcggtgaatatgcaccatggtttcatattcaggtgctggcacaggaaagcgcacgcggtgtagcacatggtacatgtgtcgctgcacaaatccagactgcagggcgtggccgtcgtgggcggacgtggttatcgcagctgggtggtagcctgacgttttcgctgttgtgggcggtttcagtgtggggcggcaggcttgtcag

SEQ ID NO: 54997 - DNA, 105 bp, Glycine max
  Peptide Sequence Number=SeqID_146682
atggaagtagaatggagatggaagaatgatgattggagacgtcacttcaaggagaagatgagtcaagaagaagctcaccaccatgccatggataagagcttgaag

SEQ ID NO: 54998 - DNA, 487 bp, Glycine max
  Peptide Sequence Number=SeqID_146683
gcgagggcgtgcagccctcttaaggcgaggacatggagccctctaaaggtgaggacgtgcagccctctgaaggcgagggtgtccaaccctcttaaggtgataggtactagtacccaagggtccacccttatgagaaagcaagagatcgactcatcgagagggccggtcatcccaaattcacaagattggacattagattcacttgaccattttggagtgacgacaatggagtcaagcaagcttcatgatgaatcaagattgattcaaagaagttttgatgataacaaaggtgatgacaaaaagctcaaagggtacatcctttgtggtacaagtagagggtacatctacttgggtttgactgagaacaagagagggtacatctcttgtggatcagttctagtggagggtacatccactaggttgttcaaagagaacaagggagggtacatcccttgtggatctttgcttgtaaaaggatttttacaag

SEQ ID NO: 54999 - DNA, 101 bp, Glycine max
  Peptide Sequence Number=SeqID_146684
aaagaaagagggagaagtttgtcgaaaatgcatcgactgaaaaatgggagggagaaagaaaagttgaggaaatgcttctcgactgggacaaggaaaaatga

SEQ ID NO: 55000 - DNA, 516 bp, Glycine max
  Peptide Sequence Number=SeqID_146685
atgattgggcaccgtctcactaattgtaaaattgtcactgcaaataagcatgttctcatcacagcctgccccaccttggaccagccacaagtgggtgattcagcaatgcccccacataccaatacagcaggtccctctaataatccaaagaatgtacagactaatttgtctgtccctcctcacagaaaacatgttctggttgcaaatcatgttcctgtccttcagaattcttctgacctcaaagaaacagggaacattgagttggatgatcctatagaagaggggtttgttcagggtggaggagatttcctcccgtccgaatccatgatcattgcctcttggaacatcagaggctttaatttgcctctaaagcatcatgcgatgcagagcttccttcgctgcaaggaaattaacgtcatggttgtgttggaaactaagttgaataaggcttcagttgaggaaatcatgagaagaaagtttggtgacgacccgcctcgtcgatacgaacttccttaa

SEQ ID NO: 55001 - DNA, 177 bp, Glycine max
  Peptide Sequence Number=SeqID_146686
atggctacagccaggggggcgctcaagcatcccgtttatggcattgtgatactacagttggagatttacacagacagacccaacgtttccaagacaacgttcctaaatgaaaaactctacactggttggtggtctcaacaagcactcttgacaacaacgaaaaaagtaccgacgtaa

SEQ ID NO: 55002 - DNA, 465 bp, Glycine max
  Peptide Sequence Number=SeqID_146687
atgggttctccacctgcctccactactcctcctcctcctccttctcctcctacttcggacgcatcggcttcgacgtctgctgtgaagcgaacacgcaaagcctcacgcctacgatcattgtccactagaccacctggtgttgagagaccagtggtgcatgttgatcctgctacagggaaggccgacggtccccacaagaagaaattaagaacatatttggggattgaggcacgtgataaggtggacatcacttacgagaactggaaggaggtccctattgctcagaaggacctaatttgggaggatattcagtttaaatcagacctcacgaggaaatgggcccttgcaaccgatcaggacggtgtcgaggacactgtctgtgatacatacgacatcagcaaggaaaagtgggcccagttttgccagactcgcagagacccttcttgggaggatgtgcgcatgtag

SEQ ID NO: 55003 - DNA, 246 bp, Glycine max
  Peptide Sequence Number=SeqID_146688
atggaaaataaaaggctacaatgcgaagggttttcctctaagctcagtcataatatcgaaattcccaacggtgagagtgctcgtaattgggttgcgaacgtggtgttcaaatttcacaatgatccaacggtgaatgagcccgagatcatcgtttttctaagacaggtttggtgggatacgagaaaaagaaagggttttgagaggagaatgggaaaaacgaaaatgagaccaaaaagaggcatctga

SEQ ID NO: 55004 - DNA, 297 bp, Glycine max
  Peptide Sequence Number=SeqID_146689
atgggtatggagtatcagaagattcatgcttgccctaatgattgcatactgtacagacttgtgggacgagggggtgtcgcaacgtgcccttttgcgggcgagcgaaggcgaggctcacgggtgcgctttccaaaggaggaaagatgcgcggagttgccaccaacgtttatttgtggaaaacgtcaggaaaaccgaaggaaaccggtcaaaatgaaaattctaagttcaggagttgtatttacgtttgaggaaggtattagcacctcttacgtttgtctcgaaggcgttggaccttaa

SEQ ID NO: 55005 - DNA, 255 bp, Glycine max
  Peptide Sequence Number=SeqID_146690
atggcctccatgatggaggccatgctaggtatgaagagattaatagagagtaatgcggccacagctgccaccgccagcactgccactgaagcagacccggtccttccaaatctagcacatcagctcggcccggacatggtgggacgagggagagacaccttttggaataccaacagcccgcgtttgggtttttactctcttggtaatcgattaccagattgttgtaatcgattaccagtagcaaaatggatttga

SEQ ID NO: 55006 - DNA, 324 bp, Glycine max
  Peptide Sequence Number=SeqID_146691
atgttttcctcaaataaacgttggtggcgacttcgtgcattttcctcccttgaaagatgcacctgtgagtctcgcgtcgccctcctaccgaaggagtggttgagagtctgcccacaaggtctggattggctcccaaagctaagggctgtgagagaggaagagactgaagctctgaaagagagcaaagaggtacaagccctaaaggcagagcttgagaaagcccaagcagtcaaggaaaagttcaagtcaacagccgtcaaagttcaaaaggagtatgatgaactgaaagacatcaacatggccatcgccgaagccttggagtga

SEQ ID NO: 55007 - DNA, 88 bp, Glycine max
  Peptide Sequence Number=SeqID_146692
atgagcaatcagagaaaaattgaggaatctcaggaaattgctagagatgccgctatcactgttggaagatacgtgagtctgcttagag

SEQ ID NO: 55008 - DNA, 246 bp, Glycine max
  Peptide Sequence Number=SeqID_146693
atgatgaagagaagaggacatggcatatcaacttgctacttcaagaaaaattacagtaacattaaaatgatatgggtcccaaaaggatcctcagtttatactagcatgcaaggacccaataaaatttgggtatctttgaggaagaagtggtacatagatagcggatgctcaaaaacatatgactggagatgcatcaaattttacacatatctctccaaagcaaagcgggcatgtaacatatggtga

SEQ ID NO: 55009 - DNA, 351 bp, Glycine max
  Peptide Sequence Number=SeqID_146694
atggttgttgcttctatatttgctaatctggattcggttccagttcttaatggtgcaaattttaaggactggaaagagaacattaagtttggacatgtaaagaagaaatgtaccaaatatcatgcttggcgtgcaaagaagggtatatttcttactttgttatgttctgaggtcaatttagctctagtacctagaaacacttggtggttagattctggtgccactactaacatcagtgtttcaatgcatggttgcctaagctatcggaagccaattgattctaaaagatggatctatgttggagatggtaaatcagtggaagtggaagctataggacactttagattatta

SEQ ID NO: 55010 - DNA, 591 bp, Glycine max
  Peptide Sequence Number=SeqID_146695
atgggaacaaatcaaactggaaaaaggttctatcaagtcaagattaagggcctagatgtcaccagccttaaggagttggggcgattgatgggacctctccaaatgcaagccttccgaaaggcgtacggaaagattttagatttgaccatagcagagatattcacggaagtcgttgcatcacacacccaatactatgaccagcctttgagatgtttcacgtttggagacttccaactagtaccgactgttgaagaatttgaggagattctaggatgtcctcttgggggaagaaaaccgtatcttttctccgggtttcttccttccttgagcaagattgcagttgtggtcagggattcggcaagggagttggatcatgtaaagaaaactcgaaacggcgtagtgggcctaccatggaagtacttagaaggcaaggcaagggatatggcgaatgaagaggaatggatcccgtttatggacgtattagcattgctaatctttagggttttcctctttccaaacatggacggtttggtggacctagccgcaattgatgctttccttgcatatcaccatagcaaagagaccccggtg

SEQ ID NO: 55011 - DNA, 891 bp, Glycine max
  Peptide Sequence Number=SeqID_146696
ggctacacacccttaccttccgaggactacatgtcctcaccttcagagtggctacacgccctcgccttcgtagggctacgcgccctcaccttccgaggactacatgtcctcaccttcagaggacaacatgtcctcgccctcaccttccgaggactacatgtcctcaccttcagacgactacacgtcctcgccttcaaaggacaacacgtcctcgccctcgccttcgtagggctacacgccctcaccttccgaggactacatgtcctcaccttcagaggactacacgtcctcgccttcagaggacaacacatcctcgccttcgccttcgtagggctacatgccctcacctttagaggactacacgtcctcgccttcagaggactacacgtcctcaccttcagtgggctacacgcccttgccttcagaggactacacgtcctccacttcagaggactacacgtcctcgtcttcagaggcctgcacgccctcgccttcaaagggcgacacgccctgaacttcagagggctgcacgccgttgcctttagagggctacgcgtcctcactttcattcctgggccaccccctgatcctggaggagggccaactatgcaagtacaaccagaggaggaggccatcgcgcagctattgtgcataccggggcaatatttcactcgtgccactgattccgtccaacgaccacaatgccgatctccccctgtggaagtattagttggtctgtgtcatcccgacatagggccctggggtttccagctctggttatgggctcctgttagtcctacagggtgcccgttccccgcagcaaggtcacgccatcatgacatagggatcgtgcctgcaagacacctagtggaccccaagaagtccaacagg

SEQ ID NO: 55012 - DNA, 504 bp, Glycine max
  Peptide Sequence Number=SeqID_146697
ttgttgaaaatttcctaaagaaatacttcccaaagtccaagattgcggaagggaaagctggaatctcttcatttcatcagttccctgatgaatctctgagtgaagcattagtgagatttagagggggaaagataaaactgaagaccccgaaagaagcaactgagctaattgagaacatgtctgccagtgatcatgccattctacgagacaaaacccatcaacccacgaagaaaaacttgttagagctattgtcgcaacctacccttttgcgggcgagcgaggcgaggctctcgggtgcgttttccaaaggaggaaaatgcgcggagtcgccaccaacgtttatttgtggaaaacgtcggaaaaaccgaaggaaaccggtcataaagaatattccagattcgggagttgtatttacgtttgaggaaggtattagcacctctcacgtcgacaaaagtggggctcttgctcctacataccctccatcgaagaggaaatcagacctat

SEQ ID NO: 55013 - DNA, 54 bp, Glycine max
  Peptide Sequence Number=SeqID_146698
atgggtatgttatacgcaaagaacgaaagatcgccaacaggttcgatacggtaa

SEQ ID NO: 55014 - DNA, 165 bp, Glycine max
  Peptide Sequence Number=SeqID_146699
atgcacaatcaagtgaacaatgtcaaagaaagcgggggaacatacggaagatctcaactggcacagtataattgggacctcttcttccaggtgttgaacccgctgattatacctgctcaccagtcaatggtatcgacgcaatatcgtgctcttgacttccattaa

SEQ ID NO: 55015 - DNA, 504 bp, Glycine max
  Peptide Sequence Number=SeqID_146700
atgccgaagatgggagattcagctaaagttgtgataaaacaagacatgaagggaagaaggcataaatatgggtttaacaacaatgaacgtgagaaggcacagaagaaaagggtggtggatgatgaaactgccgacaaacatcagctggatgaaattttactgtacataaagcacgaagacctctccgaaatcgcacacggtggtcaatgtctcagcatatcagtgttacagttgtggattctgcatctcactgaaacatgtatgcgagcggggaattctgatatctatggattcctcgagcctcagtccattcagaggttccactgcagcggacattggcagatggtggtcatcctgcccaaggaacacttagttgtctggttttgttcattgcataacaggccacacaactaccttaaggggattattaatagtgctatcaagggtcttgatgatgctccacagcctaaatcaaaggctcctgctaggtggattgtcgtcaag

SEQ ID NO: 55016 - DNA, 198 bp, Glycine max
  Peptide Sequence Number=SeqID_146701
atgagtaagataggaaggtttggaggtttgggaatggaggaacgtcgaaagggtcaagaggctgcgcaggggtggaggcagcctactggtaatcgattacatgaatactgtaatcgattacaggccatctgttctagtgtaatcgattccagtattcatgtaatcgattaccagaacaaaacaatagccttttcctaa

SEQ ID NO: 55017 - DNA, 120 bp, Glycine max
  Peptide Sequence Number=SeqID_146702
atgcccggtcacgaattatcagactggccacctggagtgatggctggacggaatgatcgtgcgatagcggatgcccttcaagccttagctcaagctatagggaatccgaatagaggagaa

SEQ ID NO: 55018 - DNA, 288 bp, Glycine max
  Peptide Sequence Number=SeqID_146703
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtcgactctagaggatcccctaagcctagcagcaactccatacattatataattaaattggaaacactcaagatcaaggtctgtggcaaactcattgcatgtttagtcaccttgcaacaatacttttatggatcttga

SEQ ID NO: 55019 - DNA, 637 bp, Glycine max
  Peptide Sequence Number=SeqID_146704
tgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgccccattaaagcggaggaccgggaaggacgcacctctggtgtgccagttatcgtgcccacggtaaacgctggagcctccggtagcacagccgagacagcgatgggttctctgccccagcggggatggagcgaaagaagttttgagaattcaagagaag

SEQ ID NO: 55020 - DNA, 366 bp, Glycine max
  Peptide Sequence Number=SeqID_146705
atgattagtgtcggctggctagcgtttcaggagcaaggcccaaatgttaaaaccaacccgctagctagtcatggaggggctagcgtgaatgccgtcgaagaggacgggccatcgcgggcaaagaggttaggagaggtggttacttctagacgcttcatctatcaatcactgcaagcggcgtgcatggtctcccgaggtggagacaaaagggatgaatgtttgtttcacctcggggagtcgcatgacatggaaacctgtcccgcggtggaagaattgcttcagcggctcatggattgcaggcagcttgaagtgtccataggagggagggaagaaccacaaatttgcatgcagtcggaagagaagaag

SEQ ID NO: 55021 - DNA, 402 bp, Glycine max
  Peptide Sequence Number=SeqID_146706
atgttaagaaccgttttaagctttggagaacatggtatggaatttcacgtgaagaggccaaacgatttcgattcaaagtcattcctaattaggatgatattgttaacctatgtgcaaaggatagagctactggactcagaccagaaaatgcttgcagatgatatcatgagcaaagaaacaaatgaagaagaagcaattcatagtgtgagttttgacttagagggatcaagttccgccacaagaaaaaacattcgcccaagtaagagtagagagaaagaagggttgatttcttcaatgaaagaagtagccgagtcactgaaagaatttgttgaagtgactaagaaaaagatggagaacaaaaaaaagatggagataaaaagaagctcaagaagtggtacatga

SEQ ID NO: 55022 - DNA, 573 bp, Glycine max
  misc_feature (432)..(432): n is a, c, g, or t
  Peptide Sequence Number=SeqID_146707
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggctccgnccccctgacgagcatcacaaaaaatcgacgctcaagtcagaggtggcgaaacccgacaggactatcaagataccaggcgtatccccctggaagctccctcgtgcgctctcctgttccgaccctgccgcttaccggatacct

SEQ ID NO: 55023 - DNA, 403 bp, Glycine max
  Peptide Sequence Number=SeqID_146708
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttcctagcagcagcagcaatggaggccgtattggaagcgatctttcgttatcaatgtccgatcaacaacaatggcaagccgggcctccacatttgttagcaactgctgcagcatcatcaggattcccacagcaaattagaccctcccaag

SEQ ID NO: 55024 - DNA, 234 bp, Glycine max
  Peptide Sequence Number=SeqID_146709
atggagatgggtgagagtgcattgctgactactgcttatgggaagaacaaagcaattaagtctcaagcttatcagaaggggaatggtaaaataccacctcaagctgatattaagaaggtggcaaagtgtttcttttgcaagaagaagggacacatgaagaagaattgccccgggttccagaaatggcttgagaagaaagggtatgcaaaacctaaggaaaccagtgggaagtga

SEQ ID NO: 55025 - DNA, 204 bp, Glycine max
  Peptide Sequence Number=SeqID_146710
atgaaatttggatatgttgttcgaaattcaactgcgcacactttcaccgttgggatttgtgagataaaattcgtggagggagaaaaggaatcgcatgaagacaatacaagtggaggtttcaatctcttctccgtctctctgacgtttgagaattctatcggaacagtcggaggaataactgaaggaatctcagggaaccgctag

SEQ ID NO: 55026 - DNA, 283 bp, Glycine max
  Peptide Sequence Number=SeqID_146711
atggtgggttacacaccttccaactttgcggatatggtcttcaccgacgaaaggatcaaagtgggtctgaaaaaaggcaaatttagtcatcctgcttggacgaatgagaaaactggggcaaatgaagagggtgaggatgaaggagaagcccgtgctgtgactgccattcctatacagccaagtttcccaccaacccaacaatgtcattactcagccaataacaaaccgtctccttacccaccgcccagttatccacaaaggccatccctaaaacaaccacaaa

SEQ ID NO: 55027 - DNA, 708 bp, Glycine max
  Peptide Sequence Number=SeqID_146712
atggatgggttggttgacttatcagcgatcgacgcttttctcgtctatcataaccacaaggaaagcccgattgtcgctatgctagccgacctacatgacacctttgaccgaagatgtgagaagagcaatacgaggattgtttgttgtactccagctctttatgtattgttggtttcgcacctttttcgtcaagaggtaaggcatgcttgcccgctagaaagtcactgttcatgcacagagaaaggaggtgcaaattgggaccaactcttagcaaaccaagaaggagcgtctatcaactggttccctcgatggagagaagggagagtcggagttcttatttcatgcggaggatttccgaatgttcccttgatggggacgtggggttgcatcagttacaatcctgttcttgctgtaagacaacttggctaccctatgagagtggcaccactagaggaaaagctcacgcttgttatttcacgaggtttcaataagaccaacatggagacacttcaaaaggtccgcaaagaatgggaggtagtgcgaaagaagaacaaagaactcacgggcagtaacaatgggcccatcggtggctaccataagtggtttagagcccacatgcaaggtttggattggctcctaagtttgagaaccgctaaaagggaggaagttgaggcaccggaggaagacgaagaggtgcaggccacttag

SEQ ID NO: 55028 - DNA, 465 bp, Glycine max
  Peptide Sequence Number=SeqID_146713
atggcagataatttccttggagaactatcacagcagcagattcagccaaatacggaggataggtgcagctggaagcatgatcaaactggatactactcaacaaaaagcggatatgacttgatatgggaagcacagatgggagttaataagaatttggactttgtggacatttggaagctcaaaataccaaattctacccaatttgtgcttgatagagatttctctgaccattgccccatcctcttgaggtctacaacagtggattgggggcctagacctttcaaagtaatgaactggtggttgaaggacaaagattttcagaaaatgtggagcttgcaaaatggtgttatcaatgtttctaaaattcagaatttaaagaaggagctgaatgacttggaagctggtagcagtattggaattctatctcaagctgaggtggatttaaagaaatccttgcaggaatga

SEQ ID NO: 55029 - DNA, 132 bp, Glycine max
  Peptide Sequence Number=SeqID_146714
atgaaattcgtgggtgttgggttttttggagttatgatgggtagttctactagaaaattggtggagatgatgggaagagttaacttagggttaaatgaaagcttgggcagagcaaatgagaaaaatgagtga

SEQ ID NO: 55030 - DNA, 520 bp, Glycine max
  Peptide Sequence Number=SeqID_146715
atgaggctcaatgaaagaaattcacaaagatcaactgagcaagctatgcaagcccaaacaaccaaagggaacaactatgatgtggtaagaataagaagggaaaagaaaagtggaagaacaataagtggaaggggtcaggcacaagatgaggattttgactctgataaagtgttactaatggcaactacaaactcagaagaagacagtgttaatctgtggtatcttgacacatgttgttccaatcacatgactggacatagagagtggtttgtaaacattgatgataaggtaaagagcaagatcaagtttgcagataacagttttgtaactgcaaaaggcattggaaagggctactcaatacagatggaggatagtcaactgaagatgtttgatagcaataagaggttgattctaaaggcctctttgtcaagaaacaaaacattcaagattggaattcagattgcagaatttcaatgcttggctgcttctataagtgatgaagctggatgtgacatcacgg

SEQ ID NO: 55031 - DNA, 231 bp, Glycine max
  Peptide Sequence Number=SeqID_146716
atgaattttgatgatgccaaagaagaattaaacaatgccgcttcaaaggataagcatttgcttcaagattacttcaagattgcttcaacaaacaaagtcttgtttcaagattcactaaagatcaagcattgcctcaaaacaaagggttttaaagtcatgcaaggctctggtaatcgattaccaggaaatgtaatagattaccagaagggaagaatgaaaaatagctattga

SEQ ID NO: 55032 - DNA, 636 bp, Glycine max
  Peptide Sequence Number=SeqID_146717
atgtcctccccatcagaagagtatacatcctcacctttagaggactacacgtcctcaccatcagagggttgcacgccctcacctttagaggactacatgtcctcgccatcagagggctgcacgccctcaccttcagaggattacataggactacacatccttgccatcagaggactacaggtcctcgccatcagagggttgcacgccctcaccatcagaggactacacgtccttgccatcaaagggctgcacgccttcaccatcaaaggactgcacgtccacaccttcagagggctacacgccctcaccttcagaggactgcaggtcctcgccatcagagggctgcacgccctaaccttcagaggactacacgtcctcaccatcagagggctggatgccctcacctttagaagactacacgccctcgcctttagagggttgcaagccctcgccttcagagggctacacgccctcagcttcagaggactacacgtcctcgccatcagagggctgcacgcgctcaccattagaggacttcatgtcctcgccatcagagggctacacgccctcaacttcataggactacacgtcctcaccttcagaggactacacgtcctcgcctttagaggaccacat

SEQ ID NO: 55033 - DNA, 423 bp, Glycine max
  Peptide Sequence Number=SeqID_146718
atggacggtaagctgagtttcagcctgccagcaggcatgtcggataagagcggcaagctgggttcggaatccaccaatatgcacgtgtatgccgatgaaaccggccagcgcgcaattatcgtgattgcgggcgatccgaccagtgaaggactggatgcgctggctcagcgtctggagcagcagcagcgcaaccgcgatccgcagctgcaggtggtgtcgaacaaagcggtgacgctgaaagatcagccggcacagcagctggatacggtgatttccgccaataaccagacctcctggtcctcggttattctggcgaaggtggacggtaaactgctgacgctgcagatcaccctgcccgccgacaatcagcagcaggcgcagagcgatgccgatgcgattgtgaagagtattactctgaagtaa

SEQ ID NO: 55034 - DNA, 658 bp, Glycine max
  Peptide Sequence Number=SeqID_146719
agggctgcacacccttgccttcagaggactacatgtcctcgccttcagagggctacacgccatcgctttcagagcactacatgtcctcaccatcagaggactacacgtcctcaccatcagagggctacatgccctcgcctttagaagactacacttcctcgctttcagaggactatgcgtcctcaccatcagaggactacaagtccttacctttagagggatgcacgccctcgccttcagaggactacacgttcgcgccttcagagggctacacaccatcgacttcagaggactacatgtcctcgctttcagagggctacacgccctcgccttcatagagctacactccctcaccttcaaaggactacacatcctcatcttcaaaagactacatgtccgcaccttcagagagctacacgccctcaccattggaggactacacgtcctcaccatcagaggacttcgcgtcctcacctttagagggctgcacgccctcgccttcagaggactacacatcctcgccttaagaggactgcatgtcgtccccttcagggggacacatgccctcgccttaagaggactacacgtcctcgccttcagagggctacacaccctcaccttcagaggactacacgtcctcgctttcagaaggctacac

SEQ ID NO: 55035 - DNA, 282 bp, Glycine max
  Peptide Sequence Number=SeqID_146720
atgatcgagccacgcactgagaagcaagtccaaggtttcttgggacgcctgaattacatagtgagcccaccgtctaaggaagtacatgctgagctacaccacttggttggtgttcaaaatggacccagtcaagtgatagagggaagcacattggcagattacctggctcagcaacccatcaacgactaccagcccatgcatccagagttcccggatgaggacatcatggccttgttcgaggaggaggtggaggatgaagatagggacaaatggattgtgtag

SEQ ID NO: 55036 - DNA, 326 bp, Glycine max
  Peptide Sequence Number=SeqID_146721
atggaatttggtgatattgttgttcattttaacattcttgatgccatgaaacatccatctgaggatcattctgtttttcgtgctgagatacttgatcagattgttgatgattatatgtttgattttgattctcttcatggtgttgtacctcttgatgttgattttttagagtcagaatgcactaaccatgttgtaggaagtacatatacttctgacttgctttatgaggtacaggctgaggaatccttctcttctcctaccctggttcctcccactgttcagccaccacccacatcagagttgaagcccttaccagtaaacctcaa

SEQ ID NO: 55037 - DNA, 199 bp, Glycine max
  Peptide Sequence Number=SeqID_146722
gcgaggctcacgggtgcgctttccaaaggaggaaagatgtgcggagtcgccaccaacgtttatttgtgggaaacgtcggaaaaaccaaaggaaaccggcaaaaatgaaaattctaagtttggggagtgtatttacgtcgacaaaagcggggctcttgctcctacgtaccctccatcgaagaggaaatcagacctacgca

SEQ ID NO: 55038 - DNA, 567 bp, Glycine max
  Peptide Sequence Number=SeqID_146723
atggtgggagaaatgttggtggcgaaagctataagtttggagagtagtagcaaaatcctacagttatataatgatgagatagcttggaggttatgggaattggctaggcatatccaagatatggagcttactgcaatcatatatggtccaaagagggcgggtttggagacgattggaaaagatttctttaaggagaagctaaaatttcaaagaaaaaaaaactccgaggttggcatgtggagggttgaagatgtagaagggaggaggttgattctttctaaagaattttggagatctttgaagaaatggcccaaaaatctagggtgggatggattggtgagggtgatgaaaactctagccactgaagaagttaagcttcaaatatgtgaagcttgctctcgatctcatctctcccattcacctttcactcgtgcgctctataactccatgttcctatcaatgctcctctacgacatgttcctgaacgcccccattgggaaaagaggttctggtgctgggggcctagggttagggcttgtgagagatgttggatgcttcatgcattga

SEQ ID NO: 55039 - DNA, 393 bp, Glycine max
  Peptide Sequence Number=SeqID_146724
atgacgggattctttggtgcaatgtttttaaatcaaagtatgggggctgaaggggattgggaaattcagatgttggatgctaaattctggctggacaaccggaatggtgatacagtttttgggctttggctgacaagtatagcaggttattcacaaattcttgtaatccgaatgccctggtggctgaaatgggatattaggtaccctcccaaaaaaacaatgttatttttagaggggccaatgggaattgggaagctgtgttgtgtggccgcatgggatctggcaaaacatagagcttgggcatggattaatgcgaaagggaaaggaagaaaattctcttattgtgaatgggagatgaatcccagggcttgtttgaattgtttaacgttatga

SEQ ID NO: 55040 - DNA, 243 bp, Glycine max
  Peptide Sequence Number=SeqID_146725
gtgaaaaagaggctaagttttgaattgcaaaaagtagcaattgggctaagctcagcagttgggctaagcgcttatccaccgcttagcgcaaaggataatctggcagagcatcagcatcaaagccgcgtgctaagtgcaagatcaaattttcagaggcattggtgcacagcattccatagtgcctattttgggaaaagagccctagaagcagcaaagaggaacaacttgtgcattgaagcctag

SEQ ID NO: 55041 - DNA, 235 bp, Glycine max
  Peptide Sequence Number=SeqID_146726
gaccaataacaatgccgataggttggacctcccagaagagtatggagtcagcaccacttttaacatttctgatttaattccttttgcaggtggagctgatattgaagaggaggaactaacagatttgaggaagggaccagtcactagagccatgagcaagaggctccaagaggattgggctagatctgttgaagaaggccctagggttctcatgaacctcaggatagatttctga

SEQ ID NO: 55042 - DNA, 531 bp, Glycine max
  Peptide Sequence Number=SeqID_146727
atggcgccgtcgcgcatgtaccgtatcaaccgagatatggcgcatggaggcggagccatgtgggatatcgggccgtatgcgatacacgctttgcgctggtgttttggtggcggcgacaagccggccgagccgcagcatgtaattgcctatggcaaacttaacgaacacggtgccgatgtggtggccagtggtgtgcttgatttcgggccggatgcgcaaggccgtgcgcggtttggcaattttgatgtgagttttgaacgcggacgcaaagccgaatatgagctcataggcgataagggctggatcaaatgccacaatatgtgggcgtaccccggcgatgatcctgtcattagctgggaggcgggtggcaaatctgaaaccatcgtcttgcctaaagctaatcatttcaatctggagattgagcactttagtgattgcgtgctttatggcaaaccaccgctgttgacgtttgacgatgcccggggcaattgcaaggcgattgaagcagtgattgcggcattaaagaaataa

SEQ ID NO: 55043 - DNA, 381 bp, Glycine max
  Peptide Sequence Number=SeqID_146728
atgggaagagggcttagacaaggtgatcccttgtctctttttcatttcatgacatttgtcgaaggaattagtattatgcaaagggaggtgaagattattgcttttaaatatcggtttactagtagaggtggatataagaaaaatggatacttgtcatcttatgatagaggtggtgaaatggagattatgaatgtaggaaacctatggtcaatgtctgagaatacacttccctctaaattaatctcgcattcatcatttgggattcaatttagggttaaggatgaacatcagagaggtttgtgtaaaggaggttcttgccacaagtttggtcatatggccactaacatgcaatcgactaagaatttgagtgatcaattctaa

SEQ ID NO: 55044 - DNA, 216 bp, Glycine max
  Peptide Sequence Number=SeqID_146729
atgtatgatcgatgcccatttgatgaggacatgaccaagagcaagggcaaggatccacttgaaggacttggaggacctatgacaagggctagagcaaggaaagccaaggaagctcttcaacaagtgctttccatactatttgaatacaagcccaagtttcaaggagaaaagtccaaggttgtgagttgtatcatggcccaaatggaggaggactaa

SEQ ID NO: 55045 - DNA, 342 bp, Glycine max
  Peptide Sequence Number=SeqID_146730
atggctaccaccaaggctttggaacaagagaccaaaagggcccgtagggaagaacatggtcgggacaagttccgaggggctctgtggggcagtaacagcgaacttaaactccgaagagaagaaagggaccaatctcgagtagacgctttgatcttgaaagatgaattgaaggcttgctcgaggtccaagagaagtttgtctcagcggttgtgcgagacagagaccaacatgttagctatcatcatcaagtatcaagaagaacttagcctagccacagcccacgagcatagggtggcggatgagtatggccaagtgtacgcagagaacgaggctagaggaagg

SEQ ID NO: 55046 - DNA, 588 bp, Glycine max
  Peptide Sequence Number=SeqID_146731
atgtctgccagtgatcacgccattctccgtgatagagggcatcaacccactaagaagagtttactggagttatcaacacaagtccctatgttggcacaaaataagttactctctaggaaacttgcgatcttgaaagaaaccttgagttgtaccatatgtggtggtactcatgaatccagtctttgcattccttttgaagagcaaacgcaagagggtccttacaaccaacaaggacagtggagatcacaccctgataatcaattcaacaaagaccagggtggaccttccaacaggccgcctcaacaagggcctaacatttttcagaggacaaccaagctggaggagactctgactcaattcatgcaggtgaccatgtcaaatcacaaaagcaccgagtcaacattgaagaaccttgagatccaggtaggccaactagccaaacaattagctgaaaagtcatccaatagctttggggcgaacacagaaaagaatcccaaagaggaatgcaatgttgtgatgaaaagaaacaagaagcatatggtagttgaggatgaggatagggtggctttggagaaacaattgttgtaa

SEQ ID NO: 55047 - DNA, 78 bp, Glycine max
  Peptide Sequence Number=SeqID_146732
tatgacagaaattgtctgcgcggaatatgacgaaaatctccgcgtgtcaatgagcttgttggccgcgattgacaaagg

SEQ ID NO: 55048 - DNA, 130 bp, Glycine max
  Peptide Sequence Number=SeqID_146733
atggactccttgaagcaaagttggtatgttgatagaggttccaccaaagacatggcgggagatgcattaaagtttattcatatttctcccaaaaatagtgaacatgtgacctatggagacaacaacaaag

SEQ ID NO: 55049 - DNA, 60 bp, Glycine max
  Peptide Sequence Number=SeqID_146734
atgtcttgggcttcatcctcctcagcttttgttttatcggggaacactcaggatttagag

SEQ ID NO: 55050 - DNA, 133 bp, Glycine max
  Peptide Sequence Number=SeqID_146735
ggagtgcttgttgcccccagcaaggtcatcaggccccctaccaatcgagctttcatcaaggagtactgcgcccccaggcaggtgcagtgcgaaacaccacatcagcattgggatggccggtagtgggcaatag

SEQ ID NO: 55051 - DNA, 150 bp, Glycine max
  Peptide Sequence Number=SeqID_146736
atgtggtaccatggagaccagtcagggtcaccagtgttttgcgagaatgctccaaccatatgggatcaacataggcttaaaggagcactcaaactaggtgacccccaaggcctacactccgaagagtctgtcagagcctctccttcctga

SEQ ID NO: 55052 - DNA, 222 bp, Glycine max
  Peptide Sequence Number=SeqID_146737
atgtgtatacataggaaatggccccgaggaaacttgcctcaaagagatccaggaaggataaagcggccgaaggaaccagttccgctcccgagtatgacagtcaccgctttaggagcgctgaacactagcagcgtttcgaggccatcaagggatggtcatttctccgggagcgacgcgtccagctcagggacgacgagtataccgatttccaggaagagatag

SEQ ID NO: 55053 - DNA, 620 bp, Glycine max
  Peptide Sequence Number=SeqID_146738
gtggaaaaacccggtagaccgttcggtccaccctcaaatcttattcgaagacccatgaattcattgcctagcgttgttcatgtgtcctccaccatcgagtctggagcaccgagaattgattgcctatcgctgttcgcctatcctccatcctccaatcttattcggagacccatgaattcattgcctagcgctgttcatgtgtcctccaccaacgagtctggagccccacgaattgattgcctagcgctgttcgccaattctccattctccaatcttattcggagacccatgaattcattgcctagccttgttcatgtgccctccgttatcaagcgtggagcctctgaaagaagaaggagagacgagagtcgttatagactaatcacggaaagagcaggacggacgaaatcagtgtcttatctttgctttcctcttatctccaatgagagatacttggcaccctttgttgcacaatatgtgaagtcccgagacgtgccggaaatccaaaggaagcaggcttacgcgatccgtgaaattccgcccacttgggccttccagtttcttcctccagaaggcggttgcgtctggaggaagcaaccttgctcgcctgggcgagctgg

SEQ ID NO: 55054 - DNA, 153 bp, Glycine max
  Peptide Sequence Number=SeqID_146739
atgcaagttagcttgcctgggcgagctgagcttgcctgggcgagcaacccctgcacgaaatggtttaaaaaggggaagggggaaggggatggccctaggcctatggtgcattctgagataatggggcatgccacattgcccccattcccttga

SEQ ID NO: 55055 - DNA, 324 bp, Glycine max
  Peptide Sequence Number=SeqID_146740
cctttgctagcattcaagtttcagcacaggaaaaatcttattttttatcaagtccttcattaagcccggatgggaaaaccgcttattttgcttatgatggagacatctggaaagtggactccaatggcggaaacgcttccagaatcacagccctggagggagaggaaattaatccacgcatttctccagacggaaaatggcttgcattcagttccaatcaatacggaaattatgacgtgtatgtgatgcctgctgaaggaggaagcattaaacagttaacatttcacacaggaaaagatgaaatagaaaactggggatgggaca

SEQ ID NO: 55056 - DNA, 231 bp, Glycine max
  Peptide Sequence Number=SeqID_146741
atgacaagtaaacttcaaatgctcataacttttgctacggttgtccgtttgaggcccactatatatcaaaacgctcagaattcagaggagaatcccgataaggggatttggatagaacctgtatcaagagctgaagctctgataccagatgatgtgatcctgactaggaacagatcgcttgatacaggctacggagacttggatgatgccacttccagtaaaggaagataa

SEQ ID NO: 55057 - DNA, 171 bp, Glycine max
  Peptide Sequence Number=SeqID_146742
atgtcagcgtcttccgaccgagactgcgaaaatgtcttggttgctatccgtcagactcaagagtctgcttgcttgtggggcttctatggaggctggatctttgagcttcaatggggtcctttaatggtgattttccaccatggagatgcagcggaagacaaaggaaaatag

SEQ ID NO: 55058 - DNA, 879 bp, Glycine max
  Peptide Sequence Number=SeqID_146743
atggggacaaatcaaatcggaaaaagattctatcaagtcaagattaagggcctagatgtcaccagtcttaaggagttagggcagctgatgggtcagctccaacggcaagcttttcacaaagcttacggtaaaatctgggacctagtcatggtagaagtctccatagaggccattgcctccctcgcccagtattatgatcaaccgttgagatgctttacctttggggacttccagctgtcacccatggtggaagaatttgaagagatcctaggatgtcctctagggggaaggagaccatacctcttctcagggttctatccctcattagctagaatttcaaagatagtccaaatcccgacgcaggaattagaccatggaaagcaagtcagaaatggggtggttggaataccgagaaaatgttgggaggcaaaagctagaaccttggcaggtagaggcgaatgggccccgttcatagacattatcgcactgttggtctatggaggagtcctctttccaaatgtggatgggttggtggatctagcagcgatcgacgctttcctcgcctatcatgaccacaaggaaagcccggttgtcgctatgctagccgacctatatgacaccttcttctggagatgtgagaatagcagtacgaggattgtttgctgtactccagctctttatgtatggttggtttcgcccctttttcgcccagaggtgagacatgcttgcactcttgaaaatcaccgttcaagcacagagaaaggaggggcaaattggggccaactcttagcaagcaaagaaggagcgtctgtcaactggttccctcaattgaaagaaggaagaatcggggttcttatttcgtgcggagaatttccgaat

SEQ ID NO: 55059 - DNA, 177 bp, Glycine max
  misc_feature (155)..(155): n is a, c, g, or t
  Peptide Sequence Number=SeqID_146744
atgacccaagagctggtagcccgcggagacaccttacggttatccgcacctcgtcattcagtgaccccaagtgtgattgatgagcagaggccaatgtggtctgagttcctcattggaggatacgtaggagcaagagccttgcttttgtcggccgncccacaatctctgtcatactga

SEQ ID NO: 55060 - DNA, 159 bp, Glycine max
  Peptide Sequence Number=SeqID_146745
atggcaatatcacggattgggaacgggcccttcggggcctcttccccgggcgtcgaacagtcaactcagaactgcgaaaccacagccaagggaacgggcttggcggaatcagcggggaaagaagaccctgttgagcttgactctagtccgactttgtga

SEQ ID NO: 55061 - DNA, 282 bp, Glycine max
  Peptide Sequence Number=SeqID_146746
atggaatttgggcatggttttgtgaactatgtggattgtggggctgacttgtgtgtatatggacagcttgtagaggaaatggctccgaaaaagctttccacgaagaggtctagaagaaacgccgcagcggaagggtccagcgccacccccgagtttgatagtcagcgtttccggagcgccgagcaccagcagcgcttcgaggctatcaaaggatggtcgttccacaggagaggctcgtctagctcagagaggatgagtatacggactttcaggaggaaatag

SEQ ID NO: 55062 - DNA, 703 bp, Glycine max
  Peptide Sequence Number=SeqID_146747
tgtggacgatttggaagatataattggggggcatgtatggttgggttccatttgtatacttggtggaatctggcatatcttaaccaaaccttttgcatgggctcggcgtgcacttgtatggtctggagaagcttacttatcttatagtttaggtgctttatctgtttttggttttattgcttgttgctttgtctggtttaataataccgcttatcctagtgagttttacgggcccactgggccagaagcttctcaagctcaagcatttacttttctagttagagaccaacgtcttggggctaatgtaggatctgctcaaggacctacaggtttaggtaaatatctaatgcgttccccgacaggagaagttatttttgggggagaaactatgcgtttttgggatttgcgtgctccttggttagaacctctaaggggtccgaatggtttagacttgagtagactgaaaaaagatatacagccttggcaagaacgccgttctgcggaatatatgactcatgctcctttaggttccttaaatttccgtgggtggcgtagctacagagatttaatgcagtcaattatgtttctcctagaagttggccatttatggcacgcgggaagagctcgcgcagctgccgcaggatttgaaaaaggaattgatcgagattttgaaccagttctttccatgactcctcttaattga

SEQ ID NO: 55063 - DNA, 426 bp, Glycine max
  Peptide Sequence Number=SeqID_146748
gaaccagccatgtacaactatcatgagaaaggaagagctcttgatcttgaaagtgtattggcaaacttcatgacataccaagctagctctaaagaaggattgtctaatctggatgacctgttaatgcaattcaaagatactgtagattcaatgcaacaagcctttaaaagaactgaaactcagattggcaagttggtagatgacatgactaaagttgtggtcaaaagagaagaagattctccagaatatccctgcatggcaaatgctggctatgttgtagggaaagataaaggtcgattggaactcagtgtggaggatcagaaaatctcttttgacctctttgaagccatgaaacactcaaatatgggtgatgtctgtgttgaagaagaggtggagcaggaaatagcattatcagcttcaaccatg

SEQ ID NO: 55064 - DNA, 218 bp, Glycine max
  Peptide Sequence Number=SeqID_146749
gcaagctagaggctagcctgggcgagctacggtctaggaaaaccaaggaaaagacctttttgcccccttttgtttgcgaggcgaggctcacgggtgcgtcttccaaaggaggaaaatgcgcggagtcgccaccaacgaaggtcgacaaaagcggggctcttgctactacgtaccctccatcgaagaggaaatcagacctacgtagttctttcttaagg

SEQ ID NO: 55065 - DNA, 315 bp, Glycine max
  Peptide Sequence Number=SeqID_146750
atgaagatcatattttctaaaaactttccactggtaatcgattacaatgtttgtgtaatcgattacacagttgaatttggaaaagggttacgacttttgaatttgaatttccaatgttttgttgctggtaatcgattacatgttgaaaattcaaattcaaaacatttttcaacagctatttctcaaccctgtcttctgaagggctaccttgctaaaatatcttataaagcgactgtagaatcctacatgaccaagaagagatcgcacctctcacacgcaagaggggatctacttcaatgcccttattggaaataa

SEQ ID NO: 55066 - DNA, 87 bp, Glycine max
  Peptide Sequence Number=SeqID_146751
atgatgtgtaaaaacaagtacaaacacgttggtcttcctaataggtgcccgatgctgaaaagatattctctatctaacaatgctcat

SEQ ID NO: 55067 - DNA, 498 bp, Glycine max
  Peptide Sequence Number=SeqID_146752
atgggtgaagtagaggaggtgcaagagaagatgaaggctgacatggaggccatgaaagagcaaatagccacaatgatggaggccatgatgagcatgaagaagataatggaagccaatgcggttatagttgccgctactggcgctgtcgctaaggtgaacccgatgctcccatctggcctcaagcaaatgaatcatccaacctcaaatatggtaggcaaagatttgggaagtacggatgaccccatgatgtgcaaattcaaaacaagcacgccttcccgcatatggcttgcctcccaaactatacaccacccaatgtggtgtatatttccaatgaggatgtcaataactccactcccatactcattaagagccaacaacctcaatttgatcatgcacatgtctctcgacccatggaggagacacatgaaattccccaccacaatctacctgacttcgagccttggctcggatatgccactgaagggcaagcagttggtg

SEQ ID NO: 55068 - DNA, 242 bp, Glycine max
  Peptide Sequence Number=SeqID_146753
atgaagggtgaatgccgtgaaagtttttcccgaatgcctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 55069 - DNA, 318 bp, Glycine max
  Peptide Sequence Number=SeqID_146754
atgtccccagtggagtcgccaactgtcacaacctacccttcggcgggagggcgacgcgtgactcgcgggatgcgtgttccacgaaaggaatacgcgcggagtcgccaccaacgcttatttgaggaaaacgttggaaaaaccggaaaagacgtgatctacgaacttttaagtgaaaggttcgggagttgtatttacgcacggggaaggagagaaacgttaaggcattggaccattaacgatctcttggggtggtcgacaaaagcggggcttttgctcctacctatcctcaattgcgatgaggaaatcagacctacgtag

SEQ ID NO: 55070 - DNA, 144 bp, Glycine max
  Peptide Sequence Number=SeqID_146755
atgcatagtcggccgatgtttgtttggcggttgccggtttgggagattcctgagtggatggctccgtggttggctctggaagagccagtcttgatcctttgcctgtacttcatcctccccttagggagattcctgatgccttag

SEQ ID NO: 55071 - DNA, 360 bp, Glycine max
  Peptide Sequence Number=SeqID_146756
atggtgaaagttggaacctcttacgtgccgatcaacgtctcattttcgccaaaagttggcccagggcttcccggtatcaacagggacaccaggatttatttatttctgcgaagtgatcttccgtcacaggtgctccagtggcttctgtttctatcagctgtccctcctgttcagctactgacggggtggtgcgtaacggcaaaagccccccccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 55072 - DNA, 745 bp, Glycine max
  Peptide Sequence Number=SeqID_146757
ttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccccctagcactcgcatgggtccctccttttatcagacgtgtcttgattcggtcattaccttatgttctggccgtttgcctgcatgtttgacctttggtttcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55073 - DNA, 422 bp, Glycine max
  Peptide Sequence Number=SeqID_146758
acctcgcaccctacacttcagagccctacaatgctcaatggaacgccccggggcttctctgtgacaagcacacgttgcgttcgagtcgtattctcggagaaatggaggttgatgaaccttggctagggttatggctaccattgaattatcaagtagatatgggatcaagtttagcatatgacaacggaatttggggtggtcttcgtcattggaagtgcggtagacagactttagttgatttagggatggcctttgtggataactgggtggtagtcacagcattggggatttctcccgtctttgctcaccctcttaatttgcccccagttttctcagtcgtcctaaaagtaggactgatcaaatttgtcactcctattcttggatctcacttcgtctctggcggagaaaatgaaaacttgaag

SEQ ID NO: 55074 - DNA, 252 bp, Glycine max
  Peptide Sequence Number=SeqID_146759
atgactgatcttgtgagcgcggaagatgatgtaaatctccgcgtgacaacgggcttgtcgcccgcgattgccgaaggatgcagaagacgacatgacgttaatctccacgtgtctccaacgggctcagaccagcgtagttttgagaaggatgcagaagacgacgaaagtctcgcgtggcttttctccactaaaagaaacgtttatacgagacaaatatttccgcccgagcgtgacttcaaatgcagcatatga

SEQ ID NO: 55075 - DNA, 1140 bp, Glycine max
  Peptide Sequence Number=SeqID_146760
atggcttctaggaaaagaaaggcaccctctacacctacccaagccagaattgacagatcaagattcacattccaggaagcttgggtgagatacacagacattattgtgcctaggaaattgctacttgagagaaatgtggtggtctacaccacaaaatttgatgaattcctagatgagctggatagaagacactggagagaggagttgactgactttctggatagcaatattgatgttgccattgtaaaagaattctatgcaaacctctatgcccccgaggacaaatcacctaagcaggtgagggtgagaggtcatttgattaagtttgatgaggatactcttaacacatttttgaagacccctgttgttatggaagagggggaaacactttgtgcttactctagatttgcactcttgaggcctgatcctcaagagttagctgctaagttctgtatcccagggagattcgagcttaatgctgatgggcagtccttgaagattctgaggaagaacatgaccactcttgctcatacttggagcattctttccatttcaaaccttattcccacttcccacacttctgatgtcactcttgacagagccaaactcatttatggcatcatcatgaagatggacatgaatgtgggaggacccaggaaggccaggggtaagagatctgaggccccttccacttcggcaccattagaggcaccaacaccttcttcttctccaataccgccctcttcatccactcagattctagtcattcctccagcacctccgcagatgctttactctatgctccagagcatccacagggggaagtccatcatcatgcagagccttcagggcttgggcttgccctccattatgagcatggaggagtttgaaactcaggtggcctggccaggagaccagccctcttcttctggagggggtggggcctctgcagcccaagagcctgatactaaggagccaccagcaccaacaccagcagaggaggagactactccagatcagactccacagccatatctagcccctgcacatatacctgaggatgttgcaccagttgcagagcctgagcagcttatacaggattcatcagcagctccagcactggatttgaatgaagactag

SEQ ID NO: 55076 - DNA, 1173 bp, Glycine max
  Peptide Sequence Number=SeqID_146761
atgacggaacaacaaaatcaatccgccgtggttgaagagaccagggaggccgtggaaaccacgccacagccagaaaacaacgagaagaaaaaggccggcaacaaaaccagcctggcgctcagcgcgattgctatcgctatcgccctcgccgccggtattggcctgtatggcttgaataagcagcaggttacgcggcaaaacgaaaccagctctgaattagcaagccagctcgcggcgctgcaaaaagcgcaggacagccaaaagagcgagctggaaagcgtcatcaaacagcaggccgaccagttgagcgaagccaaacgtgaacaggaaaccctgacgaaacagcttgatgagctacagcaaaaagttgccgtgatttccggcagcgacgccaaaacctggctgctggcgcaggctgatttcctggttaagctggcgggacgtaaactgtggagcgatcaggatgtgacgaccgccgccgcgctgctgaaaagcgccgatgccagcctcgccgacatgaacgacccaagccttatcggcgcgcgccgcgccatcaccgatgacatcgcttcgctgtcggcggtaagccaggtcgattatgacggcatcatcctcaaagttaaccagctggcgaatcaaatcgacaatctgcgtctggccgataataacgacgatgattccccgatggatgccgacagcgacgagctctccagctccatcggcgaatggcgggttaacctgcagaaaagctggcagaactttatggatagcttcattaccatacgccgccgcgacgaaacggcggtgccgctgttagcgccgaatcaggatgtctatctgcgcgaaaatatccgttctcgcctgctggtcgccgcgcaggcggtgccgcgtcatcaggaagaaacctataagcaggcgctggaaaacgtctccacctgggtacgcgcttattacgatactgaagacgccaccaccaaggctttccttgaagaagtggataagctcagtcagcagagtatcaccatgagcgtaccggaaacgctgcagagccagagcctgctggaaaagctgatgcaaacccgggtgcgtaatttaatggcccagcctgcggcagccgctccgacgccagcgccagcagcgaccgcgccagcccctgcgccgcaaggagaataa

SEQ ID NO: 55077 - DNA, 420 bp, Glycine max
  Peptide Sequence Number=SeqID_146762
atggtagccataaccctagccaaggttcatcaacctccatttcttcgagaatacgactcgaacgcaacgtgtgcttgtcacggagaagccccggggcgttccattgagcattgtagggctctgaagcgtaaggtgcaagtgcaagccattggtctgtttgctcaagcgacctgtgctcttgagtttggacttccaagaccgttcaatcagagattactcgtcttgcacgttggtgggggtgccgtaaaacaacgaggacaacccttcccttgtgttcaggaatcctctacaacaagagacccacggtctcttaatcccttttcagaaataagaagaagagaagaagagatctctcttaaaagagatagattgtacaatgaagatcaatcaaaattccttattgaatatgcaagtgtttga

SEQ ID NO: 55078 - DNA, 180 bp, Glycine max
  Peptide Sequence Number=SeqID_146763
actcatcttctccttgaagtggcgtctcctctctctcttcctttctccattccgctgccattcatcttccaagaagcaaaggaatccattgatgaagaagatcctaggcctacaagctccaatggagcttgcatcagtatggcggtgctaagggatgtttcccttgataggggaaggtag

SEQ ID NO: 55079 - DNA, 157 bp, Glycine max
  Peptide Sequence Number=SeqID_146764
atgagggagaagcttgccacccagctcgcccaggcgagcaaggttgcttcctccagaagcaacacccttctggaggaaggatctagaaggcccaagtgggccagattgctatttgcacccccctttttactaagtgcaccccccttctatttttttg

SEQ ID NO: 55080 - DNA, 474 bp, Glycine max
  Peptide Sequence Number=SeqID_146765
atgcacgatgccccccgaaagacgatttctctcctattcccatggcatactccaagttgtggccctcattattggaaaatcatttggtggtggccatacccgggaaggtcttctagccaccataccccaagtggtacaactcgaatgccaagtgtgcataccatagtggagcccccggacacaacattgactcctgcttgccgttcaaaggagggccccaacgttaaaaccaatccactagccagtcatggaggggctagcataaacgccatcgaaaaggatgggccgtcaggggcaaagagattagaagatgtggctacatcaagacggtacatctaccagtcgctgcaagcggcatgcatggtctctcgtggcggagacgaaagggatgaatgtttgtttcatctcgaggaatcacacgacatggaaacctgtcccacggtggaagagttacttcaatggctcatggactag

SEQ ID NO: 55081 - DNA, 322 bp, Glycine max
  Peptide Sequence Number=SeqID_146766
gtaagtatgcacctcccccaactgattctgatgtcatttatagtttgcagggatcgtgcccgcaacacactagtggacccgaagaaggccaacagggtcttggagttgccaactctaaatacgggtctctgtcaattcaagggagtgcctgctgcccccagcaaggtcatcaggccccctacaaatcgagctttcatcaagaagtactgcgcccccaggcaggcgcagggcgaaacaccacagcagcattgggatggccggtagcgggcaatagacacaccgccaccacctctagagttcacctcagctcatccataaaaag

SEQ ID NO: 55082 - DNA, 237 bp, Glycine max
  Peptide Sequence Number=SeqID_146767
atggaagtcaaacacaagcgttatgcaacaaatacgctagactcaagcctacatgcaatgtggtaccatttttcagtgaaaaacctcgtcgggcgcctaggagtacatgatgagacatgcctcacaatggggagaccagtcagggtcactttgttttgcgagaatgctccaatcatatgggatcagcacaggcttaaaggagcactcaagctgggtgtatttacccacaaggcctag

SEQ ID NO: 55083 - DNA, 450 bp, Glycine max
  Peptide Sequence Number=SeqID_146768
gttgtaccatatgtggtggtactcatgaattcggcctttgcattccttttgaagagcaaacgcaagaggttagctacatggggaatcaacaaaggcagggatacaatcaaggtggactctcaggattccagtagggtccttacaaccaacaaggaaagtggagatcacaccctgacaatcaattcaacaaagaccagggtgaccatgtcaaatcacaaaagcactaagtcaacattgaagaaccttaagatccaggtgggccaactagccaaacatttagctgaaaagtcatccaatagctttggggcgaacacagaaaagaatcccaaagaggaatatgatgttgtgatgacaagaaaaaagaagtgtttggtagttgaggatgaggatagggtggctttggagaaacaaattgttgtaaaggatggaattgagagaaataaagaggag

SEQ ID NO: 55084 - DNA, 540 bp, Glycine max
  Peptide Sequence Number=SeqID_146769
atgttcctcctctaccagctcaatatctttcgtttcacctttgcttttgtaaactacactgtaatttacaaaacaaaagttgaaaggaaagatattgagctggtagacgaggaagaagcacatattggtgctgatcgttctagtgcaacctctaataaatctgagatttataaggaggaagcacggaatgcaacacagaagcataaaccaaagagggtggagagtgtcaatgctgatgcagaagcctttgctgaagcactagaacatacgaagaaaagagatacaggccatcgaagtgtgttattggagaataagacaggagattcaactgtgctgaagataggagattcgactaaagttgtgataaaacaagacatgaagggaagaaagcataaatatgggtttaacaacaataaacatgagaagacagagaagaaaagggtggtggatgatgaaactggcgacaaacatgagctgtatgaagtcctaaggataccatctaaaagaaaataccgatgcctcaatcagagaaaaatgtag

SEQ ID NO: 55085 - DNA, 269 bp, Glycine max
  Peptide Sequence Number=SeqID_146770
atggctccgagaaagctttccacaaagagatctaggagggacgccgcggctgaggggatcagtgccgctctcgagtttgacaaccatcgtttcaggagcgctgagcaccagcagcgtttcgaggccatcaaaggatggtcgttccaccgagagagacgcgtccagctcagggacgatgagtacgaagattttcaggaagagatagctcgccggcgttggacgtcgctggtcactcccatggctaagtttgactcggatatagttttaga

SEQ ID NO: 55086 - DNA, 387 bp, Glycine max
  Peptide Sequence Number=SeqID_146771
atggcagcgcaattaatccatgatcgcgtggtgatggagtgcctagagggagtttgggagaccttcgaaggcaatgagagtacatccggaggaacccgcacgcacacttcagcggactgtggagtggatactacctacactactccatatcgactagtggagtcagttcaagtgatagaggtgtcatcctctgaagaagaccctgaagaggacctagaggagttacctcctgagcctgctgtggatgctctagactttccagaggatgatgaggacccactccctgatgtggattctccagaggatatcatgtcagcatctggggcagactctacagaggagagcggacctagagggacagcgagtagtgaagactcttcatcatag

SEQ ID NO: 55087 - DNA, 297 bp, Glycine max
  Peptide Sequence Number=SeqID_146772
atggaacccctccaaatgcaatccttccgcaagacttacggaaaaatcttagaattgaccatagcagaggtgtccatagaagccattgcatcacttacccaatactacgaccagcctttgagatgcttcacattcggggacttccaattagtgccaaccattgaagaatttgaagaaattctaggatgtcctctcgggggaaggaaaaccatatttttcctccgggatgtctccccctccttgagcagaattgcgactgtggtcaaaggattccgcaaagaggtttggaccgcataa

SEQ ID NO: 55088 - DNA, 1099 bp, Glycine max
  Peptide Sequence Number=SeqID_146773
atggggacaaatcaaatcggaaaaagattctatcatgtcaagattaagggcctagatgtcaccagccttaaggagttagggcagttgatgggtcagctccagcgacaagcttttcgcaaagcttacggtaaaatttgggacctagccatggtagaagtctccacagaggccattgcctccctcgcccaatattttgatcagctgttgagatgctttacctttggggacttccagctgtcacccatggtggaagaatttgaagagatcctaggatgtcctctagggggaaggagaccatacctcttctcagggttctatccctcattagctagaatttcaaagatagtccaaatctcggcgcaggaattagaccatggaaagcaagtaaaaaatggggtggttggaatactgagaaaatgtttggaggcaaaagcaagaaccttggcaggtagaggcgaatgggccccgttcatagacattctcgcactgttgatcttcagaggagccctctttccaaatgtggatgggttggtggacctagcagcgatcgacgcttttctcgcttatcatgaccacaaggaaagcccggttgtcgctatgctagccgacctatatgacaccttcgatcgaagatgtgagaagagcagtacgaggattgtttgctttactcgggctctctatgtatggttggtttcacacctttttcgccaggagagaaaggaggggcaaattgggaccgacttcttagcaaacaaagaaggagcgtctgtcagctggttccttcgatggaaagaaggaggaaccgaggttcttatttcgtgcgaaggatttccgaatgttgccttgatggggacaaggggttgcatcagttacaatctcgttcttgctataaggcaacttggctaccctatgagagggacaccactagaggaagagctcacgcctgtcatttcacgaggttccaataagaccaacgtggaggtacttcagaaggtccgcaaggcctgggaggcggtgcaaaagaaggacaaagaactcagaggcagtaacaatgggcccatcggtggctaccataagtggttgaaagcccacgtgcaag

SEQ ID NO: 55089 - DNA, 315 bp, Glycine max
  Peptide Sequence Number=SeqID_146774
atgccaatctccccttgcagatgtatcggttgggatcgtgcccacaagacgtccagtgggcccgaagaagtccaacagggccctggggtttccagctctggttgcgggcctctgtcagtcctacagggtacccgttcccccagcgaggaatcgcgcccacaaagacacccagtggacccggagaagtccaacagggccctggggtttccagctctggttacgggcctctgtagtcctaccgggtgcccgtttcccccggcaaggtcacgtcatcatgacataggtaagtatgcacctcgctcaactgatttttga

SEQ ID NO: 55090 - DNA, 564 bp, Glycine max
  Peptide Sequence Number=SeqID_146775
gatacgtaggagcaaaagcctcgctgttgtcgaccacactgctttccgtgcaccctgtcatccagaggcggcgggccccagagctggtagcccgcggagacaccttacagttatccgcaccttgagtgtgattgataagcggaggccaatatggtcatctgcgccctttccggagatgatacgtaggagcaagagccttgcttttgtcggccgccccataatcttgtcagagaccctgaaaggtcatgtgacatgcacccttgtgtcatccagaggcggcgggcccgatgatacgcggagataccttatggttatccgcacccttgtgtcatccagaggcggcgggcccgatgatacgcggagatccaaatttcggtctatccgcacccttgtgttatccagaggcggcgggcccgatgatacgcaggagaaccttaggttatccgcacccttttgtcgtccagaggcggcgggcccgatgatacccggagataccttacggttatccgcacccttgtgtcatccagaggcggcgggcccgatgatacgcggagataccttacg

SEQ ID NO: 55091 - DNA, 708 bp, Glycine max
  Peptide Sequence Number=SeqID_146776
atgaagcacttcactgacaccctcatcagtgccaacataggaacaaaagctggtaccgggccccccctcgaggtcgacggtatcgataagcttgatatttcacggaaacaccaccatcttggtcgtagtagaccagttctcgaagggagtgcacctgggcatgctgctaacacaacattctacttactcagccgttatcttgttcatggacattgccggaaaactccatggcatgccacggagcttggtctccgacagggaccctatctacgtgcgttccttcacaagaaaccttcctcatggggcaagctccttaattcggcagaatggtcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 55092 - DNA, 165 bp, Glycine max
  Peptide Sequence Number=SeqID_146777
agcttccgttttcaattacgggcgtctcgatatcctacgggacacaatcggacatccgagtcaaaacggccgccaccgcggtggagctccaattcgccctatagtgagtcgtattacaattcactggccgtcgttttacaacgtcgtgactgggaaaaccctggc

SEQ ID NO: 55093 - DNA, 93 bp, Glycine max
  Peptide Sequence Number=SeqID_146778
atgaagctagaagaggaagtcgtcctaagagctttagatgagtctttttggtcgagtttagtcccacaagaggaatttgaggatgatgcttga

SEQ ID NO: 55094 - DNA, 497 bp, Glycine max
  Peptide Sequence Number=SeqID_146779
ggcctagatatcaccaacattaaggagttggggcggttgatgggacccctccaaatgcaagccttccgcaaggtgtacggaaagattttagatttgaccatagcagagatatccacggaagtcatggtatcactcacccaatactatgaccagcctttgagatgcttcatgtttggagacttccaattagtaccgactgttgaagaatttgaggagattctaggatgtccttttgggggaaggaaactgtatcttttctccgggtttcttccctccttgagtaagattgcagttgtggcaagggatatggcgaatcaagaggagtgggtcccgtttatggacatattagcattgctaatctttggggttgtcctctttccaaacatggatggtttggtggacctagccgcaattgatgatttccttgaatatcaccatagcaaagaaagcccggtggtagctatcttggcagacttatttgacacatttgaccgaag

SEQ ID NO: 55095 - DNA, 222 bp, Glycine max
  Peptide Sequence Number=SeqID_146780
atgacaaccaaagaaaatgacaagaaaaagaaaggaattgcacttaaagcctcatcttcaattcaagaagaaagtgacaaagaggacttgaatgaaatagaagaagatgatgatttcagtttcttcgtaaagagattcaataaattcctaagaaacaaaggaaatcaaagaagatcaaacttcaaaccaaagaaaagcatcttctattccaaagttttatga

SEQ ID NO: 55096 - DNA, 330 bp, Glycine max
  Peptide Sequence Number=SeqID_146781
atgacaatcttgcagacgaccctaagtttggtcattctgcacccttgtgatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcagagataccttacggttatccgcacccttttgtcatccagaggcggcgggcctgatgacaagcagagaccaagtttggtcattctgcacccttgtatcatccagaggcggcgggcccgatga

SEQ ID NO: 55097 - DNA, 108 bp, Glycine max
  Peptide Sequence Number=SeqID_146782
atgaaagacttgggattacgcatactatgcatggagaataaatgggtttatgatcccaacatggttggctcatggtgcctaacacatgcaactaagaatgtagcgtga

SEQ ID NO: 55098 - DNA, 312 bp, Glycine max
  Peptide Sequence Number=SeqID_146783
atggggtggaccgcacacatgtctaaatatgactatgacacagaccatgagaagcttgattcaaatttaattgcgacttgcatagtgtcataccctaatttcgtccggggacctttgctcgatgacgtgcgaccattctttggtcctcgtgagcacccaggcccacttgggccctccggaatattcctccagaaggcggttgcttctggaggaagcaaccctgctcgcctgggcgagctgggcggcaaccacctcccctattttgctataaataggggaggaaggcaagaaggaaggggttcagccccttag

SEQ ID NO: 55099 - DNA, 1018 bp, Glycine max
  Peptide Sequence Number=SeqID_146784
atggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggtaaactaatgagctctgatattaatgaactatatagaagagttatctatcggaataatactcttatcgatttattaacaacaagtagatctactccaggagaattagtaatgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgatattcgggtcgtctgtcattgtgtaggaattgctaagagtaaaattcgggaaaaagaaccgattgtatgggaaatacttcaagaagttatgcagggacatcccgtattgctgaatagagcgccgactctgcatagattaggtatacaggcattccaacccattttagtagaggggcgtgctatttgtttgcatccattagtttgtaagggattcaatgcagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgagcttatcaacaaaaaagaataaacttcgatagtcctttgtggctccggtggcgactagatcaacgcattatttcgtcaagagaagttcctatcgaagttcactatgaatctttag

SEQ ID NO: 55100 - DNA, 390 bp, Glycine max
  Peptide Sequence Number=SeqID_146785
atgaactcgctaaacgagcatgctgcgctaagcgagttcatcaatacttattgtattcgtgtgctaagtcgagcccaggactcagcctccccttcacagggaagacaaaggtctcaccgctcagagcccctgatcaaaagaaagagggtagttgaaacacaagaagctgcagccacttctaagaaatctcttgaggccacttctgagccttcagaaccagtggcagatacaacttcaattcagcaagcagcagaccccttcgctcctgaggatcagactacaccagtcttgtctccgaacacctctcctttagctacccctgtgcttcccttaacagatgaggaggatgttcggacatcggatactcaggacagatcacaggatttttaa

SEQ ID NO: 55101 - DNA, 602 bp, Glycine max
  Peptide Sequence Number=SeqID_146786
tacctattgcctttagaggactacacgttctcaccttcagagggctgcacgccctcaccatcagagggctacacgccctcgccttcagaggactgcacgtcctcaccttcagaggattgcacatcctcgccttcaaagtactacacgtcctcaccatcagaggacttcacgtcctcaccttcagaggactacatgtcctcaccttcagaggactgcatgtcctcacctttagaggactacacgtcctcgccatcagagggctgcacgccctcgccttcagaggactgcacgtcctcaccttcagaggactacatgtcctcaccttcagaggactacacatcctcgccttcagaggactacacgtcctcaccttcagaggactacacgtcctcgccattagaggactacacgtcctcgccatcagaggactacacatcctcgctatcagaggactacacgtcctcgccatcagaggactacacgtcctcgccatcagaggactagacgtcctcgccatcagagggctgcatgccctcaccttcagaggactacacgtcctcaccttcagagggctacacgccctcacctttagaggactacac

SEQ ID NO: 55102 - DNA, 444 bp, Glycine max
  Peptide Sequence Number=SeqID_146787
atggagagaagtatgatagatgctgccagtggtggagcccttggagacatgacccctgctgaagccaggaatttaattgagaagatggcttccgactcccaacaacctcctcaacctcagcagcaaaatcagccacaacagaacaattatgacctctccagcaacaggtacaatcctgggtggaggaatcatcccaaccttagatggtcgagtccttcacaacagcagcagcaacaacaacagccttattttcagaatgttgctggcccaagcagaccatatgttcctccacccatccagcagcaacaacaaaagcagcaaccgcaacagccccagaaacaacaaacagttgaggctcctccgcaaccttcccttaaagaacttatgaggcaaatgactatgcaaaacatgcagtttcaacaagagatcggagcctccatttag

SEQ ID NO: 55103 - DNA, 288 bp, Glycine max
  Peptide Sequence Number=SeqID_146788
atggtgaaagtcggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 55104 - DNA, 860 bp, Glycine max
  Peptide Sequence Number=SeqID_146789
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaaccatgacacatggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55105 - DNA, 777 bp, Glycine max
  Peptide Sequence Number=SeqID_146790
atggctccacctaaagaaattgcgaccatcatttaccacactggtcacattgtagacgatccagttcaaggatcgatgtacacatctgtgaacccaatatttttttacgtcatttgttctattacgtttatacaattcattcgaaaaattaacaatcgtctccctgctcaagcaactgaacaagttgctcaattgttatttcgtgttcctatttcatttcatctgggtcagacacgttttatttcagcacaactattcgacaatgatgatctcagaggcgcgatggaaacatttctccagaatccacaattgaattctgccgaattctatgcggttattgaccttatttctcaaccacaaccatcgtctccacaaccctcatgtccacaactacaactaccgcctccacaacagttactgtacaacaacatagacctcaataatccaacccctttgacatttatacttcatacacacaactattatccgaaaatgattctttttttcatgcccaacaaacctcctttggccaacaaaaccatccttcaccccccctttaccccaccttcacaactaccacaaacacaaacatcaaatcgagatgaacatctcattgctaacgaagatcccattatacgatttcatgatgaaaacatggatgattttagtgaagatgaggatcaaaagttctttgatcacatcaatcaccaaagcgatgaccaaatcgatgacgagggtgttggcagaccaacgacacctccgtcacctccgttgtaa

SEQ ID NO: 55106 - DNA, 384 bp, Glycine max
  Peptide Sequence Number=SeqID_146791
atgcataaggcattacgggccaatgcacctctttcgtatcctcaattggtcaccctttttctccgtcattttcaaattccacttgataatgaaccttttgttcaagtcaagagatcttttgctataggtgatggtgcagtaacttcatttggtaaccgtaaggatcgtgatggaaaatggctgaagaagggcgcgttacctccacaagatgagcgtactccttctcctcctcctcaacgagatgattcctcaacccttatgaatgaagttctttcggaattaaggggtctccgcacctatgttggcatggatactcgcatcacccaacttgaagaggacgtgggttatctttgtcggtgcttcgtccttccaccgccttcttag

SEQ ID NO: 55107 - DNA, 48 bp, Glycine max
  Peptide Sequence Number=SeqID_146792
atggtgattttccaccatggagttgcagcggaagataaaggagaagag

SEQ ID NO: 55108 - DNA, 358 bp, Glycine max
  Peptide Sequence Number=SeqID_146793
tggctctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccattatggaatggttctcagcagcac

SEQ ID NO: 55109 - DNA, 318 bp, Glycine max
  Peptide Sequence Number=SeqID_146794
atgcccttttgcgggcgagcgaaggcaaggctcacgggtgcgctttccaaaggaggaaagatgcgcggagtcgccaccaacgtttatttgtggaaaacgtcggaaaaaccgaaggaaaccggtcaaaacgaaaattctaagttcgagagttgtatttacgtcgacaaaagcggggctcttgctcctacgtaccctccatcaaagaggaaatcagacctacgtagttctttcttaagggtgaatcacacgatttctttttacttgaaaggtgatcatttaaaggtgttggaccttaaaaatgatccattaacttggtaa

SEQ ID NO: 55110 - DNA, 816 bp, Glycine max
  Peptide Sequence Number=SeqID_146795
ccgttgaggtgcttcatctttagggacttccagctatcaccaatggtggaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatggggtggtcggaataccgagaagatatttggagggagtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaagggggatctgttaattggttccctcgctacaaggaaggaagaatcaggattctatcttcatgcgaaggatgtccaaatgttcccttgatgggaacaagggacagagagcttaggggaagcagtaatgggatcatcggcggctatcataagtggctgagagtccgaacacaaggattggattggctcccaaatctaaagactgtgagggaggatgaggttaaagcttcggaagaaagtgatgaggtacaagccctaaaggcagagcttgaaagagcccgagtagtcgaagagaagttcaagtccatagccatcaaaggcagcaatagtaagctcaagctccgaagaggtgaaaggaatcatcacgggtcaaaggcatga

SEQ ID NO: 55111 - DNA, 1160 bp, Glycine max
  Peptide Sequence Number=SeqID_146796
atgttccaacatcttccaccccaaatgctgaagtcctctcttcatacagtaaagaggaatcaacagaggaagaggatcaagacacagaggagacccctgcaccaagggcaccagaacctgctccaggtgatctcattgacctagaagaagtagaatctgatgaggaacccattgccaacaagttggcacctggcattgcagaaagattacaaagcagaaaggggaaaacccccattactaggtctggacgaatcaaaactatggcacagaagaagagcacaccaatcactcctaccacatccagatggagcaaagttgcaattccttccaagaagaggaaagaaatttcctcatctgattctgatgatgatgtcgaactagatgttctcgacatcaagagggccaagaaatcagggaaaaaggtgcctggaaatgtccctgatgcaccattggacaacatttcattccactccattggcaatgtgaaagaactgggaagagatgccttggattgcaaggagatcatggacctcatcaaggctgctggactgctgaaaactgtcaccaagttgggagattgctatgaaagtctagtcagggaattcattgtcaacattccctctgacataacaaacagaaagagtgatgattatcagaaagtgtttgtcagaggaaaatgtgttagattctcccctgctgtaatcaacaaatacctgggcagaccaactgaaggagtggtggatattgctgtttctgagcatcaaattgccaaggaaatcactgccaaacaagtccagcattggccaaagaaagggaagctttctgcagggaagctaagtgtgaagtatgcaatcctgcataggattggcgctgcaaactgggtacccaccaatcatacttccattgttgccacagaatcttttgctgtcaaattacccattgccttcccaactgtattgtgtggcattatgttgagtcaacatcccaatattttaaacaacattgactctgtgatgaagagagaatcggctctgtccctgcattacaaactgtttgaggggacacatgtcccagacattgtctcgacatcagggaaagctgctgcttcaggtgctgtgtccaaggatgctttgattgctaaactcaaggacacatgcaag

SEQ ID NO: 55112 - DNA, 195 bp, Glycine max
  Peptide Sequence Number=SeqID_146797
atgtattcaccggcactgatcgaaaacaatgcaaaccgacgtcggccaggaaagatgaccgatcgaggtcggctagggtttttcgtgcgcgctgtaccgagactgtgtttcggccgacactggcatgttctcatttactcggccaggaaaagattagcccacctcggaaaaaaaaatgtgattcaccggcactga

SEQ ID NO: 55113 - DNA, 1075 bp, Glycine max
  Peptide Sequence Number=SeqID_146798
ggatactagacctttcagttgggagtcttttagcactcaatgctgtctggctcgtaccgatgtcatgagtgtcttatttatgaaagacagaagtgtgacaagaagtgcagtaatggtacgggttacaaacggaacagacatgcgccaactgaggggaataactagtcaaggtgtgacacacgacaaagatggcggcaaaagacctgtattattacccgaaacaaacaacaaacaaaacattatgaagcgtattggtctatcagctgttcccgaagttctatctaaaatagaacagaactacgatgtatttactataactgataaatttcgtaatctgtctttgaaagatagcagtgctagttcaagtaatcatagttttgtttctactctgactcctactgcatctcttttagaaagatttaagattcgtactaatccatcggcgtttactcgtaatgttattgaaatgactaaagcaccattttttgatataaagaaccctattattaatttaaccgaaaaggcaaacaattatatgatgtcgattggctttcgctttatgccaggacaaggggaattcttaataaaagatctccgagctcctgataccttaggtatttctgactctgtttctaatagtatggagtcgctggcatctcgtgtcttggttgaagtaattacatttaatgaggggtattatggtcgattcttaatcctggtccaaatgggtattggttgtactgtatggtatggcttcgtacctggcgatggtatcaatatgccaattgaaggattaaataccctatttagtcctattgagaattatgatactatctttactaatcctgatgctcatgttataccgggctttaataaaatgactttaattgagggcgtaaataatccagcagcaccgctgtcacaggcatttgctcaagataggcccttcatggatatggatattgaaataccggattctaataaatctattattatcggtgttagcttaggactagcagttgccatcttatttacatttgggattaacccatgctgcggagaagttatagtatga

SEQ ID NO: 55114 - DNA, 216 bp, Glycine max
  Peptide Sequence Number=SeqID_146799
atgaagtttggaaatctattggagcaagtttcagcacttagacatgaaagctttttgttacaaaacttgaacaatgaagtgcttcttagtccaatagctcttaaggtggttggccccttgcttctggactcaaattcttcaagggatggcaccaatcctccttccaattccctatatggcaacccacaaacaaggaaacaaagagacaaccaataa

SEQ ID NO: 55115 - DNA, 129 bp, Glycine max
  Peptide Sequence Number=SeqID_146800
atggcgatctcggattcattcaccgttggatcgtttcagaggaaaaaactggaggaatctcagagaaccgctagagatgctgctatcgctgtctggaaacatgtgagtccgcttagaggtaagggatga

SEQ ID NO: 55116 - DNA, 519 bp, Glycine max
  Peptide Sequence Number=SeqID_146801
atggttcctaggccaccccctgatattagagggcgaccgattgtgcgagcacatccagagagggaggctgtcacgcatctactatgcataccgaggcaagatttcacctgtgctgctgcaaaaagacgagtgcggatcatgcgcaccaacatgaccactcttacatggatatggatgacgttgctatttagcaacattttgcccagtgaccacaatgccaatctccccctgcagatgtatcagttgggatcccgcccacaagacgcccagtggacccgaagatgtccaacagggctctggggtttccagctctggttacgggcctctgtcagtcctactaagtgcccgttccccccggcaaggtcacgtcatcatgacatagggatcgcgcccgcaagatacccagtggacccaaagaagtccaacaggttcttggagttgccaagctctaattacgggcctctgtcagttctatggagtgcctgtcgcccccagcaaggtcatcaggccccctactaa

SEQ ID NO: 55117 - DNA, 171 bp, Glycine max
  Peptide Sequence Number=SeqID_146802
atgaagcacttcactgacaccctcatcagtgccaacatacggataacaatttcacacaggaaacagcgtatgaccatgattacgccaagcgctgaattaacccgtcctaggaacaaaaggtgcttttggttaccgggcccaccccgtcgtaggctgaacaggatcggataa

SEQ ID NO: 55118 - DNA, 201 bp, Glycine max
  Peptide Sequence Number=SeqID_146803
tgtttcgtttctaaacgaccatttagaggaaacaccgggtccaacaaaatagaagaaaatcactcgaagtgtatcaatctcacacagcacgttggcctcttaacagtgaatggctcttttttcttgggagatcccactgttccttcttctgagggcaaggatggaaattctcatcctgggtcaaggtttatggtgatttga

SEQ ID NO: 55119 - DNA, 273 bp, Glycine max
  Peptide Sequence Number=SeqID_146804
atggcagtaggatacgatgtatgcatgattcatgactttgagggggagttgtatgaatatgatcttgagggggagactgctgctgaggatgaatgttgtaagctactagaagatgctgcacagaaagctgatgtcacgagagatgtcttgacatcctggagaagacttgtagatttgcaacttgaagaatttccgctgtgcttgattactctgataatggaagttgctgatcccacttgcataactgctcgtacctgctcaggaagtgtctaa

SEQ ID NO: 55120 - DNA, 141 bp, Glycine max
  Peptide Sequence Number=SeqID_146805
atgaagggaaaccaacaaagggtccccagcggagtcgccaactgtcgcaacctacccttcggcgggagggcgacacgtgactcgcgggatgcgtgttccacgaaaggaatacgcgtggagtcgccaccaacgtttatttga

SEQ ID NO: 55121 - DNA, 732 bp, Glycine max
  Peptide Sequence Number=SeqID_146806
atggcatccttcagtcagcttcagtcgcagatgcaatctcagggacttgcagtgcctcctgagcctctggttggtccctcaggtcctcgagtgagcacaaaggggagttgtgttgatcactcaggaaacgatcctgagacgagtgactctgacaggtgcggcttgtacatagaaacatatcatgcccgcctggttgccatggggagagtttatgagggatcacttattgttcataacactcctttgttgcctggccaagtaaaggtgagtgtggaggaggttacagatgtagatgctccagttcctgtacccactgatgagataattgtgtctccggcaaaaccacctctgaagcccgatccggaggtcgatgatccgctttatctgatgacattgaccatcccagagcttttctcgagaccttgtcaggttagatgggatgccaccgtgttcggggtctttaatccagatttccccctctacataaagcacgaagacctttccaaaatcgcacacggtggtcaatgtctcaatatatcagtgttacagttgtggattctgcatctcactgaaacatgtatgcgagtggggaattctgatatccatggattcctcgagccacagtccattcagaggtctgggcaatcgcagtttgagtctgaaagttacataaagagtaggatgtatagttcacaacgcgatgtctatcttggagcctacccaaatgggtaa

SEQ ID NO: 55122 - DNA, 198 bp, Glycine max
  Peptide Sequence Number=SeqID_146807
atggaggatttgcttcacaaaacaatccaagtagagaaacaattgaagaggaaagagcgtggtgttcccatgtcctctagcatgaggttcttcatagtcatccacctattcatctgctcccccgaacacaagttcaagatcatcacaggatccaaacacaacaacacacagggagtgagttatcatagtcctagctaa

SEQ ID NO: 55123 - DNA, 747 bp, Glycine max
  Peptide Sequence Number=SeqID_146808
atgaagaagataagagtttggtggtgtactataaagagtttaccagaagtaagttcagaagatcttattaccacagaatatgttgcagctaccagtaaagaagaaaaggtattagtctctgtctgtgagcaggtcttgaaacacagtccgatcagtatccgtgataactattataatttaggaggagactccataaaatccattcagatagtttccaggcttcgtcagcagggttatagtctgaaggtagaacatattttacagtatcctgtattagaagagctggcgtgctatatgacaacagatgttgctaaaatcgaccagtctgaagttacaggagaaagtattctaactcctatccagaggtatttctttgaaagtgaagggatcaccaataaaaatcattataatcagtctgttattttaaaaagcagtgaaagactgtcggcttctgttttagaaacttccttaaaatgtcttgtagagcatcatgatgctttaagaatggtgtatagtcataaagacgggaaatggaatcagtataattcgggaattgatggcgtacattaccgtttagcgtcttttgatatccgggacagtggcagtgaatcagaagaattattccaattacaacaaataggaaaggaccttcagagtacaatcaacatagagtccggagttttattccatgtgggtcatgtttccatgagtgatggggaccgtatcattttagttgttcatcatttg

SEQ ID NO: 55124 - DNA, 237 bp, Glycine max
  Peptide Sequence Number=SeqID_146809
atggcagcagaatggagaaggaagagagagaggagatgccacttcaaggagaagatgagtctagaagaagctcaccaccataggaggccatggataagagcttggaggaagaaggagatgaatgaaaggagaggaagagaggagcacgaaattttgtgctctaaaagagctctgaaatttgaaatgtcgtaccggatgtcacgacatcacgcttcagcacatgcagattatatatga

SEQ ID NO: 55125 - DNA, 658 bp, Glycine max
  Peptide Sequence Number=SeqID_146810
agcttctagtctcaattttgagcgtctcgatatattacccgattcaatcggacatccgagtaaaaagctattgtcgtttgaatttcctacgagcttccgttttcaatttggagcgtctcgatatattacaggactcaaccagacatccgtgtataaagttattgtcaattcaattttctcagagcttcggatctcaattttgagcgtctcgatatattacgggactcaatcagacatccgagtaaaaagttattgtcgtttgaatttgatacgagcttccgttttcaatttggagcatctcgatatattacgacactctctcgggcatccgagtaaaaatttattgtcgtttgaattttttaagagcttccgttttcaatttggagcgtctcgatatattacgggactcaaccagacatccgtgtataaagttattgtcatttcaattatctcagagcttctagtctcaattttgagcgtctcgatatattacccgattcaatcggacatccgagtaaaaagttattgtcatttgaatttcctacgagcttccgttttcaatttggagcatctcgatatattacatgactcaaccggacatccacgtataatgttattgtcaattcaattttctcagagcttcggatcaaaattttga

SEQ ID NO: 55126 - DNA, 570 bp, Glycine max
  Peptide Sequence Number=SeqID_146811
atgttggtgcgcatgatccacactcggctctttgcagtggcacgggtgaaaccttgccccggtatgcacagtagttgcgcgatagccttcctctggttgtgctcgcacagttggccctcctttgagatcaaggggtggcccgggaaaaagaatggtcgaagggaaattacagggcagaggaccttaaatcctcttaaggtgtggatatggagcccactgaaagtgaggacgcgtagccctcaaaagacgagggagagcgcagccctccgaagtcctctgaaggtgagggcgtgtagccctttgaaggtgagggtgtgtagccctttgaaggcaaggacaggtagtcctctaaaggtgagggcatgcaaccctttgaaggcgaggacgtgtagtcctctgaaggtgaggacgtgtagtcctctgaaggtgagggtgtgcaaccctctgatggcgaggaagtgtagtcctctgaaggtgatggcgtgcagctctctgaaagcgaggacgtgtagtcctctaaaggtgaacgtacatgaccctctgaaggcgaggacgtgtagtcctctgaag

SEQ ID NO: 55127 - DNA, 593 bp, Glycine max
  Peptide Sequence Number=SeqID_146812
tcgtcagcgaagagaattttgaagcaccggaagaggacgaagaagtccaagctctcaaaagcgagttaggaaaggcaaaactcgccaaggagaagttcaagttggccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaataatgaactcaagttgcgaagggaagaaagggaccagtcgcgagcacataacatggttctgaaagaggagttgattgcttgttcaaggtccaaaagaagcttgtctcagcgtttatgcgagacagagaccaacatgttagctatcatcgccaagtacgaagaagagttaggtctagccacggcccacgagcatagaatcgcggatgagtatgctcaagtatatgcggaaaaagaggctagaggaagggccaaggcgatggcagacacctactccacccccgaagagattcatgggcttctcggctattgtcagcatatgatagacttaatgggcccacataattag

SEQ ID NO: 55128 - DNA, 480 bp, Glycine max
  Peptide Sequence Number=SeqID_146813
atggaagtcgagcaggtgctggaatcagcgcgtcaggcgaaaaacgccggctcgacccgcttctgcatgggcgcggcgtggaagaatcccaatgaccgcgatatgccgtatctggagcagatggtcaaaggtgtgaaggcgcttgggctagagtcgtgcatgacgctcggtacccttaccgatagtcaggcacagcgcctggccggcgcggggcttgattactacaaccataacctcgacacctcaccggaattttacggcaacatcatcaccacccgtacctatcaggaacgtctggatacgctggataaggtacgcgatgccgggattaaagtgtgctccggtgggatcgtcgggttgggggaaaccgtgaacgatcgcgccgggctgctgctgcagttggctaatctgccaacgccgccggaaagcgtgccaatcaatatgctggtgaaggttaaggtgtacgccgctggcggataa

SEQ ID NO: 55129 - DNA, 834 bp, Glycine max
  Peptide Sequence Number=SeqID_146814
atgggttctgtcttgatccctactgtaaacaaaccaacggagggtccgtatcgccttcttaaaaacgtgcgtttgggcatttcgctacccctagacgtcgtatctaagaaggggacaaattccccggacccccgcattcctagattgcatctgtgtcatatgcattccatcatgcattcatccatcccacccatgagatatcggagttttgacttgcaccagcttttgtctcactttagtaagcatgggaacaaatcaaactggcaagaggttctaccaagtcaaggtcaaaagccagataccaccagcatcaaggaattagggcggttgatggaacctctccaaatgcaagctttccgcaagacttacggaaagatcttagagttaaccatagcagaggtgtccatagaagccattgcatcacttacccaatactacgaccagcctttgaggtgcttcacattcgcagacttccaattagtaccaaccattgaagaatttgaggaaattctaggatgtcctctcgggggaagaaaaccatatctttcctccgggtgtctcccctctttgagcagaattgcaactgtggtcaaggattcagcaagaggtttggaccgcataaaacagactcggaacggcatagcgggcctaccacagaagtacctagaagacaaggcgaggggtatggccaatcaaggagactgggtcccgtttatggatgtgttggctttgctaatttttggggtcgtcctctttccaaacgtggatggtttggtagacctagcagcaatcgacgctttccttgcctaccaccatagcaaggaaagtccggtg

SEQ ID NO: 55130 - DNA, 117 bp, Glycine max
  Peptide Sequence Number=SeqID_146815
atggatatgctagctgatgctgaggtaatgttcaatgcaagttatttgacattacctattggtgaaacagaccatgatccactgcttggacgccccttgacgcctacaaagcggtag

SEQ ID NO: 55131 - DNA, 225 bp, Glycine max
  Peptide Sequence Number=SeqID_146816
atgtggtcatctgcgccctttccggagatgtcagcatcttccggtggagactttttcgagtctcacaagatacgtaggagcaagagccttgcttttgtcggccaccccattcagactctgagcagatttggtcatactgcaccctttgttatccagaggtccgatgacatgcggagacaaaatttggtcattccgcacccctttgccattcagacacgatcgtga

SEQ ID NO: 55132 - DNA, 138 bp, Glycine max
  Peptide Sequence Number=SeqID_146817
attgcgcaacaatgcttcctttcgacttccggcatttcgcggaacttcacggattgcctaacgatgggtgttaagtacctcgaagcggtcaagcgaaggttgcattccaccaaacaaatggtccccggacgaaattag

SEQ ID NO: 55133 - DNA, 469 bp, Glycine max
  Peptide Sequence Number=SeqID_146818
atggctagagtgatttccacccttaatctagttcagaaagaaggccattgtcacgcgttgcttaagtctccaagcggtactggcaaccaccgatcctctggctctggtggcggatttgttcccgaggaggttgctgttcgtgctcgttctatgtcaaatgatgctcaattggtattttgtccatataactacatcaataatccagtcatttgggcaccaatggaagtggatattaaagtaggcatagttattttcgacgaagctcacaatatggaggacattactcgtgatgctagcagtgtggataatgaagaagatgttttggataggttgagggttgagggtttcagggttcagggttcagggttcagtgttcagggtttgagggttcagggttcagggttcaaggttcaaggttcaaggttcaggattcagggtttagggtttaccgtttcgcgcttccactctg

SEQ ID NO: 55134 - DNA, 3849 bp, Glycine max
  Peptide Sequence Number=SeqID_146819
atgaccggggaccgatgtcacccgtgggagggcatggtggaggttggtgatgctgccgccgtggagaggcggtgcgaggctaattttccggctgaaattcctcgcaactctgccgccgtgcgtgaaattgattacttgtcccaggctaggaaagcgcttgcggagcgttcgcctttcgatgttgctgaagagacgtcgacttctgccgctgcggttactctccccggtggcttggctagtttgctgaaccggcagggtgataaccggaggcgtctcaagaagtctcattctggcgcgaataagaggaaatcgtcgaatagggcaaaccagaagaagccagaggattctaacatttggactgagacggaggagtactttagggacttgaccttggctgatattgacaccttgtttgaggcctctcgcacttctagtttagtgtctcaggactgtttcaccatcccgtgtttgggaaatgctcctaggcacaatgcagttactagtaatagtgggaatgaaatggagcctgttccaaaattcaatgtagtagttagtagtgaggatggagaaaagggtgaggatgaaaacaaggatggtgaagcggtggaaagtgaggatgaattgttggtaattgaggcaattgacgatgttgctgttgaacaagctcctccccaggacgacaagagtcaggacatttctgattcttctgttagtctagagtggtttttaggttgtaggaatagggtttctttgacttctgagcgccctaccaagaaaagaaggcttttgggtgttgaagctggtttggagaaagttgtaatgacttgtccttttgatgagggccagctgttttgccattattgtggcaggggagacactggcagggattccaataggttaattgtctgtgcttcttgtaaagtggcagttcaccgaaagtgctatggtgtgcatgatgatatagatgaggcttggctgtgctcctggtgcaagcaaaaggttgatgttgatgtgtcggtgaatccttgtgttctttgcccaatgaagggtggtgcattaaaaccagttaatagcagcgcggaaggtgtggggtcagtcccatttgtgcacttgttttgctctctgtggatgcctgaggtttatatagatgatttgaagaagatggaacctgttatgaatgtgggagaaatcaaggaaacccggaagaaattagtgtgtagtgtttgcaaagcaaagtgtggtgcatgtgttcggtgtagtcatgtttttcattggttgctgagggtcgaacacaatactccttcttttcctagctttgagactggctatgagatcataggaagctgcagagcttctttccatcctttatgtgcaagggaagctagacataggatggaggtttgggctaagtatggtaatgataatgttgagttgcgggctttttgcttgaaacactcagatctaccagaaaacagaagcatctttccattggaaggctctatcgcagttaggaatgatatctcagaagccaaaggctttccagtgacattgccattgagtggtgaacagaacttgaaagattgcaggaatcgagaattagcctctgatagtagtcctgacaaactgaaccataatgatgaaccaccagatggaggattatctggttgcaggataagtgctcatgatgacatgttgggatgtggtgctgtgccccaacaaaatgttggagtggtagggagagccaatgagaatattgatgcatctgactctctcagttttgcgcttgttttgaagaagttgattgatcgaggaaaagttgatgtaaaagatgtagcattggagattggcatttcaccagatacattaactgcaaataccaatgaagcttatatggcccctgatgtccaacacaaaatagtcaattggctaaaagcccatgtatatactaatgcatttcagaagggtttaaaagttaaattcaaaccagccaatgcatccaaaaatgatagtggagccacagatggttctgatactttaccaatgtcagattcgggtttgttggatcctgttgctgttaagtcagttccgcccaggagaagaaccaccaataacattagaattttgaaggataataatgtgttatgttcatctgaaggggttactggtgagaatgggatgccggtggacatgtgccgagtaggtcagtctgactgtgacaatccaacaaattataatgaagcatccattcccaatgcaactgaaatgaacttaaccaagtctgaggatatttttcatgaagttcaaggcaatgcttctggatgtgtctcagaagacaagtctactgcttgtttgcaaaatgcttctgtgctttctgatcactgtgttgtccattctgcttcagaaccacctgattttggtttcataaagaaggatgcaatctctagttacattcatccatacatcaacaagaaattgctgcagattcgtgatggggtgcccttggaggacattatatgttcaagtgatgagggaaattcttctttggttgaatcctttgggggtagtgcctgctcaagtacccaaaatcagaacttaactcaagttgatttttcaaagcctgatgaagtaaatatggagcagttggttagggctataaaaatgggactttttgaattttctccacaagatgaattggagggggaacttgtttattttcagcatagattattgcagaatgcagttgcaaaaaagaggcatattgataacttaatctatagtgttgccaagagtttgccacatgagattgataaggcacatcaacaaagatgggatgaagttattgttaatcaatatctgcgtgatcttagagaggcaaaaaagcaaggcagaaaagaaagaaagcacaaagaagcacaggcagtgttggctgctgcaactgctgctgcagcagcatctactagggctctccggaaagacaacttagatgaatcaatgcaacaagagaatacgatctttttccagaatttgttaaaattggatactctaaatggaagaaccggtgcttgttctcagccaatgcctcgagccaaagagacactttcaagagtagctgtgacaagaacttcgtccgagaaatattcagaattttgcatgccaacctcagatttgtctaaggagcaatgtaaatcatgtgatatttgcagacgatcagagtttattttaaaccctatcctagtgtgctctggttgcaaggtttcggtgcacttggattgttatcgtagtgtgaaagaaacaacaggtccgtggtactgtgagttatgtgaagatttgtcctctagaagctctggggcagctgctatcaatttctgggagaagtctgttgtagaatgtgctctctgtggtggtactactggtgcttttagaaagtcttctgatggtcaatgggttcatgccttctgtgctgagtgggtttttgagtctacattcaaaagaggacaaatagatgctgttgaaggaatggaaactttgcaaaaaggagttgacatttgttgcatctgccaccacaagcatggtgtatgcatgaagtgttgctacggtcattgtcagaccacattccatccatcctgtgctagaagagctggtttgtacatgaatgtgaggcctactggtggcaaggctcaacacaaagcttactgtgaaaaacatagtttggagcagaaggcaaagtttgtgctcctcatttgtcaggctgaaactcaaaaacatggaattgaagagttaaaaagtatcaggcagattaggtgtcttctgatatataggtcactccgtggttctgcagaactgaaatga

SEQ ID NO: 55135 - DNA, 1635 bp, Glycine max
  Peptide Sequence Number=SeqID_146820
atggctaaagttggtaagttgcggagcaaggctcgaggtcacaggccaagcccacatcttttgtcttgtgaaagaaaaaatctgaaagatgttaatgtaaggaagagctcttctaaagcattggagaagaaagattgggaagatgcaacctgctcagtctgtatggaggtcccccacaatgctatccttctcctttgttcatcttatgataaggggtgtcgcccatacatgtgtgccactagtcatcgctattcaaactgttttgaacaatacaaaaaggcatatacgaaagcaacatctgttcaaagcttgcagctagaagcaaacaattccaatattgatttaagcacaggtgaacctaaagacgatactgaagttcctgagcttctttgccccctttgtcgccggcaggtgaaaggttggacagtggttgaagtggcacggaagtgtctgaatgcgaagaaaagaagttgcatgcaagatgattgctcttttgtggggaattacaaggagcttaggaagcatgttaggtctaagcatccatttgcacgaccacgagaagtggacccactaaaagaagaaaaatggaagagatttgagtgtgaaagagaacggaatgatgtgattagcacaattttatcttcaacaccaggggctatggtacttggggattatgtgctggagccaaatgaccatgctttttatagtgacgagtatgattctgatgaggaatatctagaggatgatttcttctcggtgaggtccattggtttggggagaactggccactttttgccaaacatcaggtataatcaggaccgtgctgctgataattttgatgttgatcattttggtttgcagagtgttgcatctacaggttctgcggctgtctctggacgcggactccacaggatattgttaggaaggtctagaagacgacggaggcataggatagcaaatgcaagaaggacaacttggcacaacaacttcaagcaaaaatctgcaacatctagcctcaacctaatgcaaaagataaatggttgtggctatgggaagggtcaggagaattctcagttcgctccgcatatcaggccagatttgatgatggtgttattcatgaagaagatcagcaaagaacagaagaagatggcacaaacgctggcaatgcccgtggcaccttcgctagctatcatctccaattctcgcctctccaacacactctccgttcccgttctgaacaaaccaaaggttcaagggtcaagcatcaagtgcgttcgtgttggtggtgtggagattccgaacaacaagcgaatcgagtactcgctgcagtacattcatggagttggaaggaccagagcgaaacagattctctgtgatatccaaatggataataaaatcacgaaggaactcactgaggaggagctaatcacactcagggacgaggtctccaaatacatgattgaaggcgacctgagacggttcaatgcggttaatataaagagactgaaggatattcagtgctacagaggaataaggcatattcaggggcttccttgcagaggccagcgaaccaagaataattgcagaaccttgaagggtaagaaggttgccattgccggtaaaaagaaaaagtaa

SEQ ID NO: 55136 - DNA, 495 bp, Glycine max
  Peptide Sequence Number=SeqID_146821
atgggtttctccaagcaacagcttcttgcgcggttaaaggagcttcagattccattttcccagtatgaacatccagttgttttgaccgttgacgctcagcggcttggtttgggaaaaggtggtctcagaatggcacctgaggaggctttgggtgaagtacttcaggccaatcctaaagtgggaaaagatcaaccccctgatctagctgcactagttccatctggtttgatagtcttacccgatcaaccacaaaaacaatcttcttcacaggttcctgaggatgcaaaccatgtttccatggataatggaaccaatacagtttctgatgctgggcaattcgttgaagagatattgcaaaaaacatcacagttattgctttcagaggtcaaggatgaaaatataaagttacatggggagcagctcggtactgtgttatctgacaaattactgaaaaacctcaatgcagagtttaagaaccttgctgtaagtatatga

SEQ ID NO: 55137 - DNA, 1281 bp, Glycine max
  Peptide Sequence Number=SeqID_146822
atgagcaaacccaaaactcaaagaaaaccaaccattaccaaacatgtcagccaaaaccaaaaccaagaggcacagaaaacagagaaacaaccttcatgggtggtgagaggcctactagcttgtagaaatgtgcaaatccaacaaaatcagccgcagcagaaggaagcaaaatcacccccagaagcaaaagaaaacaggaaaaaacaggaacatagaaagctgcaagaggaacgagtcccagaagaaaacagcaagaaatccaagaagatgaaatgctcaggatcgctttgtaacaacaccaagatcactgcaaagcctgacacagcaaccccagatgttcacaagaaaaggttgttactaagtgggtgcaacaacaagaacgatgcttccagcagatccatgaaagcacctcttaatgaactcaatggaaccgtgtcagcctcttcttcttctttgtcagcatcttcaacttcttctggcggtggttctttcaggggaatgccattcaggagactctccggttgttatgagtgtagaatggtggtagacccagttcttggcttcactagagacccttctctaaggagtagcatttgttcttgccctgactgtggtgagatcatgaaagctgaaagcttggaacatcaccaggctgtcaaacatgcagtttcagaactgggtccagaagacaccagcaaaaacatagttgagataatattccactccagctggctgaagaagcaatctccagtgtgcaaaatagaccgcatcctcaaggtccacaacactcagaaaacaataaccaaattcgaagagtacagagactccataaaagccaaggccacaaagctctccaagaagcaccctcgttgcatagcagacggcaacgagcttctcaggttccactgcacctccttcaattgctccctgggcctaaacggttcctccaacttgtgcaactcgataccacagtgtaacgtgtgcagcataatcaagcacgggttcaaggtcaccggaggagccggtatcttgacgacggcgacgagtggaaaggctcacgacaaggcggcgtgtgtggaggagagtgaggagaagagggcaatgctggtttgtagagtgatagcaggcagggtgaagaagaatgcagaaggtggcatggaggagtatgattctgttgctgttgccggtgctgttggagcttattctaatttggatgagttgcttgtgttcaaccctaaagctatattgccttgctttgttgtaatctatagaggcttttga

SEQ ID NO: 55138 - DNA, 807 bp, Glycine max
  Peptide Sequence Number=SeqID_146823
atggtctctgcaatcaccaattctgggagaccccacgaggctcttaccctctacaaccacatgctggaatccaaaactgtgcaacctaatcagtttttgtactctgcggttctcaaggcatgtggtctcatgggtgatgttgaattgggcaagttggctcaccaacatgtatctcaagctaggttagagtttgacacagttctgatgaatgcccttttggacatgtacgtcaaatgtgggagcttgagggatgccaaacgagttttctgtgtaaaaattccacttcatggaacaccctcattcttggaccatgctaaacagggtctgatgagggatgcgttgaatctgttcgatcaaatgccagaaccagaccttgtttcttggaatagcatcattgctggtcttgcagataatgctagcccccatgcattgcaatttttttctatgatgcatgggaagggccttaaacatgatgcattcacattcccatgtgccctcaaaacatgcagtcttcttggagagttaaccatggggagacagattcattgttgtattataaagtcagggtttgagtgtagctgctattgtatatcagcattgattgacattatggaattctatgctttctgggtatgttgccaatggagattggtggaaggcactcagtatgatttgtataccttttgtattgcattaaaggtctgcatctattttggtaacttgaggttggtatttcaagtgcatggattggtcatcaccggtggctatgagttggattatgttgttggaagcattcctcctaaataa

SEQ ID NO: 55139 - DNA, 1428 bp, Glycine max
  Peptide Sequence Number=SeqID_146824
atggcttctgagaaggttgagactgttgttgcagggaattacttagaaatggagagggaagaggaaggttctaagtccaccagtggcaaattgtctaggctcttttggcatggtggctctgtctatgatgcatggtttagctgtgcttctaatcaggcacttactcacactgctttgataattatgtgtatttttcccatattgaagcaaattaaaccttcttttggtgtggcaattaagggtctcatgattttccttcttttttatggactgatgggaagctggactgcttaccttatcagtgtcctttatgttgagtacagaaccagaaaggagagagaaaaagttgatttcagaaaccatgttattcagtggtttgaagtgcttgatggacttttgggcaaacactggagaaatcttggtctttttttcaactgtactttccttctgtttggatcagtaattcaactaattgcttgtgcaagtaacatatactacataaatgacaatctggacaaaagaacttggacttacatctttggcgcatgctgtgcaacaacagtcttcatcccttctttccacaattacagaatgtggtcattcttaggcctcgtgatgaccacttacactgcatggtatatgaccatagcttcccttacccatggccaggctgagggggtgacgcacacagggccagccaaattggttctctacttcactggggctaccaacattctctatacttttggtggacatgctgttacagtggaaattatgcatgcaatgtggaagccacagaagtttaagatgatatatctgatcgcaaccctatatgtgctgaccctaactttgccatcggcatctgcagtttattgggcatttggggaccagcttctcacccattccaatgccctctcattgctcccaaggtctggcttcagagataccgccgtcatcctcatgctcattcatcagttcataacttttggatttgcttgcactcctttatacttcgtgtgggagaaattcattggggtgcatgagaccaagagtttgttcaaaagagctttggctagacttcctgttgtgattccaatatggttcctggcaatcatattccctttctttggtcccattaactcaactgttggatctctccttgtcagcttcactgtttacatcattcctgctttggctcacatggttacctttgcttcagcaccggctagagagaatgctgtggagagaccaccatcaaagttaggaggttgggtaggattgtactccatgaacgtgtttgtggtggtatgggttttggtggtaggatttgggttgggaggatgggcaagcatgatcaatttcatacaccaaattgacacatttgggctatttgcaaagtgctatcaatgtccccctcacaaggcttaa

SEQ ID NO: 55140 - DNA, 93 bp, Glycine max
  Peptide Sequence Number=SeqID_146825
atggagatccctcaccaggttgtgtttcttcctgtgttggttggtgcatttcttaatcaatatttccaatctcttgttatatttggcatgcag

SEQ ID NO: 55141 - DNA, 183 bp, Glycine max
  Peptide Sequence Number=SeqID_146826
atggcaccaccactcaagcatctggctatagattggatgatcttgttgagggtgcgagaaaaagacatcgccctattcaagggtggttatgttttagttctatgcattggggcattgaatctgttaagtgtgcattgtgaagggttttcactagcacagtttgtaccaccccaatatatataa

SEQ ID NO: 55142 - DNA, 729 bp, Glycine max
  Peptide Sequence Number=SeqID_146827
atgcagaggattcctgaagaatttattaaaagatttggagatgaactatctaatgttgctacggttactgttcccgatggccgtgtttggaaaatgagattgaagaaatgtggtaaagatgtttcgttccgcagcaaatggcgagagtttgtagaatactattctctcggttatggttcctacctagttttcagatatgaagggaattcaaaatttcgtgttctgatatttgatactacttctgctgagatttgttatccagacttggacaataggaagaggtccaaggttgatgatcaaacaagaaagaaagagcataaggaagctattgatgaagatgatgtgaatttgaaagcatggaagaaagaaagtgattgttcggagatagcaaaggatgcttctaccaagccaaaacacccttctgttacttgtaccatccagccttatcggttgtatgtgagaagtcacttttctaaaaagcatctgaagccaaatgtttgtatgatgctccaaaattgtaatggggagcagtgggatgtttcttgcgtatgccataatacgcgctatggaggaatgatgctaacaagaggatggcgtaaatttgtaagggacaacgatctatccgaaggagatccttgcgtattggagttgatcgagaccaacccagctgttgtgcttaaacttactgtgcttggtgcacctgaatatcacagttcacgtccgcactga

SEQ ID NO: 55143 - DNA, 1104 bp, Glycine max
  Peptide Sequence Number=SeqID_146828
atgctgctgagaagtgttttaaacttatttgtgattgatgaatatgcagtgcatggcgttgaaggttccatttctggaattccactgacttctgagtcaggaaagaaaaaattccttcttcttaaagggaaacagcaggacattcccagtgtaggttttgttttaccaatgaaggccactgaggccacagtaaaacagcaaaacgtacaatctggaaattctcctatttcaactcctgcaaaacagaaccagagacgtgaagctagtggaagattgattaggagcatacttctaaataatgaagctcgtcaaagtcagtctacaactggtacacaacataaaattcaaattttaagttctgagaatgggcagcgaccctctcgtcgttttggttcaaggtctgggttaaataatcaagtctcaaatcatgatgctgcacaaattaattccgaaggggattctagaagagcattggacgaaaagttcataaaaagggatcttcatggtttggggagcagtgccaaaacagaaaaacgtactagaaacaaggatagacctgatcgaggtgtttggacaccccttcgtcgttctgatgtttcgcatgctggtaacgactattcatcatcctcattggcacagcctactcagtcaaatcctgaatctgctgaaggagaagtaaaagaaaatgttccttctggaaacaggggaggtgaattctctgcttctgcaggtggacacggtggcaatccttcaattgagaatggttctcaaagaaattttattcatcatggagcttcctatgtagtgaaggatgatggtgcagtcagtagtataagcaaagggaaaccttccaagaaaagtgttgggcatagtgctcacgagtcagggcatcattcctgctatggtctccgtataggacgtaatcctcaactaattcaggtcaacctgagtctgagcgacttgaaaggatggctcagtgtaagaggttctcacctgggaagttgggggaggatagatatatgcagccccacccctcaacctgagaggttgtttatagaattagaacctgtgacctgcaagttacaaggcagtaatttgaaataa

SEQ ID NO: 55144 - DNA, 1194 bp, Glycine max
  Peptide Sequence Number=SeqID_146829
atggctgctttagagcctatcaaggacaatgaagaagctgtcaaggcttatggaattcacctgggaactgaaatgtgcaaaaagattttagctcatggaattaagacattgcatctttatacactaaatatggagaaatctgcattggcaatactaatggtgaaccttggcctaattgaagagtccaaagtttctaggtccttaccttggagacgccctgcaaatgttttccgtgttaaagaagatgtccgtccaatcttttgggcaaatcgaccaaaaagctacatatcaaggaccataggatgggatcaatacccacatgggcgttggggtgattcctgtaatccatcatatggtgcattatctgattatcagttcatgcggccacgtgcacgggacaagaagcttgttgaagaatgggcagttcccttgaaaagcgttgaagatatatatgagaggtttagactgtattgccttggaaagttgagaagcaatccttggtcagaacttgatggtcttcagcctgagacaaagatcataaatgagcagctggagaagattaacacaaagggcttcctcaccatcaatagccagccagctgtcaatggggaaaagtcagattctcctactgggcttagtagtcataggctcatagcggggtggaaccacatacagccacagttatttgttgtcttgaacaacggcggtcaagaatatgatcagaattcccattacaacaagactctggtaatcatctgctttttaactatgttaggttacctgcagatgtccagttctgggattgagaaggcatatgtagagttcttctgctctaaggaaaagctggatgcacttgttgataaatgcaaggatcgaacatctttaacttatatggctgtgaataaagatgggagctggaaatctaatgtgggtcaaactgacgttaatgctgtgacatggggtgtcttcccagctaaggagataattcaaccaaccattgtagatcctgtcagcttcaatgtatggaaggatgaggcatttgaaatttggtcaagaggatgggcaagcttgtaccctgaggatgaggcatccaggaaattggttgaagaggttgggggcagtcacttcttggttagtttggtcgacaatgattacatcaatggtgatctttttgccgtctttgcagatttctga

SEQ ID NO: 55145 - DNA, 1056 bp, Glycine max
  Peptide Sequence Number=SeqID_146830
atgagatccaaaacaacccaattcacatgtaccttcaaggtagcccttctcagccttgcggttttctgcctcttcatcttggtattcaggtcatccatattctcattgtctcctcaactcacctcacaaaccaacatgtcaagctcagacacaatagtaccagtgtcaccacaagaaacagaaaatgcaggcacaccatcatcatcatcatgcccaaattcaccccccttgaaccccccatgcaccaaggcccctccatcattagccaatgccatcatccactatgcgaccgccaacgtcacgcctcagcagaccctccacgagatatcagtctcagcaagggtacttgagaagaagtctccatgcaacttccttgtgttcggccttggccatgacagcctcatgtggacatcgctaaattacggcggccggacggttttcctcgaggaggacaagtcctggatcgaccaaatccaggagaaggtaccctctttggagtcctaccatgtcatgtacgacacacaggtccaccaggctgaagagctcatgaaaactggaatgaaggaggattgccagaaggttacggacccgagattctccaggtgccctcttgcacacaaggggctcccgagtgaggtttatgacattgattgggacgtgatcatggtggatgcacccaccggctacttcgatgaggcgccagggaggatgagtgcaatctacactgctggcttgattgcccggaacaaggaacgcggccaaaccgatgtttttgtgcatgatgtggataggaaagtggaggacatgttctctaaggcttttctctgtgaagggtatttcaaggagcaagaagggaggatcaggcacttcaacattccaagccacagtgaatgggtgctcgcggcgacatgcaccaatgaaggtctatacgttctaacctacgaacaaagatgcattttgggtgaagctgctgctgtgctacgcaacaacgatggcgaagttgggtcaagtcgacgtgaaccaagtggtgcatcgtgcgcgtgtgggtggaagtag

SEQ ID NO: 55146 - DNA, 993 bp, Glycine max
  Peptide Sequence Number=SeqID_146831
atgccagctagtgagcaacaaaacctggaaaactggttgcccataagtgcttctagaaaagcaaaatggtggtattcaacattccacaatgtaacggctatggttggggctggcgtgttaggcttgccatttgctgtagcccagcttggatggattccaggtgttttcatgatcatgttttcatggatcctgacattttatgccctgtggcaacttattcacttgcatgaagtggtcccagggaagaggtttgatcgatactttgaattgggaaaacatgttttgggcccaaaaaaaggattctggctagtaatgccacaacagctaacggttcaggtggcttcagccattgtgtacactgtcactggtgggaagtcattgaagaaggtgttcgatacagttgttccatccatgactgacattagacaaacatattacattctcttctttgtatgcttgcagttgttgctttcccaaactcctaacttcaataaactgaaatcagtgtcttccctggctgctctcatgtctgtctgttattccatggtggcaagttgcatgtcaattgttgaggggattggacgtcatcatcatcatcatcatattgattatggagttcgatcccacacaacccctgggatagttcttgacgcattcaatgcccttggaaccatagcatttgcttttgctggacatagtgttgctttagagattcaggctacgttaccctccacagaagaaaaaccttccaacataccaatgtggcgagtgtctggcttttgggcatatggaaatgctgtcgacgatgatgtcctcatcacactcgaacaccccaattggcttattgctattgctaacttcatggttttcattcatgtcttaggaagctttcagatttgtgtcattgttggtggtataatagcagtagttgcacccattggaggagtacgaacaattattgtttcggcaaagacttacaagctattttcctaa

SEQ ID NO: 55147 - DNA, 822 bp, Glycine max
  Peptide Sequence Number=SeqID_146832
atggctgcaaggaggaagacgctgcaaaattcttctgatgattattcaaagattgtagacttagtaagccggtttgctattcatcatattaatgtcagtttctcgtgcagaaagcatggagctgttagggctgatgttcacactgtggccatgtcttcaaggctcgatgccatcaaatctgtctatggggtctcagttgctcgcaatctgattgaaattgaagcctcagacaatgatccatctacttcggtttttgagatgcatggctacatgtccaatgcaaattatgctgcaaagaaaatcaccatggtgagccttttaaatcaggaagtcatcattgagaagatacagtctgtggttgaatcaacattgaggagttccaacgaggcacggacatttcaagaacaatcagctgggcaatcttcatcgcctcgtattaatacaagtaaggaggttaacctcagccctatgccaacaggttcaagattattgaaagtgccggtacataagttggttagaacagattcattagatcctgctggaagattacatgcctacacgcaaattatgtctgatagacatcttgaaaagagtgctagtttgaatgcaataaggtcttcggttagacaaagaaggaacccaaaagattctttagaactcactagtgttcaagagcttcttgacaagatcaatagcaactgtgaccctggcatgacagacatcataaggcattgcacatatgttggaatggcagatgatgtttttgctttgcttcagcataatactcgtctttatcttgcaaatgttgtaaacttgaggtag

SEQ ID NO: 55148 - DNA, 1470 bp, Glycine max
  Peptide Sequence Number=SeqID_146833
atggacatatacgagccatttcagcaagttagcatgtgggggggcaactttaaagttgatggcggtctgaattcaattgcttccccaatgttaatggttggcactaatgtggagaacaagtcagagtatattcctcgggaaccaagagagccttctggttctggagccgatcaagaaactacaaataaagatgttaataagatgctaagacgcctagctcagaatcgagaggctgcccggaaaagtaggctgcggaaaaaggcttatgttaaacaattagaatcaagccgtttgaagctcatgcaattggagctggaaattgggaaagcaagaaagcagggtctgtatatgggcactgcattagatgccggctatataggatcaacatcagaaacaataaatccagggattgttgcttttgaaattgaatatggacaatgggttgaagagcaagaaaggcggaatgaagaacttagacatgcatttcaaacacaagcacctggtgtacagctcaacgtagtggttcagagtgtcttaaatcattactcaaatcttttcagaatgaaagcagaggctgtaaaggctgatgtcctctatttactctctggtgcgtggaaaccatcagtggagcgaattttcctttggattggaggctcccgtccatcgcagcttctaaacatcatcgtgcctcaacttgagcctttgactgatcaacaaattgttagtattaacaacctccgcctatcgtctcagcaagctgaagatgctctttcacaaggattggaaaaacttcagcagagtttggtccacgacatggcagttgatccattgagtgtaggaaacttgggacttcagatggctcgtactatggaaaaatttgaggcactagaaggttttgtaaaccagaatgttcgtatgaagcagttcatggctagtgagtgtttctttaactgtgtgccatacaacttagttgtgatacagctcttctgtggtggaacacttgaagaaggtgaaacagcagaagctagattcatcaagattcaagctgcttatgaattgcttatagatggagagaggcgaagacagtatgatatggataactgggtcaaccccatgaaggcatctcaggcatggatggagtggcttataaaaaagcgaaaagctttcgatcagcggggtgatatggcaattgctgcttgggctgagcagcaacagcgcgagctaaatcttcgcgtgcgtcaactttctcgttcaaagattgatccagatgaagcaagaaggattctggcaagagaaaaaaaggcttcggctgaatattactcgaatacccttaaaaggcacacccttgtactgaagaaaagagatttgatgcgaagaaaggctgaggaagaaaagaagaagactatcagccggctcttggcagcagaaggtcttgagcttgatgattcagatagtgatgaggcactgtag

SEQ ID NO: 55149 - DNA, 1833 bp, Glycine max
  Peptide Sequence Number=SeqID_146834
atgcagaaactgctacgcccttcttcagttcccttcctctctatctctgtcaccgtggctactccctttctttcgttgcctcccaaagttgcaaaccaaccaatgtcagcagctgctgctggttcttctctcaagcgccaactctcttattcccgctatttggcgctctctagtaccaacacttgctctgtctgcaggtgtctcagtctaacccacacccactcccaccccaagaataacaagacccttcttctccttaaccactctagaaaccgctccttgcattcggcttcagaaggctctttcatcacccaacccgaccctgttgagtatggttctcttgtggactcaaaagagaagccctttaactccaggctaaataggaggcaaaagggttctacttcttcttctcctgctccgtcaaatcctgatttgctggccatccccggtgtgggtcccagaaatttcagaaagctcgttcagaaaggtatcgctggtgttgcgcaactcaagcaactctacaaggataagttctttggcaaatctagtgacaagatggttgagtatctacagaattctgttggaataatccacaagaaccatgctgagagtataactactttcattaaacagagtgttgacgaggaggagttggaagacaattcctcttcctctgttcagaagaagcgcttaacattctgtgttgagggtaacattagcgttggcaagactaccttcctccagagaatagcgaatgaaacgatcgagttgcgtgatcttgttgaggtggttcctgaacccattagcaagtggcaggatgttggacctgatcactttaacattttggatgctttttatgccgagccgcaacggtatgcctacacctttcagaactatgtgtttgtcacacgggtcatgcaggaaagagagtcatctgctggaatcaagcctcttcgtttgatggagaggagtgttttcagtgacaggatggtttttgtacgagctgtccatgaagctaactggatgaatgggatggagatcagtatctatgactcgtggtttgatcctgtagtatcctccttgcctggacttattcctgatggttttatctatcttagggcaagtcctgacacttgccataagagaatgatgttaagaaaaagaacagaagaaggtggagtcagccttgactatctctgcgacctccatgaaaagcatgaaagctggttatttccctcccaaagtggtaatcatggagtattatctgtcaatcagctgccccatcatattgacaactctttacaccctgatataagagaccgcgttttttatctggagggtggtcacatgcattcaagcattcagaaggtacaatatttggaaatcccatgtcggaatttgtttgttatggtaaactggcttaaccatttgaactataaacaggttcctgctttggttctggactgtgaacccaatattgatttcagcaaagatatcgaagcaaagaggcagtgcctatgtcccaattgcaaggtatgggacttgattcctacatctcaatctctacttggaactagactagtgcacagcctggctatgtgtgctgggactggagagcatagtgggatatatgcacgccaagttgcagaattttttgaatttgtgaagaaaaggaatgaggtctcatccaaggaaggaagtagccaagcccaaccgcaggtgctgctacctcatgagggtggcctgtggctaccagatgggaagccttttccccgggaagctctcaaatctttggacttcagacaagcagcaacgtcattcatgtccggctag

SEQ ID NO: 55150 - DNA, 1890 bp, Glycine max
  Peptide Sequence Number=SeqID_146835
atgaccgattacgaagagagatacgaagggaacggagaagaagaggaacttcacaattctcatcatcagcctcatcctgattcctctcctttacccacccacgacgatctcaccgattccaaatctcgcctgcttttcagcatggatctcgcgattatgacagagattcttccagaagcagagataaggagcgggagaaagggagagacagggagagaaaaagggaaaaggggagggacagggaaagggagaaaagtagggatagggattcggagagaagcagggacaaggacagagatagggataagagcaaagacagggagagggaccgggatcgtgatggtgagaaggaaagggaccgtgacagggaccgccatcatagagatcgacacagggatcgtggtgagagaagggaaaggacaagggatagagatgacgatgattatcacagaagtcgtgactttgacagaagaagggattatgatagagaggataagcataggcgcaggtctcggtctcgatctcaatcccggtcagggggtcgatctgagcatagatcaaggtcacgttcgcgttctcgttcaaagagttcaggtggaagggcacccctttctgttccttgatcatttcaaagcatctcgttttaagaattttgttagatgtggcaaaaggactagtggttttgatatggctccccctgcctctgctatgttgactggtgcttctgctgttgcaggtcagatcactggggcaaatcctacaattcctggaatgtttccaaatatgtttccgttggctacaagtcagatgcagcaatttagtgctctccctgtcatgccagtgcaggctatgactcaacaggctacacgacatgctaggcgggtgtatgttggaggcctccctcctacagctaatgagcagtctgttgcaactttcttcagtcaagttatggctaagattgggggaaacactgctggcccaggtgatgctgtggtcaatgtttacattaatcatgacaagaagtttgcctttgtggagatgaggtctgttgaggaagctagcaatgcgatggctctggatgggattattttcgagggggcacctgttaaggtcaggagacctactgattataatccttccttagctgctaccctaggcccaagccaacctaacccaaaccttaatctgggtgctgttggcttaacacctgggtcggctgggggacttgatggtcctgatcgggtttttgttggtggacttccttattactttactgaaacacagatcagagagcttttagagacttttgggcctctacggggttttgatctagtgaaagatagagaaacgggaaactcaaagggttatgcgttttgtgtttaccaggatcttgcagttacagatattgcatgtgctgctctaaatggaataaagatgggagataagactcttacagttagacgagctaatcaaggtgcaaacccacagcagcctaaacccgagcaagagagcattttaatgcacgcacaacagcagattgcactgcagaaacttatgttgcagccagccttagtggcaacaaaggtggtgtgtttaactcatgcagtttcttctgatgagctcaaagatgatgaagactatgaagagattcttgatgatatgagacaggagtgctccaaatttggtactttggtgaatgtggtgatcccacgaccaccgtctgatggtgaacctgccgctggagttggaaaggtgtttttggagtacgttgatattgacggtgctacaaaagcccgtgccggattaaatggccgaaaatttgatggaaatcaagtagtagctgttttctatccagagaacaaatttgctcagggagattatgaaggttaa

SEQ ID NO: 55151 - DNA, 1608 bp, Glycine max
  Peptide Sequence Number=SeqID_146836
atgacaggaacatattcacgcataagctgcatgactcagcacctttgttccatgttggaactgaaacaagttcaagccattatcaccaaagcaggccttcactctcaccttcccttcactgccaagttaatcttcttttctgcactttctcctatgggaaacctctcccatgctcattccctcttcctacaaacttccatgcacaactccttcatttgcaacactatgattcgagcctttgccaactcttcctaccctcttcaagctctatacatctacaaccacatgcacaccaccaatgttgtctccgaccatttcacctacaactttgtgctcaaggcatgctccagagcacacaagtttgcccaagaatttgtcaaatgtgatgagtttattattatttcgaaagggggtgaagttcactgcactgttcttaaactcgggttggaccaagacccctctattcagaactcgttgctctgtatgtactctcaatgtgggttggtccatgttgcacaacacttgtttgatgaaatcagcaataggagtttggtttcttggaatatcatgatatcggcatatgatcgtgtcaacgattctaaatcggctgattaccttcttgaatcgatgccacacaagaatgttgtttcatggaacactgtgataggaaggtacatcaggttaggtgatattgagggtgcaagaagggtgttccaaattatgcctcagagggatgctgtgtcatggaattctctgattgctggttgtgtctctgttaaggattatgaaggagcaatgggactgttttcagagatgcaaaatgctgaagtaagaccgacagaagtaacacttatttcagttctgggtgcctgtgcagaaactggtgcactggaaatgggtagcaaaatacacgagtctctgaaagcatgtgggcataagattgaagggtatttaggaaacgcccttctgaatatgtattctaaatgtgggaagttgaattcagcttgggaggtatttaatgggatgaggataaaaactttgagttgttggaatgctatgattgttggtttggctgtccatggttactgtgaggaagctttgcaattgttttcagagatggaaagtggtcttgatacagttaggccgaatcgagtgacattccttggtgttttgattgcttgtagtcataagggtttggtagataaagcaagatggaattttgatcatatggcaaagcagtacaaaattctgcctgatatcaagcattatggttgcatagttgatcttttaagcagatttggattgttggaagaggcgcatcagatgattaagactgctcctttacaaaatagtgccattttatggagaacattgctgggtgcttgtaggacacaaggcaacgtggagttggctaaggtgtctttccaacaacttgccaaattgggacgcctaacagatggagattatgtgttgttatcaaacatttatgctgaagctgagagatgggatgaggtagagcgagtaaggagtgaaatgattggcttgcatgttcctaaacaagttgcgtacagccaaatcgatatgactgaatctgataagcttccctaa

SEQ ID NO: 55152 - DNA, 1383 bp, Glycine max
  Peptide Sequence Number=SeqID_146837
atggactcccaaccgggtctctctcttgggttaagcgtccctctctcttcacccgcggctccactctgtgatactacctctgttctgtggcgtttatttaacaaaagacaccccataaaggaggaagaagaagaagacgaagactatggtgaaacgattaacttcatggaccagagcgtgaagaggaagatagagggacaccaacaaccctgtttcccttcgaagcgcgtggcagtggattcctcagtggggtggtggaaccagccactgggcgttgcggaccccgagattttttatatcatggggaaggaaaaacaaagacagtttaagggaattgagttaattgcttcggaaaatttcgtgtgcagagcagtgatggaagctttgggaagccatctaagcaacaagtactctgagggaatgcctggtgctaagtactacactggtaatcaatacattgatgagattgagtttctctgttgccagcgtgcgttgttggcttttgatcttcaccccaacaattggggtgttaatgttcaaccttattcttgtacttctgctaatttcgctgtgtacactgggattttgcatcccggggataggattatgggtcttgattcgccttctggggggcatttgagtcatggttattatactttagggggaaagaaggtttcagctgcttctattttctttgagactttgccttataaggttaatccgcagagtggttacatagactatgataagcttgaggaaaaagcgctggattttaggcctaagatacttatctgtggtgggagttcgtatccaagggaatgggactatgcgaggttcagacaggttgctgataagtgtggggcagtgttgatgtgtgatatggctcatatcagtggtcttgtagcggctaaggaagtagctagtccatttgattactgtgatattgtcacctcaaccactcacaaaagtctccgaggtccaaggggaggtatcatcttttatagaaggggggcaaaaccaaggaagcaaggtttcgttcataatcatggagatgatagtaattatgatttcgaggagaaaataaactttgctttatatccatcgttacaaggaggcccccacaataatcatattgctgctcttgccatagctttaaaacaagttgcaactccagagtacaaagcatacatgcagcaggtgaagagaaatgcgcaggcattagcatctgccttgttgagaagaaatttcagattggtgactgatgggaccgacaatcatcttttgctatgggatctaacagcacttggcttaattgtaacgagttattatttggtgtactggtgtctgaagatgggaaatgattctagtacagaagtggcttaa

SEQ ID NO: 55153 - DNA, 162 bp, Glycine max
  Peptide Sequence Number=SeqID_146838
atggcttcctatggtgtggcatctctaaatcatctttcttccttctccattccgctgccattgatcatcaagaagcaaaggactccattgatgaagaatatccaaggcctacaacctccacatggagctacatcatgtggtatcaagagcatcttcatctag

SEQ ID NO: 55154 - DNA, 397 bp, Glycine max
  Peptide Sequence Number=SeqID_146839
atggttactatgataatggataccttgcctgtattctactatgagaaattagtgggctacatgccctctagctttgcagaattggtattcgccggagaaaggatcgaggtgggtttgaagaggggaaagttcgattatgtctcccccgcatgtgctagcggtaggaggaccggaacagctgaggcaaagaagaaagagggagatgcccataccgtcacttcaacgcccgcgtggcccaagccgccgcaaaccccccacggtacccaccaatatgcacaacatcacccaagtttttcggctcacgcaggaagctcttctgactcaacgctcgctcagccaagggcgcccacgcccccacagaggggggctcctcaggctccggctccaacccagcctt

SEQ ID NO: 55155 - DNA, 857 bp, Glycine max
  Peptide Sequence Number=SeqID_146840
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatattcattatcttcttgctacattgctttctcgctcttatgctttctggctttccgtttccatattttcttcctccaacttccaaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55156 - DNA, 768 bp, Glycine max
  Peptide Sequence Number=SeqID_146841
atggcgaatcaagaggagtgggtcccgtttatggacgtattagcattgctaatctttggggttgtcctctttccaaacgtggacggtttggtggacctagccgcaattgatgctttccttgcatatcaccatagcaaagaaagcccggtggtagccatcttggcagacttatttgacacatttgaccgaaggtgcgagaagagtagcgcacgaatcatctgttgtttacccgctctttgtgtatggttggttttgcacctattccaacaagacataaggcatccatgtctgctccgaagccatcgctcgtgtgtcgaaaagagaagagtagattggtaccaacacttggctgggatagaaggcaaaacaatcagctggtttcctcgatggaaggaaggaaaggagggagttctcttctcatgtggggactacccaaacatcccgttgataggaacgaggggttgtattaactacaatcccgcacttgctataagacagttagggtaccccatgaggggagcagcggcggaagagagcctttctcctttccttgtgagagattttggcgcgcaaggtttcaaggttatgcaaagagtccataaggcgtgggaaggccttttaaggaaagataaagaacttaggggcttccgtaatggcatcatcggtggttatcatgaatggctgaaagttcgtacacgagggttagattggctctccaagttgaaaattatcgatgaggagaacttcaaagctctggaagaggattaa

SEQ ID NO: 55157 - DNA, 405 bp, Glycine max
  Peptide Sequence Number=SeqID_146842
atgcaagcgcgcgtgaaatgggttgaaggtttaacgttcctgggcgagtccgcttccggacaccagattttgatggatggcaactccggcgataaagcgccaagcccaatggagatggtgctgatggcggcagggggatgcagcgccattgacgtggtgtcgattctgcagaaaggccgtcatgacgtgacagattgcgaggttaaactgacctcagaacgtcgtgaagaggcgccacgcctgttcacccacattaatctgcactttgttgtgaccggcaaagcgctgaaagacgcggcggtatcacgcgcggtggacctgtcggcagagaagtactgctctgtggcgttaatgctggagaaggcggtaaaaattacccattcgtacgaagtgatcgaggcgtaa

SEQ ID NO: 55158 - DNA, 348 bp, Glycine max
  Peptide Sequence Number=SeqID_146843
atggcctccaacattgtggccatttgctctttcatggcctccatgtcggccttcatctgctcttgcgcctcctctacttcaccaattactctagctctagcacaggacatggggttgaatcaatttagatttttcaacatggttcatgacatcttggtcaaggtgaaactggaagtaaccaggacatcaacagtcctaaatgtgtttggcagtagacaaagcagtgatgtaactcgatccatcttttgccctaatttttgcaagatggttacttccatatttcaacttgacttgatgaaccttttcgtaaaagctggagcttggttcaaccctataatccaaggaatg

SEQ ID NO: 55159 - DNA, 461 bp, Glycine max
  Peptide Sequence Number=SeqID_146844
atggaagccaatgcggttgcagttgccgctaccatcactgttgctaaggtgaacccgatgcccccatctggcctcaaccaaatgaatcatccaacctcagctatgacacatgaaattccccaccacaatctagccgaattcaagccttgcctcggatatgccactgaagggcaagcagttggtggtatacccctacaaaaccctttggagggccctcagtatcacccacaactacacctcttgcattccacaacaagtaaaaaccctcatgctatggcagaaatgggaaagttggatcatctagaggaaaggctcagggccattgaaggaggtgaagattatgcctttgctaacctagaagagttgttcgtagtacccaatatcatcacccctcccaagttcaaggtgctggactttgacaagtacaaggggactacttgccccaagaaccatctaaagat

SEQ ID NO: 55160 - DNA, 683 bp, Glycine max
  Peptide Sequence Number=SeqID_146845
atgggaatgttaatcgcgcgcattgttcttggcgtggcggaggggccgctgttctcactgaaaacgcgctttatcaacgacaacttcgccgccgatgaaataggcaagccgaatgcgctgaccgcccttggcgtatcgttggggctggcggtaggcttcccgctggtcacctggctgatggcgcacgttggctggatcggctccttctacgcgctggcgctgcttaacctgctactcggcggcggattaatctggcggtttctccccgcgccgcaagtgaccgcccagcgcgcgaagccgggcttcagccaaactttttccctcgcctggcgtacgccgctgctaggctggatcctgctggtggaaatcgccacgctcagctatctgtgggggagtagcgcctggttgcccgcctggctgcgcgacgagcaccacttctcactacaggccaccgggctgctggcggcagtcccctttctgttaagcctcggctcaaagtttcttggcggcgtgctcctcgacaaaatgcgcccggagcaggcaccgctgctgtttattatcggcggcctactcaccgccggttctgtgctggcgctgatgctcagccatcagccggcgatgctggcgctgtttatgctggcggcgaacgttttctggggattacaggggcggcgatccccgcg

SEQ ID NO: 55161 - DNA, 201 bp, Glycine max
  Peptide Sequence Number=SeqID_146846
atgagttgtacgggttcgctaagcacaccgcttcatctcactaagcgcaccgctttagttcattcgctaagcgagaaaggcgcgctaagccaaaaatcactaacgtgcgctaagcacacgagcacgaacaaggccacatatttaagcatgaaatcagattttagaccaaagcttgaaacaggagccggtttgagagcttga

SEQ ID NO: 55162 - DNA, 243 bp, Glycine max
  Peptide Sequence Number=SeqID_146847
atgatgacaaaggtgatgaacaaaaagcttataagatcaaagaacaactcaagtgaatcaaagaacaactcaagtgaatcaaagaacatctcaagtgaatcaagaacaagtcaagagttcaagaatcaagaagaattcaagactcaagaagaaagcctacaatcaagaatcaagattcaagatctcaagaatcaagatcaagattcaagaatgaagaaaagactcaatcaagataagtattaa

SEQ ID NO: 55163 - DNA, 495 bp, Glycine max
  Peptide Sequence Number=SeqID_146848
atggtgaaagttggaacctcttacgtgccgatcaacgtctcattttcgccaaaagttggcccagggcttcccggtatcaacagggacaccagcgatgttatttccgcacccaccgccttgctgcgaagcgctgatcgttccgaaatcacaggtcttattggcgcataccgtgcgcctcgggctgttccctcctgttcagtactgacggggtggtaccgcgtcacaattcggcacacaagcataccagccggaacatcagcgctggcaagtggctgcccgctttccattcgggaaaccatgtcaggctgcgcagctgcttatgaatcggccaacgcgcgggcgatcgagtgcgggcctttgcgtattacgccagctggcgctaaagggcggatgtgctgcatactggcgattactatgttggcactgataacgccagggtgttccagtcagaatgcgttcgtggcagaaaaaaggctgcaccggtgctcagcatga

SEQ ID NO: 55164 - DNA, 152 bp, Glycine max
  Peptide Sequence Number=SeqID_146849
atggcatcttcatcatcatcttcttcacacattaacattaaatctgaccccatcgatactgatgtattatggatgcaacctaagcatgtttcagaacatgtttggaatggggaagaagaaaggaaattgcatatcagacgagctgtccccac

SEQ ID NO: 55165 - DNA, 780 bp, Glycine max
  Peptide Sequence Number=SeqID_146850
atggttctcccgccacgaggcggcgttatcgggagccgtccccgctcgtgggagcagtgcttgtggcggtggctctgcggtgacttcttcggtcggaggctcgctcacgtccacgaagtcagagggattgttctgcgattgtacatcagcgtccgtcgtcggccgttcgcggccgggccggtacggagagggctccaggcccgggtgccgtcgcgtctgcacgatgaggatcacgataccgaggaggacaccgatgatcgcagccagcacgttgctgcgcagccccaggatgatctcgctcgggtcgatgcggatggactcccagacgatgcgccccgcgctgtaccagatgaggtacatcgcgaacagcctgccccactggaagtacagcttgcggccgagccagagcaggacgatcacgcccagaccgttccagatgacctcgtagaggaaggtcgggtggaacagcgtgccctcgggaagcccaggggggaacgccgagttggacgactcgatctccagcccccacggcaggtcggtcggcaggccgaacagctcgtggttgaaccagttgccgaaacggcccatcgcctgggccagcagcaggccaggggccaaggcgtcggcgaacgtccagaaccggatgcccgtccagcggcatccgaggtacgcgccgatcgcgccgccgatgagcgcgccatagatcgcgatgccgccctcccagatggcccacacggatcccggctgaagagggttccaggtgttcagcccctcgccgaa

SEQ ID NO: 55166 - DNA, 393 bp, Glycine max
  Peptide Sequence Number=SeqID_146851
atgaccggccctctcgtacctatcttcatcagagggctacacgtcctcgccattagaggactacacgtcctcgccttcagagggctacacaccctcacctttagaggactacacgtccttgcctccagagggccgcacgccctcaccttcaaaggactacacgtcctcgccttcagagggtcgcccgccctcgccttcagaggactacgcgtcttcaacttcagaggactacacgtcctcgccgtcaaagggtcatgtaccttcacctttatagggctacacgcccttaccttcagaggactacacgtcctcgcctttagtggactacacgtcctcgccatcagaggactacatgtcccccattttcaaagggcgacacgccctcacctttag

SEQ ID NO: 55167 - DNA, 551 bp, Glycine max
  Peptide Sequence Number=SeqID_146852
atggaggccatgatgagcgtgaagaagataatagaagccaatgcggttgcaatttccgctaccagcgttgttgctaaggtgaacccgacgtccccattcggcatcaaccaaatgaatcatccaacctcagatatggtagacaaagatttgggaagtatgggcggcccccatgatgtgcaaattcaaaacgagcacgccttcccgccatatggcttgcctctcaactatacgccacccaatatggcatatgccactgaagggcaagcagttggtggtataccccttgaaaacacttcggaaggccctcagtatcacccccaactacacctcttgcattccacaacaagtaaaaaccctcatgctatggcagaaatgggaaagttggatcatctagaggaaaggctcagggccattgaaggaggtgaagattatgcctttgctaaccttgaagaattgttcctagtacccaatatcatcacccctcccaagttcaaggtgccagactttgacgagtacaaggggactacttgccccaagaaccatctaaagat

SEQ ID NO: 55168 - DNA, 1278 bp, Glycine max
  Peptide Sequence Number=SeqID_146853
atggagcgcatcacgctggccaacgaagcgggcggcatcggcgtgtgggagtggaacctgctaaacggcgagatgttatgggacaagcgcatgtacgagttatttgcgctggagccgcagcgggtaccgagctacgacctgtggctgcatctggtcgatgttcaggaacgcgaagcggccgcgctcaccattcagcaggcgattgagcgccgcagcgccttccagctggagtatcgcatcaatctgccgcagggcgtgcgctacgtgcgctccgaggccaatagcatcatcagcaaggatgggcagatcgaacgcatgctgggcatttgtcaggacatcacctcgctgcgcacgctgaatgaagcgctgttccaggagaaggaacgcatggccatcaccctcgactcgatcggtgaagcggtgatttgtactgacgatgagatgcgggtgaccttcatgaatccggtggccgagacgctgagcggctggccgcaggcgaaagcggctggcgtggcgctgagcgaactgctgacgattacgcgtggcgcgcaggggccgcgcgtggagaatctgttgctgtgcagcctgcccgccagcaaaaccacaccggacctcgaagaagagctggtgttgcatacaccggacggtgcccaggtcgagattcactacagcatcacgccgctgaaaaccctgaccggcagcgacattggtgccgtaatggtcattcatgacgtcagcgagtcgcgccgcatgatgaaacgcctgagctacagcgcctctcacgatatgctgacgcgtttgccgaaccgtcacagctttgaacagcagctgaagcgactggtgaatgacgccgccgcgcatcacagcgagcacgtgctggtgtttatcgatctggataagtttaaagcggtcaacgataccgccggccatgccgctggcgatgcgctgctgcgcgcactggccgatctcatgcaacagcacctgcgcaatagcgatgtgctggcgcgcctcggcggtgacgaatttggcctgctgctgccctacagcaatgttgaccaggtgcgcgaggtggtgcagggcatcgtcagcgcggtgcatgactttacctttatctggcaggaccggccgtatcacgtcggcgccagcgccggtatcacgcaaatcgatcagcataactgcatcagcaatgtggtgatgtcgcaggccgatgtcgcctgttatagcgccaaacacgccgggcgcggccagtatcaggtttaccaggaagttcagggataa

SEQ ID NO: 55169 - DNA, 453 bp, Glycine max
  Peptide Sequence Number=SeqID_146854
atgtcctcgccaaagagggctacacgccctcaccttgagaggactacacgtcctcgccttgagaggactacacatcctcaccatcagagggctgcacgccctcacctccagaggactacacgtcctcgccttgagagggctacccgccctcgccttggggctgcacgccttcaccttgagaggactacacgtcctcgccttgagaggactacatgtcctcaccatgagagggctgcacgccctcacctccagaggactacacgtcctcgccttgagaggaggactacacatcctcgccttcagaggactgcacgtcctcaccttgagaggactacacgtcctcgccttgagaggactacatgtcctcaccatcagagggctgcatgccctcacctccagaggactacacgtcctcgccttgagagggctacccgccctcgccttgggtactag

SEQ ID NO: 55170 - DNA, 283 bp, Glycine max
  Peptide Sequence Number=SeqID_146855
gccaccaaacctgtctcagaaaaatgatgatctcggacttattcaccgttggattgtcgtgaaatttaaacagcatgttcaaaacccatttaggagcattctcaccgttgggaatttggatatcacgtctgagctaagagaaataccgggcgcattggagaaaaaggaatcgcatgaagatagtccaaatggaggctttaatcctttctccgtttctctgacgtttgggaactctattggagcagtcggaggaaaaactggaagaatcttagggaaccgttag

SEQ ID NO: 55171 - DNA, 813 bp, Glycine max
  Peptide Sequence Number=SeqID_146856
atggggccaagtcaaacgccttcgcttaaaaagaggttctatcaagtcaaggtcaagagcctagggatcaccagtctaagagagttagggcaattgatgggtcatctccagcgacaagtgtttcgcaaaacttacggtaaaatctgggacctagccatggcagaagtctctgcggaggccattgcatcccttgcccagtattatgaccagccgttgaggtgcttcacctttggggacttccagctatcacccatggtggaagaatttgaagagatcctaggatgccctctagggggaaggaaatcatacctcttctcaggattctatccctctttagctagaatttctaagatagtccaaatctcggcgcaggaatttgaccacagaaagcaagtcgaaaatggggtggttggaataccgagaaaatgtttggaggcaaaagcaagaatcttggcaggtagaggcgaatgggccccgttcatagacatcctcgcacttttgatctttagaggagtcctctttccaaatgtgaatgggttggtggacctggaagcgatcgacacttttctcgcctatcatgaccgcaaggaaagcccggttgtcgctatactagccgatttatatgacaccttcgaccgaagatgtgagaagagcagtacaaggattgtttgctgtactccggacctctatgtatggttggtttcacaccttttttgccaagaggtgaggcatgcttgcccgctagaaagccaccgttcatgcacagagaaaagaggggcaaattgggaccaactcttagcaagcaaagaatga

SEQ ID NO: 55172 - DNA, 162 bp, Glycine max
  Peptide Sequence Number=SeqID_146857
atgatccgacgacaatcaaaggcggctcgtggcggtcatcggtggtcagtggtggtggaggaggagcttgggggtgttgtggtgggtttaggggaagagaaggaagaagaagatggttgttttatgttagtaggcaagattggtgaagtgcagaatttatga

SEQ ID NO: 55173 - DNA, 258 bp, Glycine max
  Peptide Sequence Number=SeqID_146858
atgacacatcagccctcaagcgcaaggacgggcccaacatcaaagacaaacccgcttgccaatcaaggaaggggagcttttaatgccatcgaggcaagtagctcacgcgggcccaagcctttgaaggacgtaacaacctccagaagatttatctatgaagccctacaaaagtcgggcatgattcctcgcggtgggcacaagaaggattcctgtttgatgcatcccagtacgtcgcacaacatggaagcgtgttcggcg

SEQ ID NO: 55174 - DNA, 258 bp, Glycine max
  Peptide Sequence Number=SeqID_146859
atggctgctgttgcggttcagttgacgaccactcttacgatggcgcatgaccttatccttctcagtaaaaccttaacctgtgatccggttactcgtcagcaatgcttgctggtggccagttttccaggcgcatgcccagagacagaccacgttcggcgttttcagcaactcaacctcggtacgctgtaccagatcaccgatatagtggatagcttctgccttgaggcagttagcagagcggacagtcaattcgagatc

SEQ ID NO: 55175 - DNA, 876 bp, Glycine max
  Peptide Sequence Number=SeqID_146860
atgacggcgctatcgctgatgcggctcctgccacagggtgcggaaatcgactccggccgaatttcctttgccgggcgtgatattctcgccctgtcatccgccgaactcgacgcgttgcgcggcgcagatatcggtatgctgtttcagcagccacaggccatgctggatcccaccagccgggtgaggacgcaggttgccgaaccgctatgggtccatcgcaagatgagccggcacgccgctctcaatcgggtcgtcggccttctgtccgatgtcggtattcccgatccgtctgcacgggcgcaatgcttcgcgcacgaactttccggcggcatggcgcaacgtgtcatgatcgccgcggcactctcgggcaatccgcaactgctgatcgccgacgagccgacgacagcgctcgatgtcaccgttcaggcacagatattgcgcctgctcgatgacgagcgccgcaagcgccggctggccacgctgctcatcacccatgatctttcggttgtcgccgcattcgcggaccggatcgcggtcatgtatgccggccgcatcgtggaggaagggcccacccaggcgatcctcaaggcgccgcagcacccctataccaaggcgctcatcagctgctcgcttctgaccactgacggcgaggggcagttgctgacaatccccggctccagttcgcaggcccacgacatgtcctgcggctgccggtttcacccgcgctgcgcgctcgccaaatcccccggcatgggcagccgctgcatggcagccgaaccgaatctgaatgccctgccggaaggacgcaaggcccggtgctgggcagtgggtgacgagcaggtcaatcatgatcatgctggccacgcaatgtgctga

SEQ ID NO: 55176 - DNA, 255 bp, Glycine max
  Peptide Sequence Number=SeqID_146861
atggctatccaattcaagaagaaaacaaatgtgaatcaaaagcaaatattcatagttaatcaaagaataaagaataggtgtcttggagagaagttccccagcaacgacaccaaaaacttgatcgagctcggcaagtgcaccggacacacaagtagtataaaatggatggcttcctcttcaagctcaattctcttccagtcttcacacggcaaaagctctccaaactctctggaacttggacctttctctctctag

SEQ ID NO: 55177 - DNA, 354 bp, Glycine max
  Peptide Sequence Number=SeqID_146862
atggcgcctactaggcaccctctggacccagagaagtccaacagggccctggagtttttgactctgatcacgggcctctgccagtccgaaggagttcctgtcacccccagcaaggtaatccgactgccgatcacccgagccttcatcgagaagtactgcaagcctaggcaggcgcagggtgacacacatcaggacgcgggcgcaccactgccacctcggctagccgattcggctgggccattgggcgtggagcgccttagtcagcaggggcagggtttcgccccttttgtatgccctaccccagagcagtttagggctaaggttgcatggcctggagactggcccgatgcctag

SEQ ID NO: 55178 - DNA, 135 bp, Glycine max
  Peptide Sequence Number=SeqID_146863
gcccacgcctactccacttggcttgcctcctcctcctccttctccttcttctcctcctcttgcagtagcatcatagtcgctgtctacctagaagcggacacaaaaagccacacggctacgatccttggcgactag

SEQ ID NO: 55179 - DNA, 594 bp, Glycine max
  Peptide Sequence Number=SeqID_146864
atggaagtctcgagagccgaagcagatagaggatgtgtcgacttccaggcggttcatattggaggcattacgcgaggccgtgcaaagaaggaggaaggagaggtatacatgcagttgggtgacaaaaacccaagcaagcttaaacctttggtgatccatttcaccaaggacattaccactcatataccccgagttttccaaccccctatagcaaagactccagcacccttcctttacaagagtgacaaggcaataccatggaaatatggcgtacaagggcccaacagaaggcagaatgcgtctgtcatatgtgtcgagaatggcatgctggctgctaagatcacaaatatttttggtactagcggcatgactcgtagtggatgcattttcgctcctcccaaactaccggcaaggtcgaaagacaaggggaaggcaaaggcagatataggcgagagggagaagacgggtccgaccgagaatgacgaggcccctattggaaagcttgcaggggaaggggatgactttagcaagagagagatatcagctgaggaggcgattgaatttatgagaatcattcaacatagtgaattcaaa

SEQ ID NO: 55180 - DNA, 543 bp, Glycine max
  Peptide Sequence Number=SeqID_146865
atgaccatgattacgccaagctcgaaattaaccctcactaaagggaacaaaagctggtaccgggccccccctcgagagaaagatgcatcgcacgtaggaccatggaatggacacttcaatcctttctccttctctctaacgtttgggaaccctaaaaaaacaatcggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 55181 - DNA, 398 bp, Glycine max
  Peptide Sequence Number=SeqID_146866
atgtcaaatcataaaagcactgagtcagaactgaagaaccttgaggtccagatgggacaactggccaagcaaatagctgacaagtcatccaacagttttgtggcaaatacagaacagaatcccaaggaggaatgcaaagctgtgatgacaaggagtaagagctttgtggaagttgaggatgaagaaagtgtagtgcacaaggagaaagcagctaaaaagaaaggtactgaagttaagaaaaatgatttgagaggctcagtccctgctgcttgttcacttgatttgtccatgtctgcaagtggaagttgttgtgcattttctggtagtttcattcggcaatgccaccatggaagacgtgcagctattcgaactgcaagaacaaggagaaacccaggaag

SEQ ID NO: 55182 - DNA, 207 bp, Glycine max
  Peptide Sequence Number=SeqID_146867
atgttgtgcaaagccatgttagagaggccattactttatatcgaattccaactggcaacattaaagcagaataggtgcaacaaaatcatgaggttgatggaagaccccagccagctgggtgtggccaccattgctcacaactgggtagggccaaaggcccaacagaagatactaaacgttgggcagacagccccgtacaatctctag

SEQ ID NO: 55183 - DNA, 489 bp, Glycine max
  Peptide Sequence Number=SeqID_146868
atggctatccagtccccagaaagccaagaagaattggctacgtggacagcagcaaagcaaaagaagtacaagcaacatgatgccaaggctctgctattcatccaacaaggagttagtagagagatctttccaagaatcatgcaagcaaaaaatgcaaaggaggcgtgggagactctgaaaaatgaatttaaaggcatagacaagccactagagcaagcattccaatctaaaattaatatttctaaaaatgatggagataagaaaaataaccacggtaaatttcctcaaaaaagaggaggagcatttactatcgtggtaaaaggagcgaaaagcaatggagtaataatgcttcaagatcctcttgcaaattatgcaagaaaaataatcatggtacaaatgattgtcggtacaaatgcaaaaagtgcaaaaagcacctacactacgaaaaagattatttttaccaacaaaaagaagaagcaaattttctag

SEQ ID NO: 55184 - DNA, 333 bp, Glycine max
  Peptide Sequence Number=SeqID_146869
atggataggtttgctctcactctgaatgagagtcaagagcttccaaagctgttagccagagccaagacagtggttgacacatactctactcctgatgaagttcacagtcttttcaattactgcaaacacatgatgacaatgatgatggaagaaatgatgaggatgaggaagatgatggaggttaacactgctacagttgttgttgcgagtactgctactgagatggacccgattcacctgttcgatttcaatcaagtgagtcgtctagtctcgaatgtagtaggccaaggaggcgaggtagcagaaaatgcatgtgggcctcattatgttcag

SEQ ID NO: 55185 - DNA, 842 bp, Glycine max
  Peptide Sequence Number=SeqID_146870
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgttcaacaggccaactctaggcctagtgtccacggtggagaaaaaggagcggttggaataacgaaccgtgcactcatcgtaccaaatcacagcttgaatggacaggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55186 - DNA, 833 bp, Glycine max
  Peptide Sequence Number=SeqID_146871
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatactccccatcagcattgttaacaacagagtctcgctaggtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55187 - DNA, 348 bp, Glycine max
  Peptide Sequence Number=SeqID_146872
atggcccgcacgaagaaaattgggcaaatgacgtctgaggcaataaaggaaatcgttgagaagatcgattctttggaggagcaagcatcacagggatcgttcatcccccatggatgtcaggatgtcctaactgctaccattgggcgaccagaacaccctggccgtgtctatgctgctggagccggtgtcaccataaagaaatattttggatcggctccacgaacctcttgtagttcttcctccctcccttctgaagacctacaacagctgacccaacaaatcagggaccagctggaggagtcgatcacaaaaaaagtgactcgacaactcatggcatccttcagctag

SEQ ID NO: 55188 - DNA, 890 bp, Glycine max
  Peptide Sequence Number=SeqID_146873
atgggctgtgtgacctggcttgagcgctactttgccgaccgcaatctcggcaaagagaacttcgacgaggcagaaaatgccgcgcgcgaggtattacgtccggtgatggacgaactgcgctatcacggctggaaagtctgcgtaggtgcctcgggtaccgtgcaggccttgcaggaaatcatgatggcacagggcatggacgagcggattacgcttgccaagcttcagcagctaaaacagcgcgctattcagtgcggacgactggaagagctggaaattgaaggcctgacccttgaacgtgcgctggtcttccccagcgggctggccattctgatcgccattttcaccgagctcaacatcacctgtatgacgctggccggcggcgcactgcgcgaaggtctggtgtatgggatgttgcatctgtcggttgatcaggacattcgtagccgtaccctgcgcaacgtgcagcgccgttttctggtggatatcgaccaggctggtcgcgtggcgcaactggcgtcacgcttcgccgatcaggtcgctaacgcatgggatctcgatcatttgagccgcgatctcttgctgagtgcctgtgcgctccatgaagtggggctgagcattgattttaagcaggctcctgctcacgctgcgtatctggtgcgtaaccttgatttaccgggttatacccccgcccagaaaaaactgctggcaacgctgctgctgaaccagaccaatgccgttgatctctcttctttgcaccagcaaaacgccgtaccgccgcgcgtggccgagcatctgtgccgtctgctgcgtctggcgatcctgtttgccagccgccgccgcgatgatttgctgcctgcgatcaacctggtggccgttgacgaaaaatt

SEQ ID NO: 55189 - DNA, 740 bp, Glycine max
  Peptide Sequence Number=SeqID_146874
caactgggacaaagaggaagaaaggagatacccatgttgtcacttcaacgcctgcatggatcaagccgccgcagatctcccatggtacccatcagtatgcgcaacatcacccgagcttctcagcttgtgttggggactcctccaactcagcacccgtacaacctagggcgctcgcgcccatccagagggaggccccccaagctctggctccaaccccgactcgcccggccggcaatgcccactttggcgtcagttccaacgcgataaggaactttcccctgaggcctactccagaattcgcctcgatcccaatgacatacgaagacctcttgccatccctcgtcgccaaccagatggctgtgatatctcccggaaggctgacatttcaagaggaccggcccaacgtaaagacaaactcgcttgccaatcatggagggggagcggttaatgccgtcaagtcggagcagcatatatgcatgcaatccgcagataaggaaggtcttagaaagcctaaacctttggtgatacatttcaccaaagggaaggcgaagataacggaaggacaaaatgtcaaagtgatccccactccggacgaggatgttccaataaaatgtgtttctgagagaagggatggctgtgacaagaaaaaagtatcgctcgaggaggcaagcgagttcctccgcattattcaacaaagcgaattcaaagtcattgagcagctcaacaaaaccctggctaga

SEQ ID NO: 55190 - DNA, 222 bp, Glycine max
  Peptide Sequence Number=SeqID_146875
atgacgggagatgcatcgaaattcactcatatttctcccaagaaaaacggacatgtgacttatggcgacaacaataaaggtagaattcttggagttggaaaaatagaatcattagaagaaatgcatatttatggagaagatcacaaaggcaaaggagatggaaataatgaagattttcacattgatgaaattaaagcaaatgctgatcttccaagagaatag

SEQ ID NO: 55191 - DNA, 727 bp, Glycine max
  Peptide Sequence Number=SeqID_146876
ttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55192 - DNA, 1311 bp, Glycine max
  Peptide Sequence Number=SeqID_146877
atgggatgttacaatccgcatgtatataaagttgtttcgccatattatatgttcaagttcttgaagaacacaaggataagtggatggatgtttttgggtggaatattgttgtgcataacaggttctttacttcaagctcctttagatgatgatgctagcagaggctcggtgacaaaacatctctgcgacacacagagatgtccaatagatttgataactccacctaaagattttcatatttgtcgtgttgaggatcttcttgtaaatcgcattatgaagggaagcataattcacattcacagggcaaggaccgtgattgttgatactgatggtatgattgctgcatctgaattaggttgcactgaaggtattggtaagggaaactttttgaatggagctagtggtggtgctggacatggtggaaaaggagggtctgaatatttcaacgggagagagagtattggtggtagtgaatatggaaatgctattcttccatgtgaattgggcagtggaactgagggccttaatgagtcatatgagcatgttgttggaggcgagatgattgtgatgggatctattcagtggccacttttgagactagatctttatggatccttgagggctgatggtgaaagctttagcaaatcaataaaaagcagtgatggttctttggttaggggtcttggcggaggttatggtggaatagtcctttttttccttcaacaaattcggctcttggaaaatccttacttatctgttgtagggggcaatggtggccctattgatggtggtggtggaggtggaggtcgaattcatttccattggtcaaagattagtatggaggacgaatatgttcctgttgcaagtattactggcaccatgaataacaggatagttcttttcattgcagggggtgttacaagacggtcttgtccatataaatgtatatcagacaaagttggtccaatttccaaatttaactctggccttgtagtacctcgctatcctctattgattaatacatggggttattcaacaataattttgtttgctcctatgagtcattatgctagtgcaagtggaggaccagttaatgcttcccgagagttcaagcaaatggttaaggccttacattctgctggtatagaggttattttggatgttgtctacaatcatactaatgaggctgatgatgcctttccttacactacttcatttcgtgacatagataataaggaggctggtccctgtccaagttacctaaatccaatttttcttcaggcccttgctaagggtcaggcttgggcctaa

SEQ ID NO: 55193 - DNA, 528 bp, Glycine max
  Peptide Sequence Number=SeqID_146878
ccgattatgcaaaagcagaattttctgcaatattcgctaagtggccccccatgtcgctaagcggtagtgtttattttgtgaagatggcctccaggaagcgtaagagcataggggcaaggccaactgctcagtatgatactagacggttccatccccttgatgcttggaatcgttatacaaataacattttgggaaagagcattttgccagagagaaaggttgagatataccacacaaagttcgatgacttcaaggcagagttggaggggcgtaatcttcacaaatgcctcactaacttagctgatgggattattgatgttgctttgaagagggggagacattacccacctagtctaggtactgcagggccatccggggaggattctcaggaagaatttgactaccttggcagaggtgtggagtgttctctcttactccaacctggcccctacatctcatacgtcaaaccttactgtggacagagccaggttgatctttggcctagtctctcatatggacatgaacatc

SEQ ID NO: 55194 - DNA, 600 bp, Glycine max
  Peptide Sequence Number=SeqID_146879
atgagtcatcattcatctagtgctaatggcgagggtactagtcataaggaccctctatctagaatcttagatgagttgagttccctcaagttatggaaagaaaaactagaaagaaaagaaaaaggaaaagagagggtaaaaataaatcaagaagagagggaacaaataagtagtcataactcttgcaagagcctaagtgaagaacttcatgactattatgaaggaaggcatgggtcacatgttagacctcattcccataggagagagaaggaaagaaagcctcaagaggctaacattaacctctcatacttccatgggaaggacaatgtagaggctaacttagattgggaaataagaatagaacaacaacttaaaaggaagtctacttcaaaatcttatggctctgactcatatccaaagaaagaccaaggtcaaggcatcttaggggtgacaccttctaagcccaaagatgataaggggaagacaatagaaaagcaacccctcaaggctagtatgcaagagaagactaactccttgaagtgctttaaatgtcttggaaaggacacattacttctcaatgccccaccaagaaaaccatga

SEQ ID NO: 55195 - DNA, 270 bp, Glycine max
  Peptide Sequence Number=SeqID_146880
atgtacccatgtcagaaatggcatgagaatgcttcccaaatgaatatatgttgtggaattgcccctcaagtgtatctagatggcatgcaagaatggctccgagaaagctttccgcgaaaagatctaggagggacgccgcggctgaagggaccagtgccgcccccgagtttgatagccaccgtttcaggagcgccgagcaccagtagcgtttcgaggccatcaaaggatggtcgttccaccaagagagacgcgtccagttcaagacgttaa

SEQ ID NO: 55196 - DNA, 454 bp, Glycine max
  Peptide Sequence Number=SeqID_146881
atgggaaaagctcgagcaatagtggaagagctgaaaaggtttcttgtggctgattcgttgaaagagaggagcctacactcaaattttgatcatgtgcgtgatcaagttcttgctagagaccaagttccgtcaatggactctctcatcactaaacttcttcgtgtgcctcatgtattgaaggatgaaaatctcgctgatgttgtggaaacatcagtcatggttgcacctcgtgggagagggggacgctgtaacagttctttttcaaaaattcctcactttgtcactgtagctaatggttccaaagttgtgtctcaaggaagtgtaacctttaatgctaattcttttgtgattcaagaacatggcacgggtcaactgattggagaaggacgtctcccaagtctaccaaaactgaaaatgatggtttctagtcttaagaatcttcgactcttagaat

SEQ ID NO: 55197 - DNA, 387 bp, Glycine max
  Peptide Sequence Number=SeqID_146882
atgatcatcatcaaaacttcaaaagcaattgcatctacactattgtttgcaggaatcgcacccacaaagacacccagtggacccggagaagtccaacagggccctgggggatcgcgcccgcaagacaccctgtggacccgaagaagcccaacagggtcttggagttgccaagctctaattacgggcctctatcagttctatggagtgcctgtcgcccccagcaaggtcatcaggccccctactaatcgagctttcatcaagaagtactgcgtccccaggcaggcgcagggcgaaacaccacagcagcctggggatggccgacagcgggcaacagacgcaccaccatcacctctagagttcacctcagctcatccacaaaaaggttag

SEQ ID NO: 55198 - DNA, 569 bp, Glycine max
  Peptide Sequence Number=SeqID_146883
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggggttcttggaaccaatcccttttggataccaagggatgactgtatatacatttgtagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 55199 - DNA, 231 bp, Glycine max
  Peptide Sequence Number=SeqID_146884
atggagggtgctaataccttcctcaaacgtaaatacaactcccgaatctggaatattcttcatgaccggtttccttcggtttttccgacgttttccacaaataaacgttggtggcgactccgtgcattttcctcctttggaagacgcacctgtgagcctcgcctcgctcacccgcaaaagggtaggttgagacagttggcgactccactggggattatttttgtgagttag

SEQ ID NO: 55200 - DNA, 480 bp, Glycine max
  Peptide Sequence Number=SeqID_146885
atggatgccggatggctgactttccaagaggatcggcccaatgtgaggaccaacccgctcgccaatcatggagggggagcagttaatgcagttgaatccgataggccccacaggtctaaacctttaagagatgtggcaacccctaggaggtttatctttgaggccctacaaaagggaggtgtaattccccatagtgggtgtaaggaggattcctgtctgctacattccggcgagatgcatgacatggagacgtgtttggaagtagaggaattgttacagcggatgatagaccaaggtcgactagaagtcggcattgaaggaaaagaagagcagcatatatgcatgcaatctacggaggggagcggtgttgcgaagcccaaacccttggtgatatacttcactaaaagtgcagcctcgcaaaagcccgggcaccccttaatggccatacctggttgtttattacttgcaggaaaagagtaa

SEQ ID NO: 55201 - DNA, 332 bp, Glycine max
  Peptide Sequence Number=SeqID_146886
atgaatctgtattcatggagtttggagataaaaatcgaagcttttggagataaaaatgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 55202 - DNA, 486 bp, Glycine max
  Peptide Sequence Number=SeqID_146887
atggaaaaccatagatttataagcaagtctgatttagcaaaagccaggagcaatagaaaacgtattagacaacaaaaagtccatcttgatgttcagcatagtgtccatgcaagtctcaatccagcttcatcccacactgaagatgattataaccaaccaaagacaccacctcatagtgttcatgcaactgccgatcgagctccacacgatgctgaagatcattttaatatctgcgattcatctgagaatgagacttctggatcagcagaagaatctgagactatttcttcagttcgatatccaaactgtgaatcctcgcatcatgattcttcaatggacacaggagctcatacaaatgtagacattggaaatgctaaaatgtggtatcatgaaaacatatcaaaacgttcaaatgcctcagcccacgatttagcctatgttgtggagatggctagattgaacttccattgtatagaatccacctaa

SEQ ID NO: 55203 - DNA, 240 bp, Glycine max
  Peptide Sequence Number=SeqID_146888
tcccctggaaagggggcgccagagagggtgagagccccgtcgtgccccggaccctgtcgcaccacgaggcgctgtcggcgagtcgggttgtttgggaaatgcagccccaatcgggcgggaagcggatgggggccggcgatgtgtcccggtcggatgtggaacggtgagagccggtccgccgatcgactcgggacattgaccgacgcggattgcgatggtggcccaagcccgggctgttga

SEQ ID NO: 55204 - DNA, 411 bp, Glycine max
  Peptide Sequence Number=SeqID_146889
catacaattgccaaggaaatcactgccaagcaagtccagcattggccaaagaaagggaagctttctgcagggaagctaagtgtgaagtatgcgatcctgcataggattggcactgccaactgggtacccaccaatcatacttccactgttgccatagacattgtctcgacatcagggaaagctgctgcttcaggtgatgtgtccaaggatgacttgattgctgaactcaaggacacatgcaaggtgctggaggcaaccatcaaagccaacacagagaagaaaatggagctggaacgcctgatcaaaagactctcagacaatggcattgatgatggagaagcagctgaggaagaagaagatgcagcagaggatacagaatcagatgatgatgattctgatgccaccccatga

SEQ ID NO: 55205 - DNA, 870 bp, Glycine max
  Peptide Sequence Number=SeqID_146890
atggccccaaggaagcttgcctcaaagagatctaggaaggataaagcggctgaaggaaccagttccgctcctgaatatgatagccatcgtttttggagcgctgagcaccagcagcgcttcgaggccatcaagggatggtcatttctccgggtgcgacgcgtccagctcagggacgacgagtataccgacttccaggaggagatagttcaccggcagtgggcatcgctggttacccccatggccaagtttgacccagacatagtcctcgagttttatgccaatgcttggcctacagaggagggtgtgcgagatatgcgatcttgggtgaggggtcagtggatccttttcgatgcggatgccctcagccaattcttgggataccctttagtgctggaggagggccaggagtgcgagtatggccagaggaggaaccgggccgatgggtttgataaggaggccatcgcccaattgctgtgtataccggggcaggattttgcccggactgctgcggggagacgactgcggatcatgcgcaccaacatgactactctgacccagatatggatgacgttgctgcttagcaacatccagcccagcgatcataattctgacctcccctgccgaagtgtcagctggtgtatggcgcctaccaggcaccctctggacccggataagtccaacagggccctgggatttcccgctttgatcacaggactctgccagtcgttcggagtccccgtcgcacctagcaaggtgatttggctgcccatcacccgagcttttattgagaagtattgcacgcagagacaggccaagggggatgctccgcaggtcaccacctcatcaggctggcctagctggatcatttga

SEQ ID NO: 55206 - DNA, 459 bp, Glycine max
  Peptide Sequence Number=SeqID_146891
atgactaagggcaatccaggtgatttgcaaccctttgatcctgaaatagatagaacctttcataaattagttaggcatagtttgcatcctggtcattttgagcattttgagcatcctgatcattttgagcattttgttactggtgattctgaatattttgattttgagcattcggctattaattttcatactgagaacatggctcaacctccaccttatgagaggactcttagggagatggttgcacctgatttcacttatgaaagcttgtgcattcaatatcctgatgagggtaaagatcctcttaagcatcttaaggagttccatattttttgttccaccatgaagccccctgatgtccaggaagatcatatctttttaaaggcttttcctcattctctagagggagtggcaaaagattggttgtactaccttgctcccaggtccattttcagttag

SEQ ID NO: 55207 - DNA, 483 bp, Glycine max
  Peptide Sequence Number=SeqID_146892
atggcaagagctggtgacaatggtggtgtatatcatcaactggacgaatctcagcgcttatttctggacgcgtggactacacaaatgcaacgtttgttgaaccgtaacaaagaaaagccctacagacaaatagccaaatcttcctcatttactcttaaacctctatcccctagagaagtgtgtgatgaccaaatcagaatggaagaaaagagagaacaagagaaagaaaatagtgaggcactacaaatgaatatgaaaaagaagagtgatacacccgaggaaaagagtgatacacatgagagaaaatttaattattttgcagaggcgagtgaagtgaggaaagtgttacctgctcatgaactactcaatctacagtattgcaaagacagtaaaatttctactgataattctaatgagtttactatttctatttctcctagtgttcaaccattattgcaggaatttaaaaatgtcttttcttaa

SEQ ID NO: 55208 - DNA, 318 bp, Glycine max
  Peptide Sequence Number=SeqID_146893
atggcagaagaccacccacagaggatgacgctagaggactactctagctttgctacacctcagtacttgaccagcatagccagactagatgtgcaagcggccaacatttcatatccacattccctcatccagctaattcaagggaatatatttcatggagtaccagaagacgccattcacctcaacctattttctttctctttggcaagtgaagcgaaaagatggcttcactcattcaaggggaatagcctgtggacgtgggaagcgatggtggagaagttcctgaagaagtacttcccgaagtccaagaccgcttag

SEQ ID NO: 55209 - DNA, 276 bp, Glycine max
  Peptide Sequence Number=SeqID_146894
atgtgttgttatgagtggataaagagtgaggctttgagagttggaaggttaagtctgaattctgtgatcgtgatggcggtgcagctaatccgtgaacgagttgagatggagtgcctagagggagcttgggagaccctcgaaggcaacacgaggtgccgatttcggggcaccactcgattcacggctacttctttggtgcatccagatgaacctgcacggacgcttcagcgcacggtggagtggacagctccttggattagttttgtatacttttga

SEQ ID NO: 55210 - DNA, 567 bp, Glycine max
  Peptide Sequence Number=SeqID_146895
atggtgaaagttggaacctcttacgtgccgtcaactgtctcattgcttccaaaagttggcccaggtgctccagtggcgtatcatgttgtctatcagctgttccctcctgttcagctactgacggggaattggttatccgcgtcacaattcggcacacaagcactacagccggaagcatcagcgtgcaagtctaactcaccacacccgccgcgcttaattgcttgccgctacagggctgcgtcccattcgccattcaggctgcgcaatgtcgggaaaggcctgatcggtgcgcctttcgctattaatgaatcggccaacgctggcgaaagggggatgtgctgcaagtttgcgattaagttgggtaacgctacaggagtagaattggaaaaggctgccaccgcggtggcggtcagctcagaactagtgaacaggatatatccgcttcctcgggctgcactgaattcgccctacgctcatggtcgttcgacttgcggcgagcggaaatggcttacgaacggggcggagatttcctggaagatgccaggaagatacttaacagggaagtga

SEQ ID NO: 55211 - DNA, 426 bp, Glycine max
  Peptide Sequence Number=SeqID_146896
atggaagggtgttgcccttactcctacgtatcctcagatgtaatgagaaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 55212 - DNA, 357 bp, Glycine max
  Peptide Sequence Number=SeqID_146897
atgccatccttcagccagatgcagtcccaatttcagtctcagatgcaatcacagggacttacactgcctccggaggcagaggttggtccctcaggtgctcgtgccagcacaaaggagagttgtgttgatccctcagggaatgatccagagacgggtcactcagacaaatgcgggttattttatgagggatccacaacggtttacaacatccctttgttgcatggccaagtgaaggttggtgttgagaaggttaaagatgtagaggctctcattcctgtacccactgacgaggaagctgtgtctccagcaaacctccagaaagcccgaatgaagaggtcgatgatcccctgtacctga

SEQ ID NO: 55213 - DNA, 273 bp, Glycine max
  Peptide Sequence Number=SeqID_146898
atggcccgcacaaaaaaaactggccagatgacgtctgaggcagcaaaggaaattgctgagaagattgcgtcacagggttcgtttgtcccccatggacgtcaagatgtcttgattgctgccattggtcgaccagaacaccctggtcgtgtgcatgcttctggagccagtgtgaccatcaaacaatactttggaccggctcaacggacctcccgcacttcttcctccgtcgctcctgaagaactagagcaactgactcaacaaatcagggactag

SEQ ID NO: 55214 - DNA, 462 bp, Glycine max
  Peptide Sequence Number=SeqID_146899
atgactagaggcaatccatctgacttacaaccctttgatcctgagatagataggacatttcatagattagttaggcatcattttataccttttgatcattctgagctttccattactggtgaatctgtgcattatgttattggtgattttgaacatcctgatcttgagcattataattttgagcattctgattctgagcattctgattttgcacattctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggtgaagacccgcacaaacatttgaaagaatttcacattgtctgctccacgatgaaacccccagatgtccaagaggatcac

SEQ ID NO: 55215 - DNA, 189 bp, Glycine max
  Peptide Sequence Number=SeqID_146900
atgactgctaagcgcgcatccaccactaagagcagcttcagtgcgcttagcacaacagaagaatctggcatggcatcagcatcaaggccgtgcgctaagcgcgagatcagtgtgctaagcgcaggaggtgtcttcagtcaggctcagcgcacgactgacactaagcccgaatccacttacccgcactaa

SEQ ID NO: 55216 - DNA, 1032 bp, Glycine max
  Peptide Sequence Number=SeqID_146901
atgcaggaaagcctgacgcgcacggtttcttcggtgcgccgcggcgttgacgaaatcaataccggttcgcacgagatcgcggccggcaacaccgacctgtccagccgcaccgagcagcaagcggcctcgctggaggaaaccgcggcctcgatggaagagctggcctcgacggtcaagcagaacgccgacaacgcgcgccaggcgaaccagctggcggccagcgcgtcggatgttgccgagcgcggcggttcggcggtggccgaggtggtcaacacgatgcagggcatctcggccagctcgcgcaagatctcggaaatcgtgtcggtgatcgacggcatcgcgttccagaccaacatcctggcgctgaacgcggcggtggaagcggcccgcgccggcgagcagggcaagggcttcgcggtggtggcgggcgaagtgcgctcgctggcgcagcgcagcgcgcaggcggccaaggagatcaagggcctgatcgaggactcggtgagcaaggtgggcgccggttcgcagcaggtcgaacgcgcgggcgcgacgatgcaggagatcgtggcgtcggtcaagcgtgtgacggacatcatgggcgagatctcggcggcgtccgaggagcaatcgagcggcatcgaccaggtgaaccgcgcggtgtcgcagatggacgaagtgacgcagcagaacgcggcgctggtggaagaggcggcggccgcggccggttcgctgcaggagcaggcgcagcgcctggccgaagccgtggcggttgccggcgcgccagctggcgcagcaccgcagtgcgccgcgggttgccgcgccacaagcggaaacggttgcgccgaccccggcgccggccacgaccgctgccgcgcccgcggcgcgcctgacgcacagcgcgccgcgcgccaaaacggcgacggcggaggcggccagcgcggcgcgtccgccgcggcgcccggccccccgcgcggcggccaacgatgccaagccgacaccggcggccacccgccgccaggcgccggccgacgatga

SEQ ID NO: 55217 - DNA, 210 bp, Glycine max
  Peptide Sequence Number=SeqID_146902
atgataggaacatatgtaattttggcacaataccttgagcatgcgtatgctatcggccagctcctgagatatcctttagtgctggaagagggccaggagtgcgagtatggccagaggaggaaccggtccgatgggttcgatgaggaggccatcgcccagttgctatgtataccggggcaagattttgcccggactactgccgggagacgg

SEQ ID NO: 55218 - DNA, 324 bp, Glycine max
  Peptide Sequence Number=SeqID_146903
atgaacgacaactcaattcatggggctccgaaaagtgagaatggagaattgcactacagaaatcactacgcatggctccagactcatgggtggaggatgcatgaacgaaaacgcaattcatggggctccgaaaaaggggcgaggatggaggattgcactaaaggatcctcactaatcgatcctgaatcatggctcgaaaatctttggtggaggatgcatgaacgaaaatgccattcatggggctccgaaagagggttgagaatggagaattgcactaagcaatcactacgcatggctccaaactcgtgggtggaggatgcatga

SEQ ID NO: 55219 - DNA, 463 bp, Glycine max
  Peptide Sequence Number=SeqID_146904
actcttacgggaggcagcagtggggaattttccgcaatgggcgaaagcctgacggagcaatgccgcgtgaaggtagaaggcctacggttcgccgtcaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacac

SEQ ID NO: 55220 - DNA, 977 bp, Glycine max
  Peptide Sequence Number=SeqID_146905
aattgcaactgtggtcaaggattcagccagaggtttggaccgcataaaacagactcggaacggcatagcgggcctgccacagaagtacctagaagacaaggcgaggggtatggccaatcaaggagactgggtcccgtttatggatgtgttagctttgctaatttttggggtcgtcctctttccaaacgtggatggtttgatagacctagcagcaatcgacgctttccttgcctaccaccatagcaaggaaagtccggtggtagctgtcttggcagatctatttgacacatttgaccgaaggggttgtattaactacaatcccgcgctcgctataagacaactagggtaccccatgaggggagcaccgacggaagaaagcatgtctcttttccttgtgagggatttcggcgcacgaaattccaagactatacaaagaatccataaggcgtgggaaaccccgttaaagaaagaggaagagcttagaggcattcgtaatggcatcattggtgggtaccacgaatggctgaaagttcatgtacgaggtttagattggctcgccaagttaaaagtcgtcagcaaagagagctttgaagcactggaagaggacgaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatggtcggaacaaatttcgcggagctctatggggtagcaatagtgaactcaaggaagacagggaccagtcgcgagcacatagcatggttttgaaagaggagttagttgcctgttcaaggtccaaaagaagcttgtctcagcgtttatgcgagacggagaccaatatgctagctatcatcgccaagtaccaagaagagttag

SEQ ID NO: 55221 - DNA, 105 bp, Glycine max
  Peptide Sequence Number=SeqID_146906
atggagaattggcaaacagcgctaggcaatgacattcgcggggctccagactcgaagggctccagactcgaaggtggaggacacatgaacaacgccaggcaatga

SEQ ID NO: 55222 - DNA, 714 bp, Glycine max
  Peptide Sequence Number=SeqID_146907
atgcagtctcagatgcaatctcagggacttgcactgcctctagagcctctggttggtccctccggtcctcgagtgagcacaaaggggagttatgttgatccctcaagaaacgatcctgagacgggtgactcagataggtgcagcttgtacatcgaagcagatcctgctcgcctggttgccttggggagagtttatgagggatccactgttgttcataacacttctttgttgtctggccaagtaaaggtgagtgtggaggaggttacagatgcagatgctctagttcctgcaaccactgatgaggtagctatgtctccggcaaaaccacctctaaagcctgattcgcaggtcgatgatccgctttatcttatgacattgaccatcccagagcttttcttgaggccttatcaggttacatgggatgccaccatgttcggggtcttcaatccagatttcccactctacataaagcacaaagacctctctgaaatcgcacacggtggtcaatgtctcagcatatcagtgttacagttgtggattctacatctcactgaaacaagtatgcgagcggagaattctgatatctatggattcctcgagccacagtccattcagaggtctgggcaatcacagtttgagtttgaaagttacataaagacttggatgcagagttcaaaacgcgatgtctatcttggagcctacctaaatgggtaa

SEQ ID NO: 55223 - DNA, 856 bp, Glycine max
  Peptide Sequence Number=SeqID_146908
aggactacacgtcctcgccttcagaggacttcacgtcctcactattagagggctacacgccctcacctccagaggactacatgtcctcgccttgagagggctacacgccttcaccttgggtactagttaccctcaccttcagagaactacacgtcctcaccatcagagggctgcacgccctcacctccagaggactacacgtcctcgccttgagagggctacccgccctcgccttggagggctacacgccctcgccatcagaggactgcatgtcctcaccttcgtagggctacacgccctcacctttagaggactagacgtcctcgccaacagagggctgcacgccctcaccttgagaggactacacgtcctcgccaacagagggctgtacgccctcaccttgagaggactacacaccctcacctctagaggactacacaccctcaccatcagaggactgcatgtcctcaccttcagagggctacacgccctcaccatcagaggactgcatgtcctcaccttcgtagggctactcgcccttacctttagaggactacacgtccttgccaacagagggttgtacgccctcaccttgagaggactacacgccctcacctccagaggactacacatcctcgcctctagagggctgcacgccctcacctttagagggctacggatcgcacccacaagacacccagtggacccggaaaagtccaacagggccctggggtttccagctctagttacgggcctctatcagtcctacagggtgcccgtacccccccggcaaggtcacgtcatcatagggatcgcgcctgcaagacacccagtggacccgaagaagtccaacagg

SEQ ID NO: 55224 - DNA, 498 bp, Glycine max
  Peptide Sequence Number=SeqID_146909
atggccaactatgtgatgtcgctgagcaccaaggcgacgctgaatgtggaaccgcaggcgcagttggcggcccgcgccttgccggcggcggggcaactggccggcgagcggttatttcagggcgcttgccaggcctgccacagcgccgccgccggcgggccgcagctgttcggcgtcagtcccgatctggccaataacaccaatatcttcagcgatcgccccgataacctgatcaaggtgatcctgcaagggatccccaaaccggctaccgccgaattgggctttatgccgggctttaaggacagcttttccgatcggcaggtgacggcgctggtgaattatctgcgccaacgctatgccggcgacaaaccggcctggcgcgacgtggaggcgcaggccaaggttccggcgattattgtgtgtcacggcttctgcggcattcaggagctgttgctgccggcctttgccgaggccttcgtcaacgtcggttttgcggcg

SEQ ID NO: 55225 - DNA, 132 bp, Glycine max
  Peptide Sequence Number=SeqID_146910
atgattgatgatgattatcttgtgtctaactcatacgttgaagagtctttagacgaagatgatagtgttgacggtatatctgatacagatgatgaagtcaccgatatcctcaaccagtgcacaacgaattga

SEQ ID NO: 55226 - DNA, 303 bp, Glycine max
  Peptide Sequence Number=SeqID_146911
atgtcgtaccggatgtcacgacatcacgcttcagaacatgcagattatatgtgtccgtatgaacagattaaacaacccctgtttacaaccttctcacctaaccactacccgtgcgatctctacctaagagccactcttagatatgagaacctccgctcactccctctcactcacactcccgtgtttacaattaagtcaaagacacaccagagatcaactctgaacaaaagagatcaactctacacactagagatcaactctagacacaagggatcaaccctacacactaggtccaacacttga

SEQ ID NO: 55227 - DNA, 372 bp, Glycine max
  Peptide Sequence Number=SeqID_146912
atgaaaagaagcatcgcgggaaggaagaacagtggtcagagctcgcgttggagacaagaaagtgaaggaagcccgccctgccacataagtagaagctttataagtgcgggtctgggagacgaaggtcaagtgtttgcgatatgtgaagatgatgttccaagtacttcggatttggtccgaccatgccctcctgatttccagctgggaaattggcgagtggaggaacgccccggcatttacgcaacaagcataatattcgatgacgtctcccccgaaggtactaatacctgggacccgtctatcaacttcgagcaagaaatgaacaaacggaagatgaaggagatgaggatgtgggacttccttcggaactag

SEQ ID NO: 55228 - DNA, 645 bp, Glycine max
  Peptide Sequence Number=SeqID_146913
aggttgcatgccctcaccttcagagggctacacaccctcacctttagaggactacacatcctcaccatcagagggctgcacgccctcgccataagaggactacacgtccttgccatcagagggctgcacacccttgccttcagagggctatacgccctcgccttcaaagaactacatgtctttgccatcagagggctgcacgccctcaccttgagagggctacacgccctcacctttagaggactacacgtcctcgccatcagagggttgcacgccctcgccatcggaggactacacgtcctcaccatcagaggtctacatgtcctcgccatcggacggctgcatgccctcgccttcagaggactacacgtccttgcctttagaggactacacatcctcacctcaaaagggctacacgtcctcgccatgagagggctgcacccctcaccttcagaggactacagttccttacctttagagggttgcatgccctcgcctttagaggactatgcatcgacaccttcaaagggcttcacgccctcgtctttagaggactacttgtcctcaccttcagagggctgcacgccctcaccttcagagagctgcacgccttcgcctttagagggctccacatctgtgccttaa

SEQ ID NO: 55229 - DNA, 914 bp, Glycine max
  Peptide Sequence Number=SeqID_146914
gtaaaggcgaatgggccccgttcatagacattctcgcactgttgatcttcagaggagtcctctttcggaatgtggatgggttggtggacttagcagcgatcgacgcttttctcgcctatcataaccacaagggaagcccagttgttgctatgttagccgacctatatgacaccttcgaccgaagatgtgagaagagcagtacgaggattgtttgttgtactccagctctttatgtatggttggtttcacacctttttcgccaagaggtgaggcatgcttgcccgctagaaagtcaccgttcatgcatagagaaagaaggcacaaattgggaccaactcttagcaaacaaagaaggagcgtctatcaactggttccctcgatggaaagaaggaagaataggagttcttatttcgtgcggaggatttccgaatgttcccttgatggggacgaggggttgcatcagttacaaccccgttcttgctataagacaacttggataccctatgagaggggcaccactagaggaagagatcgcgtctgtcatttcacgaggtttcaataagaccaacatggagacatttcagaaggacaaagaacttaggggcagtaacaatgagcccatcggtggctaccgtaagtggttgaaagcccacgtgcaaggtttggattggatcccgagtttgagaaccgctaaaagggaggaagtggaggcaccggaggaagacgaagaggtgcaggcccttagggcagaactcgagcaagcccaaatagtcaaagaaaggttcaaatcagcagctctgaagatccgaaaggagaatgccgaactgagagatataaatgtagctaccaccaaagccttggaacaggaaaccaggagggctcgtagggaagagcacggctggaacaagttctga

SEQ ID NO: 55230 - DNA, 342 bp, Glycine max
  Peptide Sequence Number=SeqID_146915
atgtttatacggataaccactcagacagcaaaaaagaatgtttatacggataaccactcgggtatttccgctcgtcagcgtgactcaaatgtcagtatgacagatcttgtgagcgcggaagatgacacagcaaaaaagaatgtttatacggataaccactcgggtatttccgcccgtcagcgtgactcaaatgtcagtatgacagatcttgtgagcgcggaagatgacgttagtctctacgtgctatcaggcgtttcgtcttacagacagcaaaaaagttttgaaagtgcagacaaccacttgggtatctccgcatgtcacgtgactccagggccagcatga

SEQ ID NO: 55231 - DNA, 441 bp, Glycine max
  Peptide Sequence Number=SeqID_146916
atgcccggttggtcgggattggtcaagcttggttttggcaatagcaccccacctgacgtccccaaggattatggggtacccatcacatgtggtactaggtggcggtcgggcgatggtgcacaacaagctccctcaactccatctcagctctcacggatagctgcccagcaaaacaacattcaaacagcacaagtatcacagcaacaaaacagagcaaagggaggcctccacaatgttccagccccctttctaagcctggtaatcgattacacccctttggtaatcgattaccagaagcccttatggcttcctgacctcgttttcaagcctggtaatcgattacaccccatggagctcgcctgcttaggtacatcacaggttttcactgaccgactatgcccgggttgggtcgggattggtcaagcttggtttgggcaatag

SEQ ID NO: 55232 - DNA, 366 bp, Glycine max
  Peptide Sequence Number=SeqID_146917
atgccgatctccacgtgcggaaggatcgcacccctagtggacccggagaagtccaacagggtcctggggtttctagctctgattacgggcctttgtcagttctacggagtgcccgtcgcccccaacaaggtcatcaggccccctattaaccggactttcatcaagaagtattgcaccccccaggcaggcgcagggcaagacaccacaacagcctgtggatggccgacagtaggcaatagacgcaccgctgccacctccagagcccataagctcatctacaaaggctggagagttgcctatgacccgtggccgaccagcaggcgaccaagtccaaagccaaaggtgagcaaagtattaggtccgtga

SEQ ID NO: 55233 - DNA, 679 bp, Glycine max
  Peptide Sequence Number=SeqID_146918
gctttcagggacctggcccaggtagggggattcgcctgtggagcagctgcattagtccacatgtacgaccatctgaatgacgcgtcgctggcctctacacggcagttgggcggttatattacacttctccattgctggatatacgagcactttcctacagtgcatacatccgtcgttcatgatgcttatgatgaagggagcccacatgcttgcaggtggcttacaggtaaggctcatatgatgaggatcaagggagcctcgtatcggagacgtttggatgcactgagtgtgactgacattgtggtgtacgttcgacctgagcgggttcttcgacagtttggctaccttcagacggtccctccgccgtcggtggcgccagactacatggagtggttttttcggatatcgcacccattcgtcacgcggaccgaggagacagctgtgcggagacatccgcctccccctcatcatgaggagttcgtcgagccacccatctccgaggtttcagttgcgaccgatctccctacacattcagtggttcactgcgaaggatgtcaggggatggctcaggatttaggagcgattgctgaggatttggagcgggtcatcaacctcaggatggtcactgagggcactgacttacatgacatcatgactcgttgtctaaggagagctagag

SEQ ID NO: 55234 - DNA, 168 bp, Glycine max
  Peptide Sequence Number=SeqID_146919
atgactttacaacttgcagaccgctccattaccagaccatatggagtaattgaagatgtgctggtcagagtaaaacattttatcttcccgacagactttgtggccattcatgctaactgcaagctgcatagtggatatggggagaaagaagctggagctgggctttaa

SEQ ID NO: 55235 - DNA, 580 bp, Glycine max
  Peptide Sequence Number=SeqID_146920
ggaggctaactgcttgcgggctgggagctgtatgaacggtaacgtccacgtacggctccgtgagaagggcggtggacagaaatggccttgttgtacctcactctcgtcttcaatggggtctgctcttttttttttgggagagtatgccaatatgatcttaatgaggtgcggggctttgcatctgacattcgttgggcttccctcttcgggagcctgcgtcccggcgtttttgtgcaataaacccctccggccgaagactagtggtaggtggtcccgcggagctttcggagaaggtagtggtgaccctttcactcttccacggactgatacatgtaccgaatgctcatacggggaaaggttgactcctgggtctgggaacgaagtctccgaaaaatcctttctttctcgtccactcagggggggtgcggacacacctgcgcggattacaggtgacggtttacaagaatggcggggaagtgaacagtacccgacgacatttcaggggatggatgtagacccatcgggcagggataatcattccggtcctgggaagaggtgggcgaccattctcaagaactga

SEQ ID NO: 55236 - DNA, 138 bp, Glycine max
  Peptide Sequence Number=SeqID_146921
atggcttctatggatacctctgctatggtcaactctaagatctttccagaggatccagacagaacccctatgcgatgcatatgcaaaaggcgcaacaacatgacaatattcactgaacataagcaaaatggtatatga

SEQ ID NO: 55237 - DNA, 761 bp, Glycine max
  Peptide Sequence Number=SeqID_146922
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttaccttgttccagcgtggaaagcagcgtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55238 - DNA, 384 bp, Glycine max
  Peptide Sequence Number=SeqID_146923
atggttacgggcctctgtcagccctacagggtgcccgtccccccagcaagctcatgccatcatgacatagggatcgtgctcgcaagacaacctagtggaccccaaagaaggcctaatagggtcttggagttgtcaagctctaaatacgggtctctatcagttcaagggagtgcctgttgcccccagcagggtcatcaggccccctaccaatcgagttttcatctagaagtgttgcgcccccaggcaggcgcagggcgagacaccacagcagcattgggatggacggtagcgggcaatagacacaccgccatcaccactaaagttcacctcagctcatccataaaaaggttagagcgttgcctacgacacatggccgaccaatag

SEQ ID NO: 55239 - DNA, 498 bp, Glycine max
  Peptide Sequence Number=SeqID_146924
atgaagaacacattggagattggaggattcaattgggaaaataccaaatatcacatttcccagtcaagagggtccgctcttgacggtgaagaacacattggagaatggaggaatccaatcggtaaaataacaaatatcacatttcccagtcaagagggtccgctcttgacggtgaagaacacattggagaatagaggattcaatcgggaaaataacaaggatcacatttcccagtcaagagggtccgctcttgacggtgaagaacacggtccgctcttgacgatgaagaacacattggagattggaggattcaattgggaaaataacaaagatcacatttcccagtcaagagggtccgctcttgacggtgaagaacacattggagaatggaggaatccaatcgggaaaataacaaatatcacatttcccagtcaagagggtccgctcttgacggtgaagaacacattggagaatggacgaatccaatcgggaaattaa

SEQ ID NO: 55240 - DNA, 312 bp, Glycine max
  Peptide Sequence Number=SeqID_146925
atgtctcctccacctctagaacctcacaatcactcacagactcatctcatactctcaggatggctttctcttctcgctcagttctctgccagtggccttgttggtgcttacgtgcttagtgcaactctggcttgcttagcgcgcattagtgaattttggcttatcgctcatctttttgctcagcggatggactcaagcagtgcacttagcgggattagcccttgctcaacgaacatgcacaactcatccttcttccagattcttcctcgtgctcagccaaaggagtgttgcgctcagcggatgactctctaa

SEQ ID NO: 55241 - DNA, 479 bp, Glycine max
  Peptide Sequence Number=SeqID_146926
ggcggccggggctcgatgataccgcggaagatacccttacggtttatcccgcaccccttttgtcatcccagaggcggcggggccccgatgaccaagcagagacccaaaatttggtccattctacaccccttgtatcatcccagaggccggcgggcccgatgatacgcggagataccttacggtttatccacaccctttgtcatccagaggcggcgggcccgatgatacgcggagataccttacggttatccgcacccttttgtcatccagaggtggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaatttggtcattctgcacccttgtatcatccagaggcggcgggcccgatga

SEQ ID NO: 55242 - DNA, 510 bp, Glycine max
  Peptide Sequence Number=SeqID_146927
atgggaacaaatcaaaccggcaagaggttctaccaagtcaaggtcaaaagccctagataccaccagcatcaaggaattagggcggttgatggaacccctccaaatgcaatccttccgcaagacttacagaaagatcttagaattgaccatagcagagtaccaaccattgaagaatttgaggaaattctaggatgtcctctcgggggaagaaaaccatatctttcctccggatgtctcccctctttgagcagaattgcaactgtggtcaaggattcagcaagaggtttggaccgcataaaacagactcggaacggcatagcgggcctaccacagaagtacctagaagacaaggcgaggggtatggccaatcaaggagactgggtcccgtttatggatgtgttagctttgctaatttttggggtcgtcctctttccaaacgtgggtggtttggtagacttagcagcaatcgacgctttccttgcctaccaccatagcaaggagagtccggtg

SEQ ID NO: 55243 - DNA, 884 bp, Glycine max
  Peptide Sequence Number=SeqID_146928
caaagaggaatcaacagaggaagaggatcaagccacaaaggagacccctgcaccaagggcaccagaacctgctccaggtgacctcattgacctggaagaagtaggatctgatgaggaacccattgccaacaggttggcacctggcattgcagaaaggttacaaagcagaaagggaaaaactcccattaagaggtctggacgaatcaagactatggcccagaagaaaagcactccaatcactcctaccacatccagacgaagcaaagtcgcaattccttccaagaagaggaaagaaatttcctcatctgattctgatgatgatgtcgaactagatgttcccgacatcaagaggaccaagacatcagggaagaaggtgcctggtaatgtccctgatgcaccattggacaacatctcattccactccattggcaatgctgaaagacttgccttggaaagagaactggggaagaaatgccttggattgcaaggagatcatggacctcatcaagctgctggactgctgaaaactgtcaccaagttgggagattgctatgaaagtctagtcagggagttcattgtcaacattccctctgacataacaaacagaaagagtgatgagtaccagaaagtgtttgtcagaggaaaatgtgttagattctcccctgctgtaatcaacaaatacctgggcagaccaactgaaggagtggtggatattgatgtttctgagcatcaaattgccaaggaaatcactgccaaacgagtccagcattggccaaagaaagggaagctttctgcagggaagctaagtgtgaagtatgcaattctgcacaggattggcgctgcaaactgggtacccaccaatcatacttccactgttgccacag

SEQ ID NO: 55244 - DNA, 255 bp, Glycine max
  Peptide Sequence Number=SeqID_146929
atggtgaaaagttggaacctcttacgtgccgatcaacgtctcattttcgccaaaagttgggcccagggcttcccggtatcaacagggacacccaggatttatttttttctgcgaagtgatccttccgtcaccagctgtccctcctgttcagctactgacggggtggggcgtaacggcaaaagcacccgccggacatcagcgctggcaagtgtagcggtcccgctgcgcgtaaccaccacaccccgccgcgcttaa

SEQ ID NO: 55245 - DNA, 234 bp, Glycine max
  Peptide Sequence Number=SeqID_146930
atgtcttcttggccacgaacttcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 55246 - DNA, 303 bp, Glycine max
  Peptide Sequence Number=SeqID_146931
atggcttccatgatggaggccatgttaagaatgaggcaactcatagagaaaaacatggccaccgctgccactgttagttcagctgccgaagcagacccaactctcctagctactgcgcaccatcctcccccaaatgtgataggacgagaaaggagcacactggggcacaacagcaacccccatttgggatacaaccgggtggcttacccttatggattaccgcctaattacacgccgccagtcatgcatgatgatgcgggtcatgtctcttcccccatccttgaaagggagcctcctcgatag

SEQ ID NO: 55247 - DNA, 937 bp, Glycine max
  Peptide Sequence Number=SeqID_146932
atgattcctggtccaggccctgttcctgagaaactggcccctaaaagacaacagggagtgaagatttctgaaaaccctagctttgcaacaagccctagggaagtagacactgagatggataagaagatccgcttttttggggatggcattttgaaaaatgcttctgtgcctgatgctgataaagatgttccaacatcttccaccccaaatgctgaagtcctcccttcacccaaagaagtagaatctgatgaggaacccattaccaaaaagttggcacctggctttgtagaaagattacaaagcagaaagggaaaaacccccattacgaggtctggacgtatcaaaactattgcacagaagaagagcacaccaatcactcctaccacatccagatggagcaaagttgcaatcccgtccaagaagaggaaagaaatttcctcatctgattctgatgatgatgtcgaactagatgttctcgacatcaagcgggccaagaaaatcagggaaaaagaactgggaagagatgccttggcttgcaaggagatcatggacctcatcaaggctgctggactactgaagacagtcaccaagttgggagactgttatgaaagcctagtcagggaattcattgtcaacattccctctgacataacaaacagaaaaagtgatgattatcagaaagtgtttgtcagaggaaagtgtgttagattctcccctgctgtgatcaacaaatacctgggcagaccaactgaaggagtggtggatcttgctatttctgagcatcaaattgccaaggaaatcactgccaaacaagtccagcattggccaaagaaagggaagctttctgcagggaagctgagtgtgaagtatgcaattctgcatatgattggcgctgcaaactgggtacccaccaatcatacttccactgttgccacag

SEQ ID NO: 55248 - DNA, 93 bp, Glycine max
  Peptide Sequence Number=SeqID_146933
atggaagattcttcaagggatgacaccaatcctcctttcccaattccctatatggcaactccacaaacaaggaaacaaagagacaagcaataa

SEQ ID NO: 55249 - DNA, 411 bp, Glycine max
  Peptide Sequence Number=SeqID_146934
atgaggattgtggcttcatgtctgcattggatacaggagcaccgagttccaacagcggcccaggtggtggaaggctcctccatgatggacaagaggtcaagtgtcactcaagatgacctgggtcgcaacatcagtcgtgatggtggtggtgacaacattgaggtgactttcttgtcgtctacaagagcaaaaggttgtgatggtaatggactgttagtctttcacactacaagatccaaaggttgtgatgttgatcatgatttcaagaagtatcttatattcatcatctgtatgataccagacaaagggtttgtgggggcatccaaaacttggcaacaaaatagtggatgtgtgtgggtttctcagcttttacttgacattagttatatattaagtaggattaggggataa

SEQ ID NO: 55250 - DNA, 582 bp, Glycine max
  Peptide Sequence Number=SeqID_146935
atggcttccatgatggaggccatgttaggaatgagaaaactcatggaggaaaacgtggccaccgttgccgctattagttcggctgccgaagcaaacccaactctcctagctactgcgcaccatcctcccccaaacgcgataggacgagaaaggagcacactggggcacaacagcaacccccatttgggatacaaccgggtggcttacccttatggattaccgcctaattacacaccaccagtcatgcattatgatgtgggtcatgtctcttccctcatccttgaaggggagcctcctcgacagcccgacgagcccaacctcacagcacagccaatattcttgtacacagaaggaccaccctcggcgaccgaagaaagaaggaaactcgatctcctcgaggagagattgagagttgttgaaggctttggtgactatccgttcgcggacatgacggatcttttcttggtaccggatgttgtcatccccccaaattcaaagtgcctgatttcgacaagtataaagggacgacttgtcctaagaaccatctcagatgtattgtcgcaagatgggggcgcactctag

SEQ ID NO: 55251 - DNA, 675 bp, Glycine max
  Peptide Sequence Number=SeqID_146936
ggtggaccattgggtactagtaccctcaccttcagagggctacatgccctcgccttcagaggactacacgtcctcgccttgagaactacacgtccacaccttcagagggctacacgccctcgccttcagaggactgcacgtcctagccttcataggactgcacgtccttgccttcagaggactataagtcctcgccttcagaaggctacatgccctcgctttcagacgactacacgtcctcagcttcagaggactaaacatcctcaccttcagaggactacacgactgcatgtcctcgccttcaaaggactacatgtcctcacctttaaaggactacacgtactcaccttcaaagggctacacgccctcaccttcagcagactacacgtcctcccctacagaggactacacgtcctcaccttcaaagggctacacgccctcgccttcataggggtaaatgccctcaccttcagaggactacacgtcctcgccttcagagggctacacgccttcactttcagaggactacacgtcctcaccttcaaaggactacatgtcctcgccttcagaggactacatgtcctcacctttaaaggactacacgtactcaccttcaaagggctacacgccctcaccttcagcggactacacgtcctcgctttcagaggactacac

SEQ ID NO: 55252 - DNA, 237 bp, Glycine max
  Peptide Sequence Number=SeqID_146937
atgcccacccaaaccctaacaccttcttctccaccacccacgaccatcggtggccaccacgaaccgccgttggttgccactgaaccaccacaccaagaagaacattttaatcggagcaaaatcctcagaatccacctcaaggattcggtggacagcaatccctcaaatcctttctttcatagcttctttgagaacgttgaatttggactaacaaacgtgaacgagataggtctttga

SEQ ID NO: 55253 - DNA, 438 bp, Glycine max
  Peptide Sequence Number=SeqID_146938
atgattgccttctttgaatccactcacattgacatgtgggacgttgtagaaaaaggcaatcacattcctttagatgctcggagaaatgagacccctagggacagatggatagatgaacataagtccaaatttcttctcaactctcatgcgagaaatgctttgttgtgcactctatctcaagaagagtattccaatgttcaaaacttcagaagtgtgaaacagatgtgggacaccttagccattatctatgaagggtcctttgaggtaaaacgtaacaagctgagccttctgatactccatgggcaagagcttgctcaagatgaaggaacaaagaaagggaaatcgctagcccttatggttaaaagaccaaaacacaactctgcgtccaaagagtcattgtccaaagcccttgccattaatgatgattcagaagtttga

SEQ ID NO: 55254 - DNA, 306 bp, Glycine max
  Peptide Sequence Number=SeqID_146939
atgacaatgatagtagacacattaccagtattctactatggaaaatggtgggctacgcaccttcaaagctttgcggatttggtctttgccagtgaaaggatcggtgtgggtctgaaaaaaggcaaatttagtcatcctgcttggacgaatgagaaaactggggcaaatgaagagggtgaggatgaaggaaaaacccatgctgtgactgccattcctatacagccaagtttcccaccaacccaaaaatgtcattactcaacccttctccttacctaccgcccatttatccacaaaggccatccctaa

SEQ ID NO: 55255 - DNA, 541 bp, Glycine max
  Peptide Sequence Number=SeqID_146940
gggtctcctctgcggcttgatcatcttcttccattgattcctcttcactgggtgaagggacggcttcagcatttggagcggaagatgttggaacatctttctcaacatcaggcacagacactattcggggtggaagatgttggaacatctttctcagcatcaggcacagaggcggctagggttttcagcaatcttcactccctgtggttgttcctggtcgcggatgaggtactgcgggttgaacacagctgcatttcttttggtgagattgccatggaggaaagagagcgggcgtgtgaagcaacgcgaattgctttcgtggatgaacgtgctattaatgaagggggtttttcaactgatttgcatccaagcctttgtgaaagtctttctgctattgttcctcagtgccaacatgttggcaatgggttcttcatcagattcgacttcttccagtcaatgagtcacctggagcagttctggtgcccttggtgcaggtctcctctgcggcttgatcatcttctcccgttgatctcttcactgg

SEQ ID NO: 55256 - DNA, 177 bp, Glycine max
  Peptide Sequence Number=SeqID_146941
atgtggtaccatggagaccagtcagggtcacagtgttttgcgagaatgctccaaccatatgggatcaacattggcttaaaggagcactcaaaccgggtgacccctaaggcctacactccgaagagtccgtcagggcctctccctcctgattcaggtccaacccctaaaatcatttaa

SEQ ID NO: 55257 - DNA, 339 bp, Glycine max
  Peptide Sequence Number=SeqID_146942
atgcctgaaatatcctttttgatggtcgtggtcctagaagcagggaaaagtttttctaagaatactctcttaaggtcatcccagctcgtgatggaccttggagcaagacaatatggaattattttagatgtttatgagggtcttcacctgcaagaccatgaaacttgggcaacaagatgttcaaaattaccaaccacaaaatgctcagactcaccaataacagaatgctcaggatgctcaaaaggatcaaaggattgtaagtcacctggattgcctcaagtcatgcactatatgcagcagttcatgtgtttctcagacagggcaaaagaggtgggttaa

SEQ ID NO: 55258 - DNA, 366 bp, Glycine max
  Peptide Sequence Number=SeqID_146943
atgcacacacaaagtttcacaattccacaattctttaaaataggcctaactcacaaaaaggtccctagtggagtcgccaactgtcgcaaggtgcccttcgcgggcgagcgagggcgaggctcacgggtgcgctttccaaagaaggaaagatgcgcggagtcgccaccaacgtttatttgtggaaaacgtcggaaaaaccgaaggaaaccggtcaaaatgaaaattctaagttcgggagttgtatttacgcttgaggaagaggtcgacaaaagcggggctcatgctcctacgtatcctccatcaaagagtaaatcatacctacgtagttcttccttatacgtgaatcaagtgattctttttacttga

SEQ ID NO: 55259 - DNA, 156 bp, Glycine max
  Peptide Sequence Number=SeqID_146944
atgacgttgctacttagcaacattctgcccaacgatcgcaatgccgatctcaccctgtggaagtatcagttggatcgtgcccgcaagacacccagtggacccggaggagcccaacagggccttggggttttcaactctggttacgggcctctatga

SEQ ID NO: 55260 - DNA, 323 bp, Glycine max
  Peptide Sequence Number=SeqID_146945
atggcgagtccgatgacatgcggggactgcgagtccgatgacatgcgggggtaccttatggttatccgcatcttttgtcaaccagaggcaagcgagcccgttgacacgcagagactaacgtcgtcatctgcacctttgtcatccagagatagcgagtccgatgacatgcagggagatgacgagtctgatgacatgcgggggtaccttatggttatccgcatcttttgtcaaccagaggcaagcgagcccattgacacgcagagactaacatcgtcatctacacctttgtcatccagagacggcgagtccgatgacatgcgggg

SEQ ID NO: 55261 - DNA, 231 bp, Glycine max
  Peptide Sequence Number=SeqID_146946
atggtttttcacttaaggcttgtaatgagcttcaaaataaagaaagggaaacataggctcaaagggctatcaaaggaattaattcaagcatcaacaagaatcaagccaagtctattgtgcaagcaatcaatggggcaaaacacaccaaatgattatgatgatggctcaaattctcacaaaggtaaacttatcactttcaaattgagctttcagaactatcatgacatgtag

SEQ ID NO: 55262 - DNA, 622 bp, Glycine max
  Peptide Sequence Number=SeqID_146947
atgaccccaaggaagctcgcctcaaagagatccaggaaagacaaaggatggtcattcctccgggagagacgcgtccagcttagggacgacgagtataccgacttccaggaagagatagttcgccggtggtgggcatcgctggttacccccatggccaagttcgacccagacatagtcctcgagttttatgtcaatgcttggcctacagaggagggtgtgcgtgatatgcgatcttgggtgaggggtcagtggatccctttcaatgcggatgccctcaaccagttcctgggatatcctttagtgctggaggagggccaggaatgcgagtatggtcagaggaggaatcgggccgatgggtttgatgaggaggccatcgcccagttgctgtgtataccggggcaggattttgcccggaccgctgccgggaggcgggtgcgaatcatgcgcaccaatatgactaccctgactcagacatggatgacgttgctgcttagcaacatcctacccagcgatcataattctgacctccccctaccgaagtgtcatctggtgtatgccattctgacacggatgagcgttcatgtggctcagttgatcgctgatgccatttatctctttgcag

SEQ ID NO: 55263 - DNA, 564 bp, Glycine max
  Peptide Sequence Number=SeqID_146948
acttggctttagtgaagagttctatgcaaacttatacagctctgagggcctttcaccaaagcagtccagagtcagaggccatttagtgaagattgatgctgacagtctcaacacattcctggagacacctgtggtggtggaacctccaggatctattccttcagttgagcagttcagggagatggtagcctggcccgggacccaaccttcttttcacatggaagatgaaggtcccatagcccaggtacctcagcatgtggaggatgagtcatctgaggccaccatcccagatccatttgttataagagaagagacagatgagaccctggtgagacaggtagttgctgccactcccgagagatcccttgaggccacttcagagcctcctgcaccagtggtggacctaccctcacctcagcatacagtagacccttccactcctatcttagagataccagaggacccgaccacaccagtcctggctatggacacttctcttccagctactctagtacttcatctgacagatgaggaggatgttcagacacaggacacccaggacca

SEQ ID NO: 55264 - DNA, 573 bp, Glycine max
  Peptide Sequence Number=SeqID_146949
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggctggctaatgagtttggactctgaggtcagatttgaattgagggtctgttactccatctctttgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 55265 - DNA, 609 bp, Glycine max
  Peptide Sequence Number=SeqID_146950
atggacagaaacattcttgactctctgttcctaaacatccactttcatggccttgacatgaaagaaggatcaatcccagcagctttaatctataggattcaatacaaagtcatgaatacttgtgcgtctagagtcctattaaaacctcaaaaaggagagacaactttatttattaccgacatgacaaaggccaatgtttctttctcgagaacaataaaatgggatgaggtaactcttcctgaaaaatgggttatggataaggccacaccgtctgttccccgacccgcttcgaccattgaacaaattaaacaagataactccagcaatgtagaaataacctttaataggataaattctttttcatctagaatagaagcctccatgtctgaatatgagtcaaccagaagaaaggatatagattacccatggaaacaagacatcataggtgatccaacaacaaatgtgataacaaactggcaaactaaggatggtgagttaatccaatcggaggtacctcccacaacccaataccaactaccaaagttaagagacaataacgatagacctgttatggctagtcagttcaaaacaaaagatgtcaacgaggaa

SEQ ID NO: 55266 - DNA, 809 bp, Glycine max
  Peptide Sequence Number=SeqID_146951
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatctctgcatgcattatcatcaaagttgagcaatttgagagccaaatatgctttgtgctccaactccattgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55267 - DNA, 108 bp, Glycine max
  Peptide Sequence Number=SeqID_146952
atgctaagagaatcggagcaactagggcaaaaggaaggaggaagatacccatgccgtcacttcggtgcccgcatgggtcaagcccccgcagacctctcatggaattaa

SEQ ID NO: 55268 - DNA, 492 bp, Glycine max
  Peptide Sequence Number=SeqID_146953
atgtccaaatcttgtggatttgggatgaccggccctctcgatgagtcgatctcttgctttctcataagggtggacccttgggtacttgtacctatcaccttcagagggctacacgccctcgccatcagaggactgcatgtcctcaccttcgtaaggctacacgccctcacctttagaggactacacgtcctcgccaacagagggctgcacgccctcaccttcagagggctacacaccctcgccatcagaggactgcatgtcctcaccttcgtagggctacacgccctcacctttagaggaccacacgtcctcaccttcagagggctacacgccctcgccatcagagggctacacgccctcgccatcagaggaccacacgtcctcaccttgagagggctacccgccctcgccttgggtactagttaccctcaccttcagaggactacacgtcttcaccttcagagggctacacgccctcgccttgggtactag

SEQ ID NO: 55269 - DNA, 84 bp, Glycine max
  Peptide Sequence Number=SeqID_146954
atggcagctacttatgcccaaggcatgaatatcaagagaatggggaaaatgtggcatgccccattattccagaacgcaacctag

SEQ ID NO: 55270 - DNA, 369 bp, Glycine max
  Peptide Sequence Number=SeqID_146955
atgctgcaggtcgactctagaggatccccggtaatccgaccgccgatcacccaagccttcatcgagaagtactgtatgcctaggcaggcacagggtgatgcacatcaggccacgggcgcatcgccactacctcggcaggtcgattcggctgggtggccaaccaccatggacaggtgcagatacatgagtgtctctaccggttcagcctcagtcagcaggggcagggtttcgtcccttttgtatgccctaccccggagcagtttgaggctgaggtctcatggcctggagactagcccgatgcccaagcaagggaggagcctgcaggatcccccggtgaggcggatgaaccccatatggatgaggatatga

SEQ ID NO: 55271 - DNA, 978 bp, Glycine max
  Peptide Sequence Number=SeqID_146956
atgaagggccagggctgcatcatcggcgccggcgccctggagtaccccgccgagttccagggagcgagcgagaagacgctcaaggagctcgccatcggcaagacgatcaccctcatgagcacctatgaccaccgcgtcatccagggcgcaggctccggcgagttcctcaagaaggtgcacgagctgctcatcggtcagcgcggcttatacgacgacatcttcgccgcgctgcggatcccgtacgctcccatccgctggaacccggacatcgccgtcgacctcgccgagcgcgtcgacaagcagtcccgcgtgcaggagctcatcaattccttccgcgtgcgcggccacctgatggccgacatcgacccgctcgagtacgtgcagcgctcgcaccccgacctcgagatcgagagccacggcctgacgttctgggacctggaccgcgagttcgtgaccggtgggttcggcggtcgccgcgtggccaagctccgcgacatcctcggcgtcctgcgcgactcctactgccgcacactcggcatcgagtacatgcacatccaggatccagaacagcgccggtggttccaggagaaggtcgaggtcaagtaccagaagcccggccacgacgagcagctgcgggttctgcgcaagctgaacgaggccgaggcgttcgagaccttcctgcagacgaagttcgtcggccagaagcgcttctcgctcgagggcggcgagtcactgatcccgctgctcgacgagatcctgcagggcgcggcgacggccgggctcgaaggcgccgcgatcggcatggcccaccgcggacgcctcaacgtgctcaccaacatcgccggaaagacgtacggtcaggtgttccgcgagttcgagggcacgcagacccccggcaaccagcgcggctccggcgacgtgaagtaccacctgggcacggaaggcaccttcgtcgccgacgacgggtcgtcgttgccg

SEQ ID NO: 55272 - DNA, 696 bp, Glycine max
  Peptide Sequence Number=SeqID_146957
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggaaaaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55273 - DNA, 396 bp, Glycine max
  Peptide Sequence Number=SeqID_146958
atggtacttcgaacttggaacgagtatgaagaaattaacgatacttctttacctttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagcccaatgaattgggatttccctattgggccaggtcatttcgggacaagcggatcatttatgatgaagaggatgagcttcaagagaatgattcagagttcttgcagggtggaaccatgcagtaccagacacgagatagatcttccaaagaacagggcttttttcgaataa

SEQ ID NO: 55274 - DNA, 234 bp, Glycine max
  Peptide Sequence Number=SeqID_146959
atgtcgagctcacacccgggatgtttgatgagttcctccaggaactccagaggcgcagatgggaccagggttcgaggacaggtggtcagattcgatgttgagatgattaacgatttccttgacaccctgatagtcctggcagatggggaagagtatccaacttactctcagtatctccgcactcctctagatcacgacgccatcctctctgccttgtgtactccagggggatga

SEQ ID NO: 55275 - DNA, 357 bp, Glycine max
  Peptide Sequence Number=SeqID_146960
atgaggattcttttttataggccaaggttcaaaaagtctaaggttgtgtttcaatggggtttgttatcgtgggaacccaatcttgatatctggggtgaaacaaatttgggtgtcaaggtgtcggtttcgggccgagcttccatattgttccataaggcacgcgtgacaatgatgattcgaaaacaacgtgcaaaattagtcatggctacagccaggtgggcactcaagcatcccgtttatggcattgtgatactacagttgggaatttacatagacagacccaacgtttccaagttatgttctttcatcagttcaatgaattcatccatccttatctcggttcattccggaaaataa

SEQ ID NO: 55276 - DNA, 356 bp, Glycine max
  Peptide Sequence Number=SeqID_146961
gaatttacaagatagtggaactctcaagcgggttgcttggggactggacgtaggcacaaggaaatctaccctgaggttcatgagaaccctagggccttctttagcagctttagcccaatcctcttggagcctcttgctcatggctctagtgactggtcccttcctagggaggattacatcacgaaccaagatagatgtttatgctagcacattgtctatggaatttggtgatattgttattcattttaacattcttgatgccatgaaacatctgtctgaggatcattctgtttttcgtgttgagatacttgatcagattgttgatgattatatgtttgatttttattctcttcatg

SEQ ID NO: 55277 - DNA, 369 bp, Glycine max
  Peptide Sequence Number=SeqID_146962
atgacacatcaactacatgtcctcgccttcaaagggctacacgccctagcctttagaggactacacgtcctcgccttcaaaggactacatgtcctcgccttcagagggctacacgccctcaccttcagatggcttcacgccctcgcctttagagggctgtacatcctggccttcagaggtctacatatcctcgccttcagagggctacacgccctcgcctttagagggctacacaccctcttcttcaaaggactacacgtcctcgccttgagaggactacacgtcctcgccttcagagtgctacacgtccttgctttcagagggctccacatctacgctttcagagaactcaaggtcttccgcccttaa

SEQ ID NO: 55278 - DNA, 252 bp, Glycine max
  Peptide Sequence Number=SeqID_146963
atgtctcttaaaccgtgggggagacatgaaattccccatcacaatctagccgacttcgagccttggctcgaatatgccactgaagggcaagcagttggtggaatgggaaagttggatcatctagaggaaaggcttagggccattaaaggaggtgaagattatgcctttgcaaacctagaagagttgttcctagtacctaatatcatcacccctcccaagttcaaggtgctggactttgacaagtacaactag

SEQ ID NO: 55279 - DNA, 545 bp, Glycine max
  Peptide Sequence Number=SeqID_146964
tgcatgaggtagctacaaacccatctgcatcatctgaaactaagaagcttgaaggcaaactggatgtgttggtcaacttggtaacccagctggccttgaatcagaaatctgtacctatcgcaaggcaacaacaacagcagcctgctccttccttccaaaatgctgctggcccaagcagaccatacattcctccaccaatccaacaacagcaacaaccccagaaacaaccaatagttgaggcccctccacaaccttccctcgaagaacttgtgaggcaaatgactatgcagaacatgcagtttcagcaagagaccagagcctccattcagagcttaaccaatcagatgggacaattagctactcaattgaatcaacaacagtcccagaattctgacaagctgccttctcaagctgtccaaaaccccaaaaatgtcagtgccatttcattgaggtcgggaaagcagtgtcaaggacctcaacccgtagcaccttcctcatctgcaaatgaacctgccaaacttcactctattccagaaaaaaggtga

SEQ ID NO: 55280 - DNA, 432 bp, Glycine max
  Peptide Sequence Number=SeqID_146965
atgggggatcccatcagcagactctccttccctggtagacgcattgtttgtcactcaaaaaaagcatatgctgctctaatcagttggaagtgttatctctttactaaagcacgttcgcattttagcgaagaaaacatcgagactatttctagtctcacaagttatccagaactacgtaggtctgagttcctcattggaggatacgtaggagcaggagcctcgcttttgtcgaccgcaccgctttttgttaccatgacccaaaagctggtagcccgcagagacaccttacggttatccgcacctcgtcattcagtgaccccaagtgtgattgacaagcggagaccaatgtggtcatctgcgccctttccggaggtgtcagcatttttcggtggagactttttcaagtctcacaagttatttagaactacgtag

SEQ ID NO: 55281 - DNA, 258 bp, Glycine max
  Peptide Sequence Number=SeqID_146966
atgaccatgattacgccaagctcgaaattaaccctcactaaagggaacaaaagctggtaccgggccccccctcgagattatattaagccttctgaacagcctgaagattatctcggtggtttcacggtgtcgatctttggtgcagaagaattggcaaatgaatataaagccaaaggtgatatcgaattcctgcagcccgggggatccactagttctagagcggccgccaccgcggtggagctccaattcgccctatag

SEQ ID NO: 55282 - DNA, 261 bp, Glycine max
  Peptide Sequence Number=SeqID_146967
ggtacatcctttgtggtacaagtagagggacaactcaagtgggttgactcaaagatcaatcaagagaggacatctcaagtgaatcagtttagggagggacaattcaagagttcaagtaagaatcaagaagggtacatcccttgtgaagactcaagaagaaatgctaagagtcgaatcaagattcaaggttcaagatctcaagaaatcaagatcaagattcgactcaaggttcaaggaatcaatgagagaggcacgggttga

SEQ ID NO: 55283 - DNA, 354 bp, Glycine max
  Peptide Sequence Number=SeqID_146968
atgcataaggcattacggaccaatgcacctcttccatatcctcaattggtcaccctctttctccatcattttcaaattcctcttgatgatgaaccttttgttcaagtcaagcgttcctttgctataggtgctggtgcagtcacttcatttggttactgtaaggatcgtaatggtcaatggctgaagaaagatgcccttcctccacaagatgagcgtactccttctcctcctcctcagcgagatgattcagcccttatgactgaagaatggatatccatctcacacagcttgaagaagatgtgggttatattcgtcagagctttgatcttccaccaccacattcttagtgtttag

SEQ ID NO: 55284 - DNA, 417 bp, Glycine max
  Peptide Sequence Number=SeqID_146969
atggcttccaatatcaaatccgaccaattaacacacacttcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 55285 - DNA, 354 bp, Glycine max
  Peptide Sequence Number=SeqID_146970
atgggtttaggcaagaacaacggcggcagaaccagcctgataagcattagaggaaaccgtgggaagtttgggttaggttataaacccacacaggcggacataagaaagagtgttgcgggaaggaagagcggaagccaaggctcatccgacgacgagtccatcgaaggtattaatacctgggacttgacaatcgatttcaagcaagaaacagatcagacggagggtggagaggacgaagatgtgggacttcccccggagttggagaagatagtcgcccatgaggaccaagagatgaggcctcatcaagaagagacggaactagtggacttaggaaccgacagtgggaaaatggaa

SEQ ID NO: 55286 - DNA, 102 bp, Glycine max
  Peptide Sequence Number=SeqID_146971
atggggctccgaaaaagatttgatggtggaggatgcacgaacagcgcaagtgctaggcaatcaattcgtggggcttcggactcgatggtggaggatgcatga

SEQ ID NO: 55287 - DNA, 138 bp, Glycine max
  Peptide Sequence Number=SeqID_146972
atggcgaatcaagcttatcgataccgtcgacctcgagggggggcccgctgcattaatgaatcggccaacgcgcggggagaggcggtttgcgtattgggcgctagcggagtgtatactggcttactatgttggcactga

SEQ ID NO: 55288 - DNA, 324 bp, Glycine max
  Peptide Sequence Number=SeqID_146973
atggggggtgcaaatagcaattttgaaattttgaaattgggccttccagagtattttcggagctggattgcttctggagtaatcaacccagctcgcctgggcgagctgggcggcaacctcctccccttttttcctataaataggttgaagggggctgttctaagggtcccggatccccctggtgatgtatttcagctattttgggtgaaaaaaatcgttttcgtgaagaaaatccaagccgagattttcctccgttattcaccgttcttcatccgttcttcgttcttcaacggtttcttttcttccgtttttgacgagctttaa

SEQ ID NO: 55289 - DNA, 345 bp, Glycine max
  Peptide Sequence Number=SeqID_146974
atgtctgcacaacacacggctccagccacaccccggccagccaataatacgactcctggcacgaaggttgagagcggtggaagcctcggcaactatcctttctcggatttagccgatctgtgcctggtacctgacatcatcattcctgccttcaagtttaaggcagcatccggtcgtggaaaacgacttgaatgctctgtttcatctggggaatacacacgacatggactcccgacggaagaacttcagagcatgagcaaacgggaacatgagtccattaaggaatatgctcaaaggtggacgggacctagcagctcgaagtcatccgagagagatgggaaatga

SEQ ID NO: 55290 - DNA, 214 bp, Glycine max
  Peptide Sequence Number=SeqID_146975
atggtcaacttatttcagcctgataatacagaaagatcttcagaatgtgggtctgccttcaagaatgatgggaacatgatccttgagaatccttgcttcttattgcaaaatccaacagagggaatggaagagggggaatgtgctgcttctgcaaatcagaattacctgtggaagaagattcacctgcacagaaattatgaggaaggtgctacag

SEQ ID NO: 55291 - DNA, 915 bp, Glycine max
  Peptide Sequence Number=SeqID_146976
atggatcaggagagaagaacggacgtcggtcaggatcgcgaggccgacctgctggccagaacgcgaacgggggacgagggcgcgtacgccgaactctggcggaggtacgcgcagatcgcgaaggtcgtcgcccgcacctactggtggtcggccgactcggacgacctggtgtcggagtcgttcacccgcatctaccaggccatccgtgcggggaaaggacccacgagcgccttcaagccctatctgttcgccaccatgcgcaacctggcggtcagttggggtcgggctcgtcgtgagctccccgtcgagcacatcgacgcggtcgaggatcccgcgtcgaccgaggccgccgcggacgaccgcttcgacgcgacgttggtgtcgaaggcgctgctcaccctcccggatcgatggcaggaggtgctctggctcgccgaggtcgaggacctgtccatgcaggagatcggggaacggctcgacatcagcgagggtgccgccggtgtgctcgccttccgcgccagagaggggcttcggcaggcgtggatcgccgcccacctctccgaccggccgccgtccgcgaaggagtgccggtggacgctcggcaagctcggaggacacgcccgccgtcgcctgaccgcccgcgacgatcgacgtgtgcgcgcgcacctcgagcagtgcccgcagtgtcgggcgagcgcggaggaagcgcgtcgggcgagctcgcgcatcctgtcggtgctgcttccgggagcggtcgccctgggcgccggtgtgcagaagtggcaagcgttcacggcggcggcaacggctgtcgtcgcctcgttgatgcccgtctcggtgacacttcccgtcgcgagcctgactacggcgaaagagggcctcgtcgcggcgacgctggtctcgaccgcgacgctg

SEQ ID NO: 55292 - DNA, 81 bp, Glycine max
  Peptide Sequence Number=SeqID_146977
atgaataagaaggttaagtggtggctggacagaaatatagaaatggcaataactgaagctacagggctccaaatgaggtga

SEQ ID NO: 55293 - DNA, 252 bp, Glycine max
  Peptide Sequence Number=SeqID_146978
atgggtgagagtgcatcgttgacaacttctggtgggaagaacaaagcaattaagtctctacgtaatctgaaggtgaatggtaaaatacctcctcaagctgataataagaagggtatgcaaaacctaaggaaactagtgggaagtgagcaaagcattttattaggcaataagctaggctcacctacgaaggctatcggaaccctgcatgaagttctcctttctctggctcaccaatgtgaaaggtgtgcgtga

SEQ ID NO: 55294 - DNA, 396 bp, Glycine max
  Peptide Sequence Number=SeqID_146979
atgggcttgtcggccgcgattgacgaagggcgcagaagacgacgtcagctctgcgtgctatcaggcttttcgtcttacagacagcaaaaaagaatgtttatacggataaccactcggacagcaaaaaagaatgtttatacggataaccactcgggtatctccgcccgtcagcgtgactcaaatgtcagtatgacagatcttgtgagcgcggaagatgacgtaaatctccgcgtgtcaacgggcttgtcggtccgcgatagtcgaagggcgcagaagacgacgttcagtcttgcgtgctatcaggcttttcgtcttacagacagcaaaaaagaatgtttatacggaaaaccactcgggtatctccgcaccgtcagcgtgactcaaatgtcagtatga

SEQ ID NO: 55295 - DNA, 645 bp, Glycine max
  Peptide Sequence Number=SeqID_146980
atggtaccgactattgaagagtttgaggaaatattaggatgccttcttggggggagaaaaccctatcttttctccgggtttcttccctccttgagcaagattgcagctgtggttggagattcggcaaaagagatggatcgcatgaagcaaactcggaacggcgtagtgggcctgccttggaaatacttggaaggcaaggcaagggatatggcgagccaagagaagtggggcccgtttgcggatatactagctttgttgatttttggggttgtcctctttccaaatgtggacagtttggtggacttagccgcgattgatgctttcctcgcatatcaccatagcaaagagagtccagtggtggcaatcttggcagatttgtttgacacctttgaccggaggtgtgagaaaaatagcacacggattgtctgttgtttacccgctctctgtgtgtggttggtttcacacctattccaacaagacacaagacacccgtgtccgcttcaaagttatcgctcatgcgccgaaaaaggaagagtcgaattgggaccaacatttggctgggatagggggcagcgcgatcaattggttttctcgttggaaggaaggcaaggaaggagttattttctcgtgtggggactaccctaa

SEQ ID NO: 55296 - DNA, 245 bp, Glycine max
  Peptide Sequence Number=SeqID_146981
gggcagaatcgtcttaggccacagtccgaggtcgagacaaagctaaaagcagaaaccaatcaagaggctagggtcatgaccgacaaatcgtcatcccttcccagctcgggacaagcggaaaacgccactgtaagacagcctagggatggccttaggcctagggtgcatcctgaagcaatggggcatgccacattgcccccactcgcttgctattcatgcctaaacatgcgcccaccaagtgctcg

SEQ ID NO: 55297 - DNA, 1231 bp, Glycine max
  Peptide Sequence Number=SeqID_146982
atggctacctcaccaaaagaaatttccgcttctggttcacccgctgtaccatcatctccgcaccaggaacaaccagaattcaacatccaacccatacaagtaattcctggtcaagcttctgtccctgagaaactggttcccagaagacaacagggagtgaagattgatgaaaaccctagccctgcaacaattcctagggaagtagacacggagatggacaagaaaatccgcggtattgtgagtagcattctgaaggatgcttctgtgcctgatgctgagaaagatgttccaacatcttccaccccagatgtttctgtgcctgatgtcaataaagatgttccaacatcctccgctccaaatgctgaagccctcccttcacccagtgaagaggaatcaacagaagaagaggatcaagcctcagaggagacccctgcaccaagggcaccagaacctgctccaggtaacctcattgacttggaagaagtcgaatctgatgaagaacccattgccaacaggtctggaagaatcaagactatggcccagaagaagagtgctccaatcactcctgccacatccagaagaagcaaggttgctatcccctccaagaaaaggaaagaaatttcctcatccgatactgatgatgatgtcgaactagatgtctcgacatctaagagggccaagacttcagggagaaaggtgcctggaaatgttcctgatgcaccattggacaacatctctttccactccattggcaatgttgaaaagtggaaatatgtgtatcaacgtagacttgccttggaaagagaactgggaagagctgccatggattgcaaggagatcatggacctcatcaaggctgctggactgctgaagactgtcagcaagttgggagattgctatgaaggcttagtcagggaattcattgtcaacattccctctgacatatcaaacagaaaaaatgatgattatcaaagagtgtttgtcagaggaaagtgtgttagattctcccctgctgtgattaacaaatatctgggcagacctactgatggagtgatagatattgatgtttctgagcatcaaattgccaaggaaatcactgccaaacgagtccagcattggccaaagaaagggaagctttcagcagggaagctaagtgtgaagtatgcaattctgcacaggattggagctgcaaactgggttcccaccaatcatacttccactgttgccacag

SEQ ID NO: 55298 - DNA, 351 bp, Glycine max
  Peptide Sequence Number=SeqID_146983
gaacaacaagctaagtgggaacaacaagctgagtggataaatgcccagagacagattctgcgccctttatcattcaggaatgacaagctgagtgggaacaacaagctgagtgggcttgatcatttccaacgaaacgcagagacaaattatggtcattctgcgtctttatcaaccgagaggaacaaattcaacagtatcaggatgatgtgtcgggaccatccgttgttaggatgcgagcctcatttaaccacttcgaggtacttggcacccatcgttaggcaattcgtgaagttctgtgatatgccggaagtcaaaggaaagcattgtagcacaatccgtgaagttccgtga

SEQ ID NO: 55299 - DNA, 540 bp, Glycine max
  Peptide Sequence Number=SeqID_146984
atggcctccatgatggaggccatgttaggtatgaggcagctcatggaaaagaacgcggccaccgctgccgctgtcagttcggctgccgaagcagacccaactctcttggcaactgcgcaccatcctccctcaaacatagtaggacggggaagggacacactggggcacgatggcagccctcacctgggatacaaccgagcggcttacccttatggattgccgcccaactactcaccacccgtcttgcaagacgatgcgggccatattgcttctcccgtccttgaaagagagcctcctcaacagcccgacgaggtccacaaagaccctcaagactatgctcgaagggatgtcgagttctatcccccgatcctggaagggccggcacccagcacgttgcctcaacccaacatcgcgacacaaccaatagttttgtccgcggaaggaccgcccccgacaactgaagaaaagaggaagcttgatctccttgaggaaagattgagagccgtggaaggatttggggactattcgtcacagacatga

SEQ ID NO: 55300 - DNA, 168 bp, Glycine max
  Peptide Sequence Number=SeqID_146985
atggaacgagctgagaaaagatttgagtaccgtttctactattcttcggaagaaaacaatggggaagaggacaatgagggtggaattggtgctgtggatgcgctaatttcaatcggtgagatcaaaataaatatgaataagaagaagattgctatttacgggagttga

SEQ ID NO: 55301 - DNA, 867 bp, Glycine max
  Peptide Sequence Number=SeqID_146986
atgccttcttgggggaagaaaaccgtatcttttctccgggtttcttccctctttgagcaagattgcagctgtggttggagattcggcgagagagttggatcgtatgaagcaaacttgaaacggcgtagtgagcctatgcggaaatacttggaaggcaaggcaagggatatggcgaatcaagaggagtgggtcctatttgcggatatactagctttgctaatctttggggttgtcctctttccaaacgtggacggtttggtggacctagccacaattgatgctttccttgcatatcaccatagcaaggagagcccagtggtagctatcttggcggacttatttgatacatttgaccgaaggtgcgagaagaacagcgcacagattgtctgctgcttacccgctcttggtgtgtggttggtttcgcacctattccaacaagacataaggcacccgtgtccgcttcaaagttatcgctcgtgcgtcaaaaagagaagagtagattgggaccaatacttggctgggataggaggcagcacaatcaactggtttccacgatggaaggaaggaaaggagggagttctcttctcatgtggggactacccaaacgttccgttgatagggaagaagggttgtattaactataatcccgcacttgccataagacagttagggtaccccttgaggggagcaccgacggaaaagagcctctcgcctttccttgtgagagattttggcgcgcaaagtctcaagattgtacaaagagtccacaaggcgtgggaaagcacgttaaggaaagataaagaacttagggacatccgtaatggcatcatcgatggttatcatgaatggctaagagttcatacatga

SEQ ID NO: 55302 - DNA, 684 bp, Glycine max
  Peptide Sequence Number=SeqID_146987
atggtatcttatctaaccaatccgggtaaggggccttcttattgggaccccccgaagaactccgcggtacaactagccgcagcgatcactgccggctcaaggatctatatgtacaagtatatttcaagagaagactgcttatatacagacaccgactctattgtccttggtaatccacttccggaggaagatgtttcctctaaatgctatagctataccacagaagagtcagatggcaataagaaggtctataagtacaagggaccgggtagaaatgttataactccagaatggtataaagaacagtacgccgacccttcccaaagtctgataaagaaggtaacttatcaatttcgacccgattggaaagaactctcggttaaaaagaaagagaatccacttgatatcaatgacttgtcatctctaaattacattggaacaaaactattagaaagttttaaaaggaaaacagctattttagaaaaagagaattcggctctttctcagaaattacagaagctggaacaggaaagaggtataatagcccagcggagagtagaagaaggaaataataccgaagataataatacattagagcaaaataatgctaaaagggctgaagataatatcaatggagatctattggatccagatacgatgccgcgggataaaaagcccccctga

SEQ ID NO: 55303 - DNA, 231 bp, Glycine max
  Peptide Sequence Number=SeqID_146988
atgatgcagatgatgatgatgattaagtctctttgtaaacaaagattcaaaaatttcttaaaaaaaagatggaaaaatctaaaagaaaaattacgtgagaaactaaagaaagcatacatcacctgggatgcccaaaatgatttggaatcctctgatgattctgaaaatgcaagagaccctaaatctttgggtaccttatggcaaaaagttacgaaagtgatgaagaggtaa

SEQ ID NO: 55304 - DNA, 606 bp, Glycine max
  Peptide Sequence Number=SeqID_146989
atgaagcaaactcgcaacggcgtagtaggcctggcacggaaatacttggaaggcaaggcaagggatatggcgagccaagagaagtggggcccatttgcggatatactatctttgttgatttttggggttgtcctctttccgaacgtggacggtttggtggacttagccgccattgatggtttcctcgcatatcaccataccaaggagagtccagtggtggctatcttggcaaatttgtttgacacttttgatcggaggtgtgagaaaaacagtgcacggattgtctgttgtttacccgctctctgtgtatggttggtttcacacctattccatcaagacacaagatacccgtgtccgtttcaaagttatcgctcgtacgccgaaaaagaagcaagagggagggtgattgatgcattgcatcaagaagcgactatgtggatggataggttcgccttgaccttgaatggaagtcaagacctcccgcgtctattagccaaagcaaaagccatggccgaagtgtgtacagcccccgaggagattcatgggctaatcaattactgtcaacacatgatagatttgatggcccatataattagaaaccattag

SEQ ID NO: 55305 - DNA, 234 bp, Glycine max
  Peptide Sequence Number=SeqID_146990
atgaacagcgctaggcaatcaattcatgggtctccgaataagattgagaatggagaatgggcgaacagcgctaggcaatcaattcggggctccagactcgatggtggaggacacatgaacagcgctaggcaatcaattcatgggtctccgaataagattgagaatggagaatgggcgaacagcgctaggcaatcaatttgcggggttccagactcgatggtggtggacgcatga

SEQ ID NO: 55306 - DNA, 798 bp, Glycine max
  Peptide Sequence Number=SeqID_146991
atggggttgaaccaagctcatgcttttacgaaaaaggttcatcaagtcaagttgaagtatggaagtaaccatcttgcaaaattggggcaaaagatggatcgggttacatcgctgcttcatctactgccaaacacatttaggactgttgatgtccttgttacttctagtttcaccttgacaaagatgtcatggaccacgaaagaacacgctttacgacgcccttaccgaacccgtgctagagtaatgggtgaagtggaagaggtgcaagagcaagtgaaggctgacacggaggccttaaaagagcaaatggccacaatgatggaggccatgatgagcataaaggagataatggaggtcaatgcggttgcaatagccgctaccagcaccattgccgagtgcaaaaacaagcatgccttcccaccatatgacttgcctcccaactatacaccacccaatgtggcatacactcccagtgaggatgtcaataactccgctcccatactctttgaaagccgacaacctcaaactgatcatgcacatgtctctcaaaccatgggggagacacatgaaattccccaccacaatctagccgacttcgagccttgcctcggatatgccactgaagggcaagcagttggtgaggaaaggctaaaggtcgttgaagaaagtggaggttatgcctttgctaacctagaagagttgttcctggtacccaatgtcgtcacccctcccaagttcaaggtgtcggactttgacaagtacaaggagactacttgccccaagaaccgtctaaaagat

SEQ ID NO: 55307 - DNA, 247 bp, Glycine max
  Peptide Sequence Number=SeqID_146992
atgcagtcagatgataagaaaccaagtaagcccaagtctttggtgatccacttcactagggatgtcgccactcagaggcctcgtggtttccagcctgttacaattaagaagcctacgcctttcccttacaaaagtgataaggcagtgctatggaagtacgccgcacaagggcccgatgggaggaaagatacgtttgtcatacatgttaaagatgatctatcctccactaaagccacaaacatatctg

SEQ ID NO: 55308 - DNA, 673 bp, Glycine max
  Peptide Sequence Number=SeqID_146993
caccgaaagaagacgaaaagacaaagctctcaaaaacgagttaggaaaggcgaaacttgccaaggagaagttcaagttagccactacacacatccggaaggaatgtgccggattacgggaagagaatgcaactaccgcaaaagcccttgaacaagagaccaagagggctcgcaaggaagagtatggccgtaacaaatttcgcggagctctgtggggtagcaacagtgaactcaagctgcaaagggaagagagggaccagtcgcgagcacatagcatggtcttgaaagaggagttagttgcctgttcgaggtccaaaaggagcttgtctcagcgtttatgcgagacggagaccaacatgctagctatcatcgccaagtaccaagaagagttaagtctagccacggcccacgagcatagggtcgcagacgagtatgcccaagtatacgcggaaaaagaggctagtggaagggtgatcgactctttacaccaagaggcaaccatgtggatggatcggtttgctcttaccttgaacgggagtcaagaacttccccgattgttagccaaggccaaggcaatggcagacacttactccgcccccgaagaaattcatgggcttctcggctattgtcagcatatgatagacttaatggcccatataattagaaaccgctag

SEQ ID NO: 55309 - DNA, 488 bp, Glycine max
  Peptide Sequence Number=SeqID_146994
gatttcactattgggtgggtaaaatctttggtcggacataccctgaaactttaggtcaaatccatttttggatcacttttttcggggttaatctgaccctctttcccatgcatttcttagggctttcgggtatgccacgtcgcattccagattatccagatgcttacgctggatggaatgcccttagcagttttggctcttatatatccgtagttgggattcgtcgtttcttcgtggtcgtaacaatcacttcaagcagtggaaataacataacaagggcgaacattccttgggctgtggaacaaaattcaaccacactgaatggctggtacaaagtcctccagcttttcatacttttggagaacttccagctatcaaggagacgaaaagctataatggctacttaccaacagaggatagcgaggtactacaaggccagagttaaatttggaaattggatcgagctgagccggagctgctcctactga

SEQ ID NO: 55310 - DNA, 309 bp, Glycine max
  Peptide Sequence Number=SeqID_146995
atgcaagggttgtggttgtgggcgatactctgggtcccccaaagtgtttggcaggggtacgccactgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgcttccctttgctcctacgtattcctcaattggggatgagaaaatcagacctacgtag

SEQ ID NO: 55311 - DNA, 159 bp, Glycine max
  Peptide Sequence Number=SeqID_146996
cttgcatgcggggcagattctgctactgtggcaatcaccacgacagatcttgttagcaagagtgtggcaattgagtctctggttttgtgggtaatgttgggtcctgcacaaagattaataggcccgtggacattatcacagttgtgggggttaatataa

SEQ ID NO: 55312 - DNA, 1296 bp, Glycine max
  Peptide Sequence Number=SeqID_146997
atgacgaaagtagtggataaccataaagtgtgtccgcaagctaccagaccctcgggtcacgatagcagaattgagactttttcgcggtctcggccggaagacgctgccatctctgggaagggtgtggataaccataaggtgtgtccgcgtgctaccggacccttgggtcacgatagcagaattgatactttttcgcggtctcggccagaagacgctgacatctccgggaagggtgcagatgaccacattggtctctgcgtacccttgggtcacgatagcgaaaatgagactttttcgtggtctcggccggaagacgctgacatctccgggaagggtacagatgaccacattggtctctgcgttcgcttgcctctagatgaccataaggtgcagataaccataaggtgtgtccacgtgctaccggacccttgtgtcatgatagcgaaattgagactttttcacggtcttggccgaaagatgctgacatctccgggaaggaagacgctgacatctctgggaagggtgcagatgaccacattggcttcttcttgtcaatcggacttggggtctccgaatgatggggtgtgtctgcgtgctaccggacccttgggtcacgatattgaaattgagattttttgtggtctcggctggaagacgctgacatctccaggaagggtgcagatgaccacattggcctctacttgtcaatcaaacttggggtctccgaatgatggggtgcgaataaccgtaaggtgtcttcgtgtgccatcggactcttggggcgagaaagtcaccagcgcaacaaattttggttggcaatcaaagggagagaaccacttcaagtcatggtttcctttctttccttatttggttgtgactattctgtattgtttggatatttgtctgcgtgttagcagctcaacagtgagtgactcttctttcttgggagaccccactattcctttctctgagggcaaggatggaaattctcatcctgggtcaaggtttatgcaactcagggataaggggaatgtccctcattatttccatgacacgcatgcaacaatgatggattatgagctctggacgcgagatggggatttgttgatcacaggcccaatacctgctcgtatctgtcctggtggttgggtgtctgctggtcggccatgtatcgtaggcaatgctctagcctttgtagatgagctgaggtggattctagaggtggtggcggtgcgtctgccgccagctgctggccatccccaggctgtcgtggtgcttcaccctgcacctgcctag

SEQ ID NO: 55313 - DNA, 430 bp, Glycine max
  Peptide Sequence Number=SeqID_146998
gaaagaacacgctttacggcgcccttaccgaacccgtgctagagctagagtaatgggtgaagtagaggaggtgcaagagcagatgaaggctgacatggaggccttgaaagagcaaatggccacaatgatggaggccatgatgagcataaaggagataatggaggtaaatgcggctgcaatagccgctaccaacaccattgctaaggtggacttgacccccccgcgacccttatttagtgcgaaaaacaagcatgccttcccaccatatggcttgcctcccaactatacaccacccaatgtggcatacactcccagtgaggatgtcaataactctgctcccatattcattgaaagccgacaacctcaaactgatcaagcacatatctctcaaaccattgggagacacatgaaattccccaccacaatctag

SEQ ID NO: 55314 - DNA, 411 bp, Glycine max
  Peptide Sequence Number=SeqID_146999
atggacgaagatcagtggatgtatgaaagtataatgtttgaagaagtgaatatagattatgaaaatgaagaagaatgtggtgtgaatgaaccacatgttgattattcggatgcgtttaatacttctcagataataatgttcatgattttattatgcaccattggtagaacaccagatgatatattaaacatacttgaagccactatgatccctactcatgatgccctgctatattacaataggaggtggaacatgtcacgccaaaatgagtttgttggttactcattcacagcaaaagatcccaaaaagtttgacattcctttcggatgtaccatgaatgaactgaaggatttgatcaagcaagttgcgccttatgggattcccccttatggtatttatgaaacacaaacg

SEQ ID NO: 55315 - DNA, 691 bp, Glycine max
  Peptide Sequence Number=SeqID_147000
ggacacgctttacgacgcccttaccaaactcgtgctagagctagagtaatgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatccggcctcaagcaaatgaatcatccaacctcaaatatggtaggcaaagatttgggaagtacggatgaccccatgatgtgcaaattcaaaacaagcacgccttcccgccatatggtttgcctcccaaactatacaccacccaatgtggtgtacattcccaatgaggatgagacacatgaaattccccaccacgatctagccaacttcgagccttgcctcggatatactgctgaagggcaagcagttggtggtatacccctgcaaaacactttggagggccctcagtatcacccacaactgcacctcttgcattccacagcggataaaaaaaccctcatgactatggtaggaatgggaaagttggatcatctaaaggaaaggctcagggccattgaaggaggtgaagattatgcctttgctaacctagaaaagttgttcctaatacccaaacatggtcattcccaagttcaag

SEQ ID NO: 55316 - DNA, 477 bp, Glycine max
  Peptide Sequence Number=SeqID_147001
atggtgaaagttggaacctcttacgtgccgatcaactgtctcgttttcgccaaaagttggcccagggcttcccggtttcaacatgggacaccaggatttattatagtctctaactctggaagtttgggatcttccgtcacaggtcttattcggcataccgtgcgcctcgagggtgatgctgccgctgttccctcctgttcagctactgacggggaattggttatccgcgtcaattcggcacaaagcactacagccggaagcatcagcgctggcaagtgtaaagcctggggctgccaactgtctgggaaagggcctgatcggtgccgggccttcgctattaagaatcgccaacgctggcgaaaggggagatgtgctgcaatggcaagaatggaaaaggctgccaccgcggtgcgtcagctagaactagtggtcccccgggctgaacaggaaattccgatcttcctcgcttcacgttga

SEQ ID NO: 55317 - DNA, 777 bp, Glycine max
  Peptide Sequence Number=SeqID_147002
atgatcccacagatttctcaggcacctggcgtcgttcaactggtgcttaattttttgcaggcactggagcaacagggttttacaggtgataccgccacgaactatgccgacaggctgacgatggccaccgataacagtatctaccagcttcttcccgatgccgtcgttttccctcgttcaaccgccgacgtggcgctgattgcccggctggccacgcaagagcggttcgcctctctggtctttacgccgcgtggcggcggcaccgggaccaatggtcaggcgctgaaccagggcattattattgacatgtcgcgctatatgaaccgcatcattgagatcaatcctgaagagggatgggtgcgcgttgaagcgggcgtcatcaaagatcagctaaatcagtatctcaagccttacggttacttcttcgcgccggaactctccaccagtaaccgtgcgacccttgggggcatgatcaataccgatgcgtccggtcaggggtcgctggtctacggaaaaacctccgatcacgtgctgggcgtgcgtgcggttctgctgggtggcgatattcttgatacccagccgatgccggtcgaactggcggaaacgctgggtaaagacaacaccaccatcgggcgtgtttatcgcacggtgctggagcgctgtcgtgacaaccgccagctgatcctcgataaattccccaaactgaaccgcttcttaacgggctacgacttgcgtcacgtctttaacgacgatctgacgcagttcgatttaacccgg

SEQ ID NO: 55318 - DNA, 468 bp, Glycine max
  Peptide Sequence Number=SeqID_147003
atgtcgttgatgaggttgtctttcgtcatatttcacccagaagacgattattgtgtccaatttctggaatacttggatcaccatgagagtgaagggcctattattgtgttgttgagcaatgccagaattaaagagggtcagggatcctatccatgctcagttagcaattctttgaaggcttcaaaattgactattcatgagccagtggcaccaattgaagaattcaatcagaagctttcaaaattgggcattgagattcgctcagttttgacacatcgttcccagtggagttcgcagcctttaggttctgctcagttatcatcaagggaggcattcatttccaagtcagaggcaaagagcatttctgagataaacaacatttgtgaagagtttgtttgtgttactgttggcacaatcacgaggattgttatggacaatcattcatggtgttatgcatcttgcatttag

SEQ ID NO: 55319 - DNA, 198 bp, Glycine max
  Peptide Sequence Number=SeqID_147004
atgaatgtaattgataaacaaagacaccgaacacaacaacatagcaaagtccccagcggagtcgccaactgtcgcaacctacccttcagcgggagggcgacgcgaaggctcacgagtgcgtcttccaagggaggaaggcgcgcggagtcgccaccaacatttattcgaggaaaacgtcagaaaaaccgaaacgtgtag

SEQ ID NO: 55320 - DNA, 417 bp, Glycine max
  Peptide Sequence Number=SeqID_147005
atgccgatctccccctgcggaaggatcacacccacaaagacacctagtggacccagagaagtccaacagggccttggggtttccagctctagttacgggcctctgttagtcctacagggtgcccgttccccccagcaagggatcgcgcccgcaagacacccagtggacccgaagaagtccaacagggtcttggagttgccagctctgattacaggcctctgtcaattctacggagtgcctgtcgcccccagcaaggtcatcaagccccctactaatcgagcttccatcaagaagtgttgtgccctcaggcaggcgcagggtgaaacaccacagcaatctggggatggtcggcagcgggcaacagacgcactgccaccacctctagagttcacctcagctcatccagaaaaaggttag

SEQ ID NO: 55321 - DNA, 432 bp, Glycine max
  Peptide Sequence Number=SeqID_147006
atgaaagataagcgggatgagaaagaaaaactagaaaaccaaaagaaaaagaaggatagtaagaccttttcttcaaaggccaagaggaagaaaaaagaggaaaaggattcctccaagaagattgttaagaaggaaaatcattttgcaacaaaatgtgatatcaaaagagcactccttcttaaacaatctttctaccttctcctatcaagggaaacatcccttagcaccgccatacctcttgggcttgaggttattcctcaagtaaaggagttgttggatgagggtttggttcgtaagagcttaaatccttgtgctttgttggtgcccaaaataagtaatatgaggcaccaaatccctatgataggtggtatgatgaatgtgttgaatggtgaaaccctctttagtaaactcatgcacccaacatcttcatga

SEQ ID NO: 55322 - DNA, 456 bp, Glycine max
  Peptide Sequence Number=SeqID_147007
atgaagcacttcactgacaccctcatcagtgccaacatacagtacaatagactgaagttaattctatacatagaagaaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 55323 - DNA, 366 bp, Glycine max
  Peptide Sequence Number=SeqID_147008
atgctaaacatccaaaatctcatttatggttatgagaaaatttcatcagcatactctccttccccggtagacgcattgtttttcactcaagaagcatatgctgctctaaatcggtctgagttcctcataggaggatacgtaggagcaagagcctcgcttttgtcgaccacaccaccttttgttgtcatgacccaagagctggtagcccgcggagacaccttacggttatccgcaccttgtcattcagtgaccccaagtgtgattgatgagcagaggccaatgtggtcatctgcgccctttccggagatgtcggcatcttctggtggagactttttcaagtctcacaagttatctagaactacgtag

SEQ ID NO: 55324 - DNA, 78 bp, Glycine max
  Peptide Sequence Number=SeqID_147009
atgactgtggacacttcatttgttcagttaactgctgcagtgccaagcttggtgatgcaatgtagcagaagggggtaa

SEQ ID NO: 55325 - DNA, 231 bp, Glycine max
  Peptide Sequence Number=SeqID_147010
atggaaagggagcttataggacaagcttccaaaggcttagacaagggagtagaatttggtagtttcaaccataggtttggggcttttacctttttcaaaaccacaagaaagaaccataacttaggaaccaacatgagtctttattcttcatctagtgttaatgctgagggttctacacctatggaccccttgtataagatattagatgagttgagatcccttaagttgtag

SEQ ID NO: 55326 - DNA, 264 bp, Glycine max
  Peptide Sequence Number=SeqID_147011
atgtccaaatgccctaggtgtggggtatcacggtacaaagtcaaggatgatgaggagtgtagtagtgatgaaaactcaaagaagggccccctagcgaagatgttgtggtatcttccgatcgttccaaggccaaatactgggtggagtgaaaaagctttagttcactacttcagtagtacatcgattgcttcacaggaaaacacgttgcctaaaagttactatcaggcgaagaagatactttgtccgatgagtatggagtattag

SEQ ID NO: 55327 - DNA, 307 bp, Glycine max
  Peptide Sequence Number=SeqID_147012
ctgcatccgcgtcgagagcgagtcgtcgtgttccggtcgcgggacggattgggaacgggcccttcgcggcctcttcctcgggcgtggaacagtcacatcagaattgtgctatgaatgtcaaagtgaagaaattcaaccaagcgcgggtaaacggcgggagtaacgaaaccccagccaagggaacgggcttggcggaatcagcggggaaagaagaccctgttgagcttgactttagtccgactctggcccctctttttggacccaaggtcgggttcggccggtcgatccgggcggaagacattgtcag

SEQ ID NO: 55328 - DNA, 512 bp, Glycine max
  Peptide Sequence Number=SeqID_147013
gagaggagcttgccacccagctcgcccaggcgagcaaggttgcttcctccagaagcaacagccttctggaggaaggatctggaaggcccaaacgcacccgtgagtctcgcgtcgccctcccactgaagggtagtgttgctcgcgctaagcgccgcccccatgggctaaacgctattcgttgcggcatgcataaggctaagctagcactgctcactaagccattatggcatccaggaaaaggaagagcattgcttctaagccacaggctcagtatgataccaggagattccaatccttggaatatagataacattatggaccggaggatccttccagaaaggaatgttaagatttatcatactgaattcgatgagtttaaggaagagttggagaggcgtaacctacacaaatgcctcaccaaccttcaggagggaagcatagatgtggcaatggttaaagaattctatgacaagctgtacaactcagaagaccaagttcccaagtgtgccaga

SEQ ID NO: 55329 - DNA, 456 bp, Glycine max
  Peptide Sequence Number=SeqID_147014
atgagaggggcaccactagaggaagagctcgcacctttcatttcacgagggttcagtgagaccaacatggagacactttggaaggtctgcaaagcatgggaagtggtacaaaagaaggacaaagagctcagaggcagcaacaatgggcccattggtggctactgtaagtggttgaaagcccacgtgcaaggtttggatgggctcccaagtctgaggaccgctaaaagggaagaagttgaggcatcggaggaagacgaagaggtgcaggcccttaggacaggacttgagcaagctcaaacagtcaaagaaaggttcaaatcagtggatcttaagatccaaaaggagaatgccaaactgagggatgtaaatatagctaccaccaaggccttggaacaagagaccaagaaggcttgtagggaagagcacggccggaacaagttccgaggggctctgtag

SEQ ID NO: 55330 - DNA, 812 bp, Glycine max
  Peptide Sequence Number=SeqID_147015
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagagggtatgcctgctgctgggagaccatgccaagccgccctgttttcagttctcatgtctaggttgacagagccacctgggagcttgaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55331 - DNA, 141 bp, Glycine max
  Peptide Sequence Number=SeqID_147016
acttatcaaggtaatccttgtggcgtctacccagacttatcttcctttactggaagtggcgtctacccagacttatcttccttcactggaagtggcgtcatccaaaccttcgtagcctatatcaaacgatccgccccgtaa

SEQ ID NO: 55332 - DNA, 273 bp, Glycine max
  Peptide Sequence Number=SeqID_147017
atggacccttgggtactagtaccctcatctccagaggactatacgtcctcaccttcaaagggctacacgtcctcaccttctgaggactacatgtcctcatcttcagaggactacatgtcctcacctttagaaggctacacgccctcggctccgaggactatacgtcctcatcttcagaggactacatgtcctcaccttcagagggctacgcgccctcgccttcatagggctgcacgccctcaccttccgaggactacatgtcctcatctttag

SEQ ID NO: 55333 - DNA, 531 bp, Glycine max
  Peptide Sequence Number=SeqID_147018
atgttatgggtcggtggtgattgttgtagtggttggtgcggttgcacgtcatcggagatggacgaagatcaatggatgtatggcagtataatgtctgacgaagttcatatgaatgatgaaaataaacatgaagctggcatgaatgaagaacaacatgttgattgttctgatgcattcaatacttctctggtgtttactacccgagatgatgttttgcagtgggctcggtcagtcgcttatgaaattggatttgtggcggtgattatgaagtcagacacgaacactggagtggttagtataggtctaggaagaaagattttgttagaagagatattggccgtaagaaatgtgggtgtcccttcaagtttcatcggaaaccagtggttgaagggcaaggtgaaaaagaggctaagttttgaattgcaaaaagtagcagttgggctaagcgcatatccaccgctaagcatagcttcagcgcgcttagcgcaaaggagaatctggcagagcatcaacatcaaagtcgtgcactaa

SEQ ID NO: 55334 - DNA, 255 bp, Glycine max
  Peptide Sequence Number=SeqID_147019
atgcttatcctcttgttgagaggcctgtggctaagcgaggttgaatcgctaagcccagctgtttggttcctttatttgcagatggcatcaagaaagagggctagaactgacaatatcccttcatcatccatcccagctcctcagtcaacagccatagaaccagatgtccaacacctgcaaatcttagtccctatgctacagagcctatttagaggacaacatattatcatgcacagcctgcaagagttggcttag

SEQ ID NO: 55335 - DNA, 285 bp, Glycine max
  Peptide Sequence Number=SeqID_147020
atggcagaggtctccacggaagccattgcctccctcgcccaatattatgaccagcctttttggtgcttcacctttggggacttccagttaacacccacggtggaagagtttgaagagatcctgggatgccctctgggaggaaggaaaccatatcttttctcaagcttctatccctccttggctagaatttccaaaatagtcaaaatctcgacacaggaattggaccggggaaagcaagtcgaaaatggagtggttggagtaccaagaaaatgtttggaagcaaag

SEQ ID NO: 55336 - DNA, 272 bp, Glycine max
  Peptide Sequence Number=SeqID_147021
cacaaagcacttacatccaaacacatgaagatgatgtagaagcaaagcttcatgatgaatcaagattgattcaaagatgttttgatgataacaaaggtgatgacaaaaagctcaaaggtcaatcaaagaatgagttcaagatgttcaagatagaatcaagaacacttcaagattcaagaggaaagttgatttcaagaatcacttcaagattcaagaggaaagttgatttcaagaaccaagactcaagattcaagaatcaagagaagacttaa

SEQ ID NO: 55337 - DNA, 473 bp, Glycine max
  Peptide Sequence Number=SeqID_147022
atgggagcatagatgtggcagtagtgaaggagttttatgcaaatctctatgaccttgaagacacatcacccaagcaagtgagggttagggggcatctgattaaatttgatgttgatgccctcaacaccttcttctatatatcgacggtgattgaggaaggggagagcctcctagcttattccaggtttgccagattgaggctagatctagaagagctggtagtccgtgtatgtatccctggaaggggatttgagttgaatgcagacgggctgcctctaaagattctgaggaagaatctgactactctggcccagacctggagtgtactttctttctctaacttggcccctacctcccacacttcagacattactttggatagggccaggttgatttatgggatcattcagaagatggacatgaacctcgggtacctcatctcgagtcatattgtggaagcaaagctaccatga

SEQ ID NO: 55338 - DNA, 174 bp, Glycine max
  Peptide Sequence Number=SeqID_147023
ctaaccataggtctattggaggagtacacatcacttttagtgaacaataaggatgtcaggttgaagctcaatcatttggagaagaaaaaccgtgataacattcttgagttcatacttcagaaagacccacatgcttgtctagaggaaactacagctttgtgcaactacctttaa

SEQ ID NO: 55339 - DNA, 258 bp, Glycine max
  Peptide Sequence Number=SeqID_147024
atgtatgaatatcctaggagaacccgcgtattaatgcgtaagcattcctttcaaaattcgtgtgcatattcgtgttttgttggaaaaagggaaatggctccgaagaaactctccacgaagaggtctagaagagacgccacaggagaaggatccagtgccgccctaaagtttgatagtcatcttttctggagtgtcgagcaccagcagcgctttgaggccatcaggggatggtcattccacagggagaggcgtgtctag

SEQ ID NO: 55340 - DNA, 231 bp, Glycine max
  Peptide Sequence Number=SeqID_147025
atgtgcgacttgccaatgtcaaagttgtttcttctttgttttcgaatccagactaaggttcgatcgaggttatcttcttccttgtctaggataatttccctagcccctttagtgagggcttgggtctttcatttggcccttgtggaccagccaatgcgtataagcttgggctttcttaacgtggctcatttgacgactcagtacatggatgtcacgagtctattggcatag

SEQ ID NO: 55341 - DNA, 502 bp, Glycine max
  Peptide Sequence Number=SeqID_147026
tctcgattggctcccgaatttagagaccactaagggggtggaggttgaagcccaggaagaagacgaagagatacaggccctcaagacagaactcgagaagctcaatagtcaaagaaagttcaagtcagcagctgttaggatccgaaaggagaatgccgaactgagagatgtcaatatagccaccactaaggccttagaacaagagaccaagagggcctgtagggaagaacatggccggaacaaattccgaggggctctgtggggtagtaacagcgagtttaagctccgaagagaggaaagggacaaatcgcgagtagacagtttgatcttgaaggatgaattgagggctagaggaagggtgattgactctttacatcaagaagcaacaatgtggatggaccgatttgctcttactttgaacgggagtcaagaacttccccgattgttggccaagggcaaagcaatggcggacgcctactcctcagctattgtcagcatatga

SEQ ID NO: 55342 - DNA, 447 bp, Glycine max
  Peptide Sequence Number=SeqID_147027
atggcccagttgatctcagatgtcatatatcaatttgtagggatcacgcctcctaaacacccagtggacccagagaagtccaacagagcactggggtttctggccttgatcacaagcctctgcccgttttatagggtgtcggttactcccaccaagcttatccgacctcccattaacagggccttcatagaaaaatattgcatgccaaggcaggcacggggtcaggtgcagctgaatgagagcttctaccggtacaccctgcatcaacagagccaggaccctagtctgttcccgtggactatccctgaggagttcggggccacaattgcatggcctggagataggcctgattttcaggaaggggcaggactcgcagggacccccgaagatgaggatggagctcagaaggatgatgatatggctgatgtgatggactacttcctttga

SEQ ID NO: 55343 - DNA, 552 bp, Glycine max
  Peptide Sequence Number=SeqID_147028
atggagataagtatgatagatgctgccagtggtggagcccttggagacataacccctgctgaagccaaaaatttaattgagaagatggcttccaactcccagcaatttagtgcccgaaatgatgttattgtcattagaggagtgcatgaagtagccacgaattcatcttcatcagatgagactaagaagcttgaaggtaaactagatgccttggttaacctgcaacaacaacaacagcaacaaccccagaaacaaaaaacagttgaggctcctccgcaaccttcccttgaagaacttgtgaggcaaatgactatgcaaaacatgcattttcaacaagagaccagagcctccattcagagcttaactaatcagatgggacaattggctacacagttaaatcaacaacagtcccagaattatgaccgattaccttttcaatctgtccaaaattccaaaaatgtgagtgccattacattaaggtcaggaaagcagtgtcaaggacctcaaccagtagcatcttcttcatccgcaaatgaacctgcccaaccttag

SEQ ID NO: 55344 - DNA, 357 bp, Glycine max
  Peptide Sequence Number=SeqID_147029
atgccttcaccttgggtactagttaccctcaccttcagaggactacacgtcctcgccttgagaggactacacgtcctcaccatcagagggctgcacgccctcacctccagaggactacacgtcctcgccttgagagggctacccgccctcgccttgggactacacgccctcacctttagaggactacacgtcctcgccaacagagggctgcacgccctcaccttcagagggttacacgccctcgccatcagaggactgcatgtcctcaccttcgtagggctacacaccctcacctttagaggactacacgtcctcgccaacaaagggctgcacgccctcaccttgaaaggactacac

SEQ ID NO: 55345 - DNA, 187 bp, Glycine max
  Peptide Sequence Number=SeqID_147030
ggatttcccgtctgctgtatctctcgttacagtctttcaaagaaatgaacgtggattcgaggctttagtcctcacgggcaggatcatcttgagctaccttctggggtggggaccaaacatggacagcagaaaccaatcaaggtacttaggaatggatgcaagtagggatggggtcacgatcgactga

SEQ ID NO: 55346 - DNA, 435 bp, Glycine max
  Peptide Sequence Number=SeqID_147031
atggtgaaagttggaacctcttacgtgcccgatcaactctcattttcgctcgaaaatcccagggcgtgtcccggtatcgaacatggccgacggccggcctgctgttttcatctggaagtgtttctcgatcacaggtcgcatcaagcttattcggcgcaataccgtgcgcctcgagggggtgatgctgccgaccagcttactgattccctagtgtatgatgctgttcctcctgttcagctactgacggggattggttatccgctcacaattcggcacacaagcatacacgccggaagcatcagcgctggcaagtgtaagcctggggtgcctaatgacgctgacgctaactcaccacccgccgcgcttaattgcgttgccgctacagggctgccccattcgccattcaggctgcgcaactgttcgggaagggcctga

SEQ ID NO: 55347 - DNA, 212 bp, Glycine max
  Peptide Sequence Number=SeqID_147032
caaagagtagaatcgtctcaggccacggtcagaagtcaagacaaatcaatggcagaaatcaaccaaggtacataggaacggatgcaagtggggatggggtcatgaccgaccaatcgttgccctttcccggtgctaaacgagcagagaacgtcgctgcaaagcagcccagtatcctttgtggttgcagtttcttttactattgtttgttttaa

SEQ ID NO: 55348 - DNA, 180 bp, Glycine max
  Peptide Sequence Number=SeqID_147033
atggttctacagggcaaaacaattggtgttaatgtagaagatgatgattcatacatggacacctatgatcatagcttctccacctggctcgcctcttcctcctcctccagacccatcagcttcgccgtctgtcgtgaagcggacacgcaaaggcacacgtctatgatccttgtctactag

SEQ ID NO: 55349 - DNA, 534 bp, Glycine max
  Peptide Sequence Number=SeqID_147034
atgcaaaggagatctgctacaggtgatttaattcccacagatttggagattaatgctacttgcaggagacgaaacgcagagagaattagaaaatttttgcaggacttagaagcagaagcaactccaggagaagaacctcgatcttccgaggcatcttctaggtgtcctattctagggcaatctcatatagatttaattgaagaggttatcatggcagaagagccaaggagagtgaccctagaagatttctcaagtttaagtgtgccacaatttttcaccagcattacacaatcggaggttcaagctcagaccattacataccctccatcattagtccaattgatccaaaataatttgtttcacgggttatcggaagataaaggagaagaggtgagaggaagcaccatccacaagggaataagccatggaagaaggagcttcgccaccaagaatgtgccttggataagaagcttggagaggatgcttcaatggaggaaaagaaagagagataaaaagagagaggggggagcatga

SEQ ID NO: 55350 - DNA, 163 bp, Glycine max
  Peptide Sequence Number=SeqID_147035
atggaggattgccttgggggtccgcacatcaagcttatcgataccgtcgacctcaagggggggcccgctgcattaatgaatcggccaacacgcggggagaggcagtttgcgtattgggcgctagcggagtgtatactggcttactatgttggcactgatgagg

SEQ ID NO: 55351 - DNA, 236 bp, Glycine max
  Peptide Sequence Number=SeqID_147036
ggtgaatgtgttaataatgtggtatgggctttagaacagtttcgaggtatatttctaagacatgatgccctccctggagttattgtgactgacagaaacctaacattgatgaatgcaatgaaaattgtattccctgagtgtacaaacttgttgtgcagtctggttgattgtccttcggaacagcagttcgatgaatgccttaagaagtttgaaattgcttgttcaccttggccaat

SEQ ID NO: 55352 - DNA, 573 bp, Glycine max
  Peptide Sequence Number=SeqID_147037
atgaatttcgactgtctggccgctggcgagcggttgagacagcggataaggctgtctgtctacgcgtgcgcctacgcaggcgtggccgatatgcggtatgcacggcatacgcgaagtcgacgcggagtactgcgccatcgccaggtcagtttcgacaatacgcccttcaggcgtgaaaacgctaaatctttctatccgggaagagcggattttacgctctcgatcaaattcaaacgagctacccgcactctgctgcagctcgagcagagctctgcattaccaagcgctgttcgcggatttgtgccggtagtggcatgcttcatcacatcacgtgctagctttgtaggggccatcaggtgtgcgtgtcgagtttcaccctctccggccgaatcatggtccatccgtcttcgggtgcgtgatactgggttcaccgttcaacaggtgacgccgtgcggagccgatcatcgatatgcaaacgatgatacgccgttcgcttttggaaggcgatgtaatcttctgctctcctggcagcggcttgtagagcagctgtgcatctgcccagtaacgcgatag

SEQ ID NO: 55353 - DNA, 920 bp, Glycine max
  Peptide Sequence Number=SeqID_147038
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataacaccatattacagtgctaaatcaagcagttttactcaaaggcgctcaacattttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55354 - DNA, 863 bp, Glycine max
  Peptide Sequence Number=SeqID_147039
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatttccatgcactggttttactatgccctgaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55355 - DNA, 1122 bp, Glycine max
  Peptide Sequence Number=SeqID_147040
atggggtggagatacaaggcagggttgttccttatacttactgtggttgtcatatgggtcacctctgctgaagtcacccagccatttgcagtgacgtatcttggagcttctcttatggtagtttacctcccagtagcattcattaaggactggttgtgtaagttatttgaacaccgctcttctagaagtggaaaaagtgcaaaagttggggatgagttttctgtcaggtgtacctctcctctgaagggcaatggagtgcaaaaaaacattgaagtagaattggggggcatgactcgaaaagatagtgatgcaaacctttcagcacatgaagaagtaaagccattgatggctaaatataatgatgctactgctataaaggtcgagaaagaacatactacaagggaaattgctacttatggattttacattgcacctatctggtttataacagagtatctatcaaatgctgcccttgcgcgaacaagtgttgcaagtacaacagtattatcatctacttcaggactcttcactctcttcattggtgtgcttatgggccaagacactttaaatgtatcaaaagtagttgctgtcttggtcagcatagccggggttgtgatgacaactctggggaaaacatgggctgcagatgacgcgatatcaagtgcttccaatggacaacgctctcttgttggagatctttttggccttctctctgccatgtcatatggtctatttacagtgcttctcaaaaaaatttctggtgaagaaggagaacgagttgatgtgcaaaagttgtttggatatgttggattgtttacacttgtagcactatggtggcttatttggccattgtcagccttaggaattgaaccgaagtttacaattccccattcagccagagtggacgaagtggttcttgccaacggatttgttggtagtgttctctcagactacttctgggcactttgtgttgtatggacaactccccttgtggccactttgggcatgtcacttaccattcctcttgctatgatggctgacatggtgatccatggtcggcattattcggcattgtacattcttggctcaatccagctctcctacagtgttgttggccagtga

SEQ ID NO: 55356 - DNA, 474 bp, Glycine max
  Peptide Sequence Number=SeqID_147041
atggaggacaaaaggaccgtaatcacaaataaccaagcaaggaagaaaatccacccattaattagaagcttaagcattggcggcgaaggtgggattgtgtggcttgttgtgttcggtggagccttggccattgcgggtttcatggaagatgtgaggataaaggcacaagcctcccagaagcaaaacactgccccccacatattgtctcgtgggggttatgaatatttagaagaaaagctcatgactgagaagacaaagaaaagactggaagaagctgcccagtctggaagcactaagggcatcattgaccctccatctcccatcaaacgccacgtgaaatggaagatggcccgcacgaagaaaactggacagatgacgtctgaggcagcaaaggaaatagctgataggattgagtctttggacgagcaggcgtcacagggatcgttcgtccccatggacgtcaggatatcctga

SEQ ID NO: 55357 - DNA, 285 bp, Glycine max
  Peptide Sequence Number=SeqID_147042
atgttcctcatattcaacactagtgctttgaaaggacttgatgatactccacaaccgaaatccaagactgctgcttggtggattgttgttaagtgtaatagacaaaaaggaatcactgaatgtggctactacgtgatgcactggatgtccacgataatcttaggatctttcaggaataattgggagacgtattttaatgaagttagaccattggaagtagagagattcaaggcacttcgcatacagtgggcacaatattatctaaaagttaaacatcaaacatag

SEQ ID NO: 55358 - DNA, 417 bp, Glycine max
  Peptide Sequence Number=SeqID_147043
atgagacttcaagataggatctgtgttcccaatgtgctcgagcttaggaagatggtcttaaaggaaggacataagagcaacctaagcatccaccctggtgctaccaagatagcattgggaaccaagcttaggctgagtttagcctaccatcctcagactgatggccagattgaacataccattcagtcgctagaggaacttttgaggcacccagtctcgatcatcgtgtacttggtggcatggttcttcctctacttcttccacgacgagtctatggtggtgttcggcaccagggtggatgatggagtggtggtggtgattcttgtggcagcgacactcatgggattggtgctcattggcgtgtgggtgaacgtggtgggttcggggatcgttggcgttgagtatactaatatttag

SEQ ID NO: 55359 - DNA, 480 bp, Glycine max
  Peptide Sequence Number=SeqID_147044
atgcatgtatactcatgccgtgtcatcactcatgcatcgcatttgtctcgtcatctttgtcacgggaagccggaaggtccgcatcgccttcttaattgcatgcatcgggcaccatgctatcgcatccctcgctcagtttatgaccagtcgctcagatgcttcacgtttggggacttccgattagtaccaaccatagaagagtttgaagggatcttgggatgcccgctaggagaaaggaagccatatcttttttccaaattctacccttccatggcaagagtagcaaaagtggtcaagatctcgacacaagagttagaccgagtgaagcaaaacaggaatggggtgatagggataccaaggaagtgcttggaggaaagggtcgaagctttggcagatcagggagagtggacttcattcattgatatattagcactgttggtgtttgggaccatactcatgcatatgacacattccacctga

SEQ ID NO: 55360 - DNA, 777 bp, Glycine max
  Peptide Sequence Number=SeqID_147045
atgcaagccttccacaaggcgtatggaaagattttagatttgaccatagcagagatatccacagaagccgttgtatcactcacccaatactatgaccagcctttgagatgcttcacgtttggagacttccaattagtaccgactatcgaagaatttgaggagattctaggatgtcctcttgggggaaggaaaccgtatcttttctccgggtttcttccttccttgagcaagattgcagttgtggtcagggattcaacgagagaattggatcgtgtaaagcaaactcgaaacggcgtagtggacctaccatggaagtacttagaaggcaaggcaagggatatggcgaatcaagaggaatgggtcccgtttatggacgtattagcattgctaatctttggggttgtcctctttccaaacatggatggtttggtggacctagccgcaattgatgctttccttgcatatcaccatagcaaagagagcccggtggaagctatcttggcggacttatttgacacatttgaccaaaggaggcagaacaatcaactggtttcctcaatggaaggaaaggaaggagtccttttctcatgtggggagtacccaaacattccgttgatagggacgagggattgtattaactacaatcccgcacttgctataagacagttagggtaccctatgaggggagcaccaacggaagaaagcctctctcctttccttgtgagagatttcggtgcgcaaagtttcaagattatacaaagagtccataaggcgtag

SEQ ID NO: 55361 - DNA, 720 bp, Glycine max
  Peptide Sequence Number=SeqID_147046
atggatgaagaccagtggatgcatgatagtatgatgtctgaagaagttgatatgaatgttgaaaatgaggaagatgttggcgttaaagtagaacacgttgattgttctgatgcctttaatacttctcagttgtttgctagcagtgatgaagttatacaatgggctcgatcgttggctcatgacattatatttgttgtcgttataatgaggtcagacaccaatatcggtgttcgaggaagagcctcatttctgttgatagcttatgaaaggagtgggaagtataggcctaagaaacataatttgttaatttgtggggttcacaatcacgaaatggcaaagtcattcgttgggcatccatatgcgggtcgactaacaaaggatgagaagattgttgttgatgatatgacaaagtccatgcggtttcaaggtcttttcatgagagttgatgcactccccggggttattgtcaccgatagggatttatctttgatgaatgcagtgaaaaatgtattctcggatgctaagaacttgttgtgtcagttccacattgacaaaaatgtgaaggcaaagtgcaaaacccaggttgctcaaaagaatgcatgggattatatgatagagctcgagggagtttggttgactgtccatgccaagccaggtcaggctttgaaaggcctgagcctagcctacgatgaatctttgaggcctgagtctggcctataa

SEQ ID NO: 55362 - DNA, 537 bp, Glycine max
  Peptide Sequence Number=SeqID_147047
atggccgcttcttcctcttcctctcaccatttacttcttcctcttcctgtcaccgttggtgttggtgcttgttcctcttccgttcatccttcatcttcctctgtgctagtggttgttgttgttggtggttgttggtccttagtcttcttcagttcttcaattcttcttctcgtttgttgggtaatcttctttgagtgttggatctacgagcatttttcgtctgttggttccgctgttcctgttgaggattatgatgagaggagaccgcgtgcatgtcgatggacttctagcaaggcactgcccatttccacgtatcgcaggcgtctggatagactgacccctgacgtggtgttctggatttcgtacggtgaccattgttcatttagagaatttgagtttggtgagtacattgcacctataaggcaattatgtgtcgtgcctagccactattcgccagattacatagattggttttacatgatctcgcacccattcatgagtttggcacagccaggggatcctctagagttccgctag

SEQ ID NO: 55363 - DNA, 465 bp, Glycine max
  Peptide Sequence Number=SeqID_147048
atggttagattattaccacctcgagatagtctaacattatctacctcatccttgtcttctgtgtctatcccagttaggcctcccgatgttgcacctacaccatctccacctccgactaaagctagaccatcttcatctcatgttaatggacgtggaccatctcaggtacatgcatccaccccatctctatcctacgttgatgcacgtggaccgtccccagtacctacatccacacctttcccatccccgcctgtgggcagtatgcctacaaatgaagatactataaatttggcaatggaagacccttcccttaatgatcgtcctatggttacgctaattaatcgagcgtttcatccatctaatgttgcggcaaaggctgtcactttgtccattaggcaacaatttggtcagccttggcctacatggggaacgattccaaaagatcaaaatgacttctttttttag

SEQ ID NO: 55364 - DNA, 303 bp, Glycine max
  Peptide Sequence Number=SeqID_147049
atgaattacaagaagaatttgaggctagactatctcaagctaggaccaaagcataagggacgcctttatggtactggagaccttgctcatacttacaaatgcggaaatgacagcttcatgcaacatacacaaggatcttctagccacgctgaagatgctgcagagattaactaccagagggaggagttgcgtcaatcaaaagaggagatgcgcatttttcagtcagtagtccttcagttcctacctccagaggcatggaacattattcatcaacaacaacaacctcaccagcagcagcactag

SEQ ID NO: 55365 - DNA, 189 bp, Glycine max
  Peptide Sequence Number=SeqID_147050
atggagaagtctgaaaagaaaaatcttagtgaaaagaaattgaagaaagcatacatcacatgggatgaaaacgatatggaatcttctgaagattcagaaaatgaagagataaatctctgccttatggctaaaagttatgaaagtgatgaagaggcaaacaaagatgtgtttttgataaggctggattag

SEQ ID NO: 55366 - DNA, 417 bp, Glycine max
  Peptide Sequence Number=SeqID_147051
atgaagaagatcctaggcctacaagctccaatggagcttacatcatgtggtatcagagcatcttcatctagtgaattgtctttaattccttgttcttcatattattctccatgtatatcctccattctccatgtatattccttgttcttcacctttgcttttgtaaactacactgtaatttacaaaacaaaagttgaaaggaaagatattgagctggtagacgaggaagaagcacagattggtgctgatcgttctagtgcaacctctaataaatctgagatttataaggaggaagcacgaaatgcagcacaaaagcataaaccaaagagggtggagagtgtcaatgctgatgcagaagcctttggtgatcactggaaaattcagattgctttatgcattctgaagctgaagcactag

SEQ ID NO: 55367 - DNA, 236 bp, Glycine max
  Peptide Sequence Number=SeqID_147052
catcaaaaacaccttgtcctcaaggtgttggggcttcaaaccatgagctaaaaattcgaaggagacagaaggtatcaccttctgataaggaaccatatgcagtagcagaagacagagtcaaggagacagaaccagaggtgcaagcaggaggtctcttctctcttatacctctagaggcactggttcctcaaaaaccagatatccttggcacgcagcacctaacacttacctactaa

SEQ ID NO: 55368 - DNA, 231 bp, Glycine max
  Peptide Sequence Number=SeqID_147053
atgttcggtgttgcctctacgatgttcagcgatgaacaaccctggctccagagaggggtgattgaagaaagatcacgtgaagagagaaaaggttttggagaaaaattgagaaaagaaaacaaggcaatggggagaaaggatctcaaacatttgaagaaaggaaagagagaatggcttggggggagggggggaggttctagagatattaccgttgcctgtggaccattgtga

SEQ ID NO: 55369 - DNA, 2754 bp, Glycine max
  Peptide Sequence Number=SeqID_147054
atggtgatggagtattggagaccatggttttgggggcacaccgacaagtactacgttgttaagttgagtcaattgaggttagaatttggagcaacgttgggtgctgcaaatgacaagataattgcaattcagattacaggaacagctacgaagaaagggaaagtttcttcttctttttcttcttcaactcgtacccagaaactaggatccattcacaccaccttcccccaaagattcatcaattctaaggcaccaacaatcgtgtgggacgcacgtgacttctgcgggtttcatctcttgctcaaacataggtccctaagtggcacgtgccatatggcacttcatgtcttacatggggagggtgatgtaggagaatataaacctgaaatggtgatgggtggagaagtttccatgagcgttactatggcagagttgatggagggggaggagatgaagaatgagtcaaattgttgtcaggttcaaagaacacttccaatccaattgaaggtgcatggggtgttcatggaagctacacttttggtttcattgagcttattgaaactgagaaattttcatgatgacttgcctagagcatttgtagacaaagtgacatgccttggggagaaaaataatgggaaagttgatgatcaagttgagcaatggagttcttatgaatcggatgagttatctgtgtgtgattcagatgactcatctgatgagtccaccactacaaccacaagcagtagcagcagcagtagcactagcactgcaattcactgtaatgggtcaagtgttacaagatcagagaggtttgtggactcagatacagagacctttttggacacaatgcagaggagttggtccatgttgccatggaatagaagcttcgagggatggactttcaaaagaacctcctcaagtaaacgagagcctttgacctcacattcaactcattccatgggaccatactttgatcacaataaatgcactgcaagtggctgggaaaatagggaactttggagtagagatgggaaaacaaagctcaaaaccaatgtgttctttgcttcctttgatcaaagaagcaaaaaagcatgtggtgagagtgcatgtacagcactagcagtgtgcatagctcactggcttcattccaaccacaacatgccaacaagggctcaatttgatagcctcatcaaaaagggttcctctaaatggagaaagctgagtcatagtgatcactacctaaagcttttccctgataagcattttgatttagagacaatcttggaagccaacattaggccactagttgttatccctcaaaattcctacacaggatttttctcccctgagaagtttaaatgcttagaaggagccatgtcctttgatgatatttgggatgagataactagaaatgatggtgtggttgatcatgagccaagaatttacatagtgagttggaatgaccatttctttgttctgaaagtggaagttgatgcttgttatgtgattgacactttgggggagaggctttttgagggatgcaaaaaggctttcatgttgaagtttgatggttcaagtttgatgcatgcaaagggaagtaagaaaggaagaggtgagatagtttgcaaaggaaaagagtgttgtaaagagttcatcaaacgctttcttgctgccataccacttaggcaactagaagaggaagagcaaaataaagggactgtctataatccttattttcacaggaaattgcagattgacttccattatagtttgttatcatccttgtcttcagtttcttcaattgtacctttatcatcaccatcaccgtctatgtggcaagaaaaccgccatgacgccctattcaaagcagccatgcgcgtgaatgcaaagcccacaaggccaaagaaggtagcttttatgtttctaaccaacaaacccctcccatttgcgccactatgggaatcttacttcaaccaaaccacaacatcaaagaatctcttcaacatttacgtccacgcggacccaacatttccctaccacgcgcccttctccggcgtgttcttcaaccgcgttattcgctcacaacccaccaggagattctcccccactctcaccgcggcagcgcgtcgcctacttgcacacgcgctcctcgacgacacttccaattccctgttcgtgctactctctccctcttgcattcctctccactcgctcaacttcacctaccacgcgcttctccgcaggggcaagagcttcgtcgagattcttgccaatgaagcagtggcttacgaccgttgggcggcgcgtggacctcacgtgatgctcccagaagtgaggctcgaggaattccgtgtggggtcgcagttttgggcgctgacacgtcggcacgcgcggcttgtcgtgagtgatcgcgtgctgtggccgaagttcaacgtgccgtgcgtgcggtttgacacgtgctacccagaagagaattactttcctacccttctgagcatgtgggacccgcagggatgcgtgccggccacgctcacgcatgtgaattggacggggcgtgtggacgggcatcctcgcacgtacgaagcgtgggaagtggggcccgagctgattcggaggatgagggaggataggcctaggtacggtgacggtaacggcgacggacggagggatccgtttttgttcgcgaggaagttcgccgcggacgcgttggaaccgttgatgagaatttcgaacggcgtcatcttcagggactaa

SEQ ID NO: 55370 - DNA, 309 bp, Glycine max
  Peptide Sequence Number=SeqID_147055
atgaaggcccaagtggagaaggatgaaggcccagagccagagacactatcaagactattaattgttgctgaaggcccaagtaatccttgtggcgtctacccagacttatcttccttcattggaagtggcgtctacccagacttatcttccttaaccaaaagtggcgtctacccagacttatcttccttcactggaagtggcgtctaccctgacttatcttccttcaccggaagtggcgtcatccaaatatccgtagcctgtatcaagcgatccgttcctagtcaggttcacatcatatttcttttgtga

SEQ ID NO: 55371 - DNA, 150 bp, Glycine max
  Peptide Sequence Number=SeqID_147056
atggtggttgaaaaaggaagagaggagggtggggatagagatgatggccaatcaaggggtgaaggggtagagagggaaatccagctagagggagagaagcctcccatcatggaggtagaaagccctctcatggaaggggagacctcctag

SEQ ID NO: 55372 - DNA, 537 bp, Glycine max
  Peptide Sequence Number=SeqID_147057
atggtggtgctggtcccaaataggcaaaggaggtggtatagcttcgtgaaggacctgatcaacctgattgatgacatcatcgaaaacctcgtcgccactgaacaaaggaggcggaataagaggtggcatagcatcatcatcatccgcgacacattggtgaggttgcttagaatcgttgttgaaagagagcatgagggaatcaaacctaattctgtcggcagcgcgtggggctcattggattccgttgccgctgtggcgacctcttatgtgctcttctgcgtcgagcaccgctactctgactgccgcgattgctcctacgactacaaggctgctaggagagaggccatagcgagagaaaaccctgtcgtgaaggccgcaaagatcgtcaaggtaaaggtgtttgtaggtataagacatttttcttgtagtgagaagttgtggggagggggggctgaagccccactactagaaaaaacaggcttctacgacgatcctttgaagccttccatgatggtcttcaaccgtcttcgaaagtga

SEQ ID NO: 55373 - DNA, 117 bp, Glycine max
  Peptide Sequence Number=SeqID_147058
atggcggcacaagacgttgttcgacagcccgattttggaagaaaggtatatgacagagaaagcctctttttccagcagtgcccccttctatcccctccttccatccgtccctcttaa

SEQ ID NO: 55374 - DNA, 1776 bp, Glycine max
  Peptide Sequence Number=SeqID_147059
atgtttgggttctcaggagttgacgatttttgcccgatgggatcaatatatgccaaccccaaggaagcaagtttcttcttgcctcttggccctcaagttgatgtatactttcctcctcggaagagatcgcgtgtcaacactccattcgttttcgatggagaatggtttgagcaaaagccgaaaacctctgttgaagccttgccagatgagtgtctctttgagatctttaggaggttgccttctggggaagacaggagtgcatgtgcctgtgtttccaagcgatggcttatgcttctaagcagtatttgcaaaaatgaaatctgccccaccaacaaagccactggatatctctctcgaagcttggaaggaaagaaggcaacagatgttagactagctgccatagctgttgggacttcgtctcggggaggattggggaagctctcaatccgtggaagcaacatggctctttctctatggaatgttgctaccgttggtgatgagggcctaattgagattgctaatggatgccaccagctagagaagcttgacctttgcaagtgccctgcaattactgataaggctttggttgcaattgcaaagaactgccagaatctgactgagttgtcatttgaatcttgccctaacattggtaatgaaggtctacgagctattgggaagttatgctccaatctgaagtccatatccatcaaggactgcactggtgttagtgatcacggaattgctggattgctttcttcaacttctttggttctatcaaaggtgaagctccaggcattgactgtttcagatctctctctagctgttattggtcattatggcaagtcagttactgatcttgtccttaattgcctcccaaatgtcagcgagagggggttctgggtcatgggtaatggtaatggattgcagaagctaaaatcacttacagttgcatcttgcaaaggagtaacagatattgggcttgaagctgtaggaaagggttgtccaaatctgaaaattgcacacctccacaagtgtgcatttctgtcagacaatgggttgatgtcattcgccaaggctgcttcatcacttgaaagcctacgattggaagagtgccacagaattacccaacttgggttttttggtgtcctttttaactgtggtgcaaaattgaaggctatctctttggtgagctgctatgggatcaaagatctgaacttggtgttgccaacagtatctccatgtgaatcacttcggtcgttgtctatcagtaactgttctggatttggcaacgcctccctgtctgtattgggaaagctgtgccctcagcttcagcatgttgaattgagtggacttgagggagtgacagatgcagggcttcttccactccttgagagttccgaggctggtttggttaaagtgaaccttagtggttgcacaaacattaccgacaaagtagtttcatccttggccaatctgcatggttggactcttgagaatctaaaccttgatggttgcaaaaatatcagtgatgctagcttgatggcaattgctgaaaactgtgcattgctatgtgatcttgatgtctccaagtgcacaatcactgatgctgggattgcagtcctggcacatgccgaacagattaatctgcaaatcctttctttgtcaggttgcactttggtctcagacaggagcttaaccgctctgagaaaattaggccacaccctttttgggactaaacatccaacactgcaatgcaatcaacaacagcacggttga

SEQ ID NO: 55375 - DNA, 807 bp, Glycine max
  Peptide Sequence Number=SeqID_147060
atggctacaccatccagttcccctcctcctcctcagtcaacaacacattcctcgtctacctcaaagaagacaagaaaagtgacatggctcagatcattggctactagaccaacagcaaggaaggccaggatgataaagtatgtgaaaagcaaggcatcaacaaggagaagtgaaaccaattttgttagagtcataaagaccgaggttcaaaagaaggcgcaggccattcaaaaacaaaacactgctcctcgcgtgttgtctcttgggggttatgaatatctcgaagaaaatttgatggaggacaagaaaaagaaacgattggaggaaacagccaaatccgggagcactaagacaattattgatcctccatctcccattggacgacacaattccttggaggaacaggtctcacaaggaagcttggttgcccatgaacgtcaagatgtattgattgttgtcattgggcaaccagaacactctggtcgtgtccatgctgctggagtcagtgtcatgatcaaacaatactttggaacgacttcaaggacctctgacacgtcttcgtccatggctcccgaagacatgtatcgcagatgcaatcacagggacttgcactgcctcctgggcctaagggacttagagaaatctggattgtatgtcaatgaaaatcctccccgtttggttacccttagaaaactttatgaggggtcgaccactgttcacaacatccctttgggcaacgatcaagtgaaggtcaatgttgaggaagttcgagatgttgatgctcatattcttgtacccactcaagag

SEQ ID NO: 55376 - DNA, 306 bp, Glycine max
  Peptide Sequence Number=SeqID_147061
atggatgaagcatctaaaggactaagaactcaaggtcaaacagtgagtaaagtggatggatcagaagatttctggagcagcagcacctttgagttagaccatagtgctgctcattcacagagaagcatctcgtcaatcggaatgccaaataatccttctgattctcagtgtagtggaggcagtcaaagtggtgctcctgaatttgtcaaccatggcaagtttgctgttatgtgttcattatctgttgattctctggtgtggaaacgatcttgcttaattgttgatagagctattcaggacttatag

SEQ ID NO: 55377 - DNA, 573 bp, Glycine max
  Peptide Sequence Number=SeqID_147062
atgctaggtgtaggaagaaaatccctcatgggcaaggtgtactgctttgtgccctttgtaggtgtcgtcgcaacttgttcaaagtacatcgagattgttttctcttctagtggcttcacttttacaagttgttggattgtcacagaagccatggatgagatccttggaagtatgcttgttattgaatgttgggtcaaggatggtagcgggaaaggctctgtaaaggttggcattggaagtcgaatgagaaccaggggtcttttggaggtggcaacggtgtctgatgaaactgggtccagcgaaggaggtgaaacaagtaatgcagcaacggcaaagactgatatagttgttgtggccactggaacaataggtaagggtcttgggaaggataatggaaatgttggtggttctggaaggggttggagaataaatatgcttgaggttagtggtagggatttgccatgggtgtttgcggttgttacaatggtggcattaagggctattgtcctagccattgttgaggaagaaaagggtttcagaagagtgacacatgaacgaggagcaccaggatag

SEQ ID NO: 55378 - DNA, 195 bp, Glycine max
  Peptide Sequence Number=SeqID_147063
atgtcggggtcgagggtgtcacaacaaccttcaaatttccccatgcatagtgttgcttgccagcggtcatacaatgctcaatggaatgccctgaaactcctctatgataagcacatgttgcgttcgggttgtatcctcgaaaaaatggaggttgaggaaccttggttggggttacggctaccattgcattattga

SEQ ID NO: 55379 - DNA, 702 bp, Glycine max
  Peptide Sequence Number=SeqID_147064
atgttgcggaacgcgaacacgaaaagcactttgaagagcaccgaagttcccttgtcgtgcgcaaaaaacaacgctcatcttgaaaggacggcccgtgtgcggaatggtaggctctcacacaacagtattggacagggatggaggattgagaaaatgggcttctcctggggcaaaaggggtcatttttcagatccaaagacgagatcttctacccatcatgatgaagctcggcctacatctcaactgtctgaactatggtcacctttggaaagccaaggatggaaaccttatgttgaatcaaataagccgactgcattattagagaagttggagggatatatccaagtctttcttgatggaggtttgaaccaacaaaagttggggatatgtgatgcagttgttgttgcaaagatactgaatgctactccggtgatcccataccttgaattgaatcctgtatggcgagattcaagctccttcatggatatatttgatgtggatcatttcattgatgtattgaagaatgatatttctatagttaaagagttgcccaaagagttgcttatgtttgactgcagctccttcatgtattatggcttggctattcgagaaaccaaaatcaaggctgcacctgtgcatgcatcagcctactggtatctggataatgttttgcatgtcctacaaatattggtatctacctag

SEQ ID NO: 55380 - DNA, 141 bp, Glycine max
  Peptide Sequence Number=SeqID_147065
atggctggtcctaggattgcccatgctaccttgaaaggtccgagtgtggttaaggacatcataattggaataacacttggcttagctgctggtgaccagcttcaagtcctgccgtcatcttcctcaattgcagtccaatga

SEQ ID NO: 55381 - DNA, 117 bp, Glycine max
  Peptide Sequence Number=SeqID_147066
atggtggcaattttctcttcttcgctcttcgtttcctcgcctattcctgaatccataaagctccacaacttttcagggctcgctcctcgctccttcaggataaagaggaaaaagtga

SEQ ID NO: 55382 - DNA, 630 bp, Glycine max
  Peptide Sequence Number=SeqID_147067
atggcacttcgacacttgtggtgccagctgggcatacattttttgtgcgccaaacaagattccgaggtccctgccaatctcaaaaacttgatattcagtaaatttaactgcttgaggatgcagattatgggcaacctacttgcacctacgaaagatgcatggaaaaaatgttcaggaccgtggctttatttccttgacgttcgcggaatgacagttcatggatcaggagtaatcaatggtcagggacgagattggtggggcaaaccatatggaactggagcatgcagccacatgcctacggctcttcttttccaaagatgtgatggccttcaaataagtggcctcactcacatcaacgggccaggatcacacatctttgtagtccatagccaagacataaccatctcaaatattgacatatactctccactggaaagtcacaacaccgatggaattgatcttacaaattcagttcgggttaacattagagactctatcataagaaccggcgacgactgcattgctatgaaaggtggctcaaaattcatcaacattaacaatgttacatgtggacccggtcacggcattaggtattcatcaaaatgcgaattatataagtatagtcaatag

SEQ ID NO: 55383 - DNA, 246 bp, Glycine max
  Peptide Sequence Number=SeqID_147068
atggtggcgacgaggtctttgtgggggttcaggttaataaaggaggtagcgacgagggtttgggtctgtggtggggtttgggtgggtgatggtagcaacgtggtggcggggtggggtcgtggtggcagtgatgtggttggtaggtttgggttcatggtgacaatgaggtcattgacaacaaagttgagagagaaactagagattttgagattttgtaaggctagagcaaaaaggagttcaaattaa

SEQ ID NO: 55384 - DNA, 729 bp, Glycine max
  Peptide Sequence Number=SeqID_147069
atgaggagcttaacgcaaatccttgcggcagtcgctaggcttagcgggctcttgccagctaagccgattatgcgcaatttccataaacgcctcaccaatttggttgatgggagcatagacttggctttggtgaaagagttctatgcaaacttatatagctctgaaggcccctcgccaaagcaagccagagtcaaaggccatttagtgaaaattgatgttgacagtctcaacacattcctggagacacctgtggtattggcagaggggcctcctgggaggattctcaggaaagatttgactactttagctcaggtgtggagtgttctctcatactccaacatggcccccacatcacatacctctgatctgatagtggacagagctaggctaatctttggcctagtctctcgcatggacatgaacataggagctcttatttctggccagatgacttctatagcccagtctaacacttctagacttgggtttcctgctctgatcaccgccctatgtagagccagaggggttgtctctaacagccttacttttgagcgcctgagcccggtcattaacttggcctacatcaggaagaactgttggaatcccgaggacctaacagtttctatcagaggggatatgagcacgagggcgaggccagctgagcttccttccacatctacagctcctactccagcacccacttcaacaactccttctatcccaccttag

SEQ ID NO: 55385 - DNA, 78 bp, Glycine max
  Peptide Sequence Number=SeqID_147070
atggtgccaaaaacttgttcgagttcggtgtgtaaactaactatgaaaaaggaaaatcacgtgagtaatgatgcgtaa

SEQ ID NO: 55386 - DNA, 276 bp, Glycine max
  Peptide Sequence Number=SeqID_147071
atgggccaagtgacaactcctgaaaatccagggggataccatagcaagtcaaacaagaaagatgcctactgtagcaacaacagggaagctacgaaggtgaagacgaaggttatgtcaacagtagcgacgagatggcggcaatttaagtccacattgactagcaaatttgtgtttgctaagagtgaaggtcaacaaacgcaggatgttgtgacaaaatatggactagatcctgaagcatggaaacaatttgaagaaacccggctcacacctaactag

SEQ ID NO: 55387 - DNA, 599 bp, Glycine max
  Peptide Sequence Number=SeqID_147072
ggcatagtgtgactgggatagatgaaggccatcagttgtctggagtatttcaatgccaaggaagtgatggagagggcccaagccataaagagccttttgaagcttgcaaacatggttggggaactaagggtcagccatgccaggaggttgctccatcgtgtaaccatgggatgagtaggtacaacatgtggaagttgagtctgggtagaagagatgcaataggaagttgtaaggcaggagattgcattaaaggatttgagcatggtggaacggaagcaaaagctgttgttattgctgttaggtctgcacaagaactggacatgattgtcatccaacagctgattattgttaatatcctccctcaaacaaggctgaggttgaaggcagagtttggtccaaaaatgcatgagagtagctctggacacgagcttagtgaacaaatcaggaacttgatcattggcaggaatgtggtgagtgacaagatggccaagggcaactcattcgcgaacatagtgatagcccaattcaatgtgcttgctgcgggcatgaaatactggattgatggtcatgtgaagagcactaagattatcacagtataa

SEQ ID NO: 55388 - DNA, 485 bp, Glycine max
  Peptide Sequence Number=SeqID_147073
atggatgtctggtcatttgctgatgataaattcattgctgatgttatttttgctattgttgctgcttctcttgttgcaattgtagagtcaacaggaacattcattgcagcatggagattaagcaaagcaacccctattccaccatctgtgcttggtcgtggtgttggctggctggtcaaaaagaaaaagcttaaggaagagaataagaggaaagcacttgaggcagagagagcaaaagaagagcagttgttgagaaagcgtcagagagaggagagacgagacaaataccgaaaggaagacaagcagaataagaaaattcggagagcagagagtgagggatggaacggaaacatgagtttatttggaaagagtgagggtattgagtttgatttgattccaaggaaccccaagtatgagataacttatgatcagtgcttgcagctcttcacttctctcaaacacagcggagttcttgttcatcaatg

SEQ ID NO: 55389 - DNA, 345 bp, Glycine max
  Peptide Sequence Number=SeqID_147074
atggggaaggcaaaagaagcagcggtggtggcgggagccctagcattcacgtggctccttatagagctcgctttcaaacccttccttaccaaggcacgtgcttcgattgacaactctgacccgtcacgtgaccccgacgatgatgctcttcctaaaaccaccattaatgacgttcccaatgtcgctgattctaaacccgccggcgacgtacctaccgctgttgatactataaccaccgacccagatgtaccctccaatgtgttaagacaaagatctcaagcggttaaacctttgatactttgtgaatggggatacaaaagaattctcaggcggttaaacatttga

SEQ ID NO: 55390 - DNA, 293 bp, Glycine max
  Peptide Sequence Number=SeqID_147075
ccaattcatattgttgttgaggttatacaaaccggctctccacgcaatcgagagaatgttgctgctgtcttgtggtcactatgcaccggagatccactgcaattaaaactagcgaaagaacatggtgcagaagcagcactgcaggagttgtcagaaaatggaactgatagagctaagataaaagctggaagcatattggaactcttgcagcgaatggaagggggacctgctatcaagtcagcagcaacaacagaaccaggtagtcaaaacggaaagaaattggaaggtgggag

SEQ ID NO: 55391 - DNA, 279 bp, Glycine max
  Peptide Sequence Number=SeqID_147076
atgttgattgatgttggaaatgcattgtcatgtgcatgttgtgtatgttcgtggggggcaaagtgcactgacctttcagggtctttggcacttgctttgagccagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 55392 - DNA, 120 bp, Glycine max
  Peptide Sequence Number=SeqID_147077
atgaaggcaataaccaatacatccaaaggtatgcttgatgaagttgcacctcggtggattgaaacaaagtggttttctgatacaacatcgttagacgtggaggccatcagaacactttga

SEQ ID NO: 55393 - DNA, 201 bp, Glycine max
  Peptide Sequence Number=SeqID_147078
atgagaaaatacgagagggttgctagtgcttttgtgagaaggctgctagtggtgagagaggatttgttcttggaagatgttggcgatttgccgaagtccgaatacgtggaatgcgcgagtaatgtggatgatgaaaaatctactgttccgttagggattggattttcggacatggcttttgagaattgtggtatggcttaa

SEQ ID NO: 55394 - DNA, 2118 bp, Glycine max
  Peptide Sequence Number=SeqID_147079
atggggaattgggtgaagtccttgctacagcatctttgcttattcctcactgctagaaacgttttggttattggtggaggagatggtggagtcctgcgggaagtacctcgtcatgcctcagtagagaagatagacatttgtgaaatagacaagatggttgtcgaagtctttaaacaatttttcccttatatagcagtaggttttgaggacccacgtgtaacacttactgttggtgatggagttgcattcttgaagaatgttccagaaggaacttacgatgcagttatagtggattcatccgaccctattggggaaggttgcacactaactccaatgaaagaaaatgttcttccactcatgactgtaaatttccagcaaggacttggccagaagtttaaacagccagctggaactggtattgatttttcaacatttgaggagtctgagttattgaaagtaggggacatggatgtctatcctgttgcaattaaagcagatgcatcctccagcgaccatgatgaatcaaaatcaaatgaaactccatcatccggtacctcaaactctcagataactcaagcagtgtttgagaaggagaaaggacaatttgtttcttgcaaaactgaggtccttgatattgacatttcttcagctgttggtaagtcttctctctctctttttccattccttacatgggttttggaagaaatggtggataaaaagaatggtgatggggggagagtgtgtttatgtttgtttgtgttattctgtgtttgtgagtggtttgggaaattggtcggaaaaggggcagttttggctggggtctatgcaaggaagaggaaaacatttgttctagttaattctggtttagtgtatggctttggcttcataggatttggcatcctcggattcctggatagaaaggtatctgataaagtattgaaacctagaatcttagataccttgagagctcaccatgtttgccaaattagcactggcttgtaccacactgtggtgatcactagcaggggacaaatatttggctttggagacaatgaaagagcacaacttgatcatgacacttcaccaaacatgggtcaaaaggggtccatgaaccctatttgtgcaaaggtccaaaacctccaaaccaaaacagtcaacaaaaccattaagaatggggccagagaatgggactcagtcatgtatagatcatttctgagatgtgatgatccaaaaggagtagtggaatgtgggacaatcaagaaatacaggactcgttctcacaaagtgaaggacaagacacgaatccaaaagacgggtgaaaacttggagacatccttgtccttgatgaacaaaagatacaaagaagagaataaggtcccaaaaggatgtgatggaaatctcatcgatccatcatcttatagagatattatgtgtgatgaaaagtctgaagatattgcagaagacagaattgaagcaaagattattggtagaacgcatgctaatccatttggggaacaaagtaatccaaaggggtttcaaagaccacagccttcagctggtggttgtctaagtaattgccaagaggaacttaagaaggtgattaaggagagtttggttacacaaaatatgtttccaaagacctctgaaagattaaactatggttcaaaaactttctctacaagcacaagccaatattctgttgtcaggactaacaacctttttgatccttctttctcagcaatagctccaaagatggaaagaccacctagcctaattttcaagctgatgggtttagaagaagccccctcaaaatcatttccagctattaagcagaaacagttggatagagagctagatatgtcaaaggagagttttgtcaaagagcctaagcttcatgtgcatcatttcaatgataccaattccaagcaatttcgtgatttatctcatattgcacttatgaaacctcaatgtactctttaccaggaatcattccacaaacatgggaaagaaatggaaaaaggtatatgcaaacgggtgaacaaagaggaaggacctaaatttctcaaagaggttatgaaacttgatgcaaaaggaattaatcctgttgaagaatcataa

SEQ ID NO: 55395 - DNA, 690 bp, Glycine max
  Peptide Sequence Number=SeqID_147080
atgttgaagaacggtcgagaatcttcgcgtaattactcacggaaacgttacggaagcgcctcggcttggattttcttcacggaaataattttcctcaacaatttcgagagagagagaagtgccaagaaggctaaacccttttcttcttcactcctccccctatttatagcaaaaataggggaggagcttgccacccagctctcccaggcgagcaaggttgcttccttcagaagcaacagctttctggaggaaggatctagaaggcccaactttcgaagaagttacggaaactcacggatcgcgcaaaaacacatctttttgatttccgccacatcacggaatttcacggatcgcgcaagcctgcttccttttgatttctgtcacgtctcgggacttcatttattgtgcaacaaaggacgccagtttggacaacttgtcatgatcatgagcagaattgaacaagctttgaaagctaggatcaggtcaaggaggaagaaattctgggagaaagcagtcgatattgaagaactttgtggtccagataaagcatggtggggagaatatgaagacagattaacggttgtaaagattgatcatgatgtcaacccgcaactgcaaatacaacataatgtggtgaaggaaggttgtgctaaagggtttctactcggggctgggattcagtcattctaa

SEQ ID NO: 55396 - DNA, 246 bp, Glycine max
  Peptide Sequence Number=SeqID_147081
atggtggcgacgaggtctttgtgggggttcaggttaataaaggaggtagcgacgagggtttgggtctgtggtggggtttgggtgggtgatggtagcaacgtggtggcggggtggggtcgtggtggcagtgatgtggttggtaggtttgggttcatggtgacaatgaggtcattgacaacaaagttgagagagaaactagagattttgagattttgtgaggctagagcaaaaaggagttcaaattaa

SEQ ID NO: 55397 - DNA, 960 bp, Glycine max
  Peptide Sequence Number=SeqID_147082
atggccaaccattctacatctcttattaatggaattcccatcaatgaggcatctaaccttgggtggcaacagcctcaaagccttccacaatcagaagggaaactggtgatgtttaaatttgaatggttatttggaacaccaaaggttgaacttgtgaagcatgttacaggtattgatggctccagagttcagaaggtgttggaatcagttcacattgcagctaacaaaaacacagttccaggagatgtgtcagctatggctcctggtggtatcagaatggctagactgaggcaagttaactgcaaacccgttgccatgggtgagaactacttttgctcatcaccaccaccaccaagggtgagaactcaactagtccatttgccaattcaattggagccaaaaattgggagtagtcctatggaagtgcagcagaggaagccagcagttgctgctgctactattcaattggaacataaagtatttggttcaaagtttgaatgtgtttgtatggaaaatgaagatgataacaatggtgttcaagtaggattaaagaatgaagcccttgccataggtcctccaagtccttctaaaggttccttgcccttattccttgtcttgtcctcatcacatggtgaaggggagactacacttattgggaataatgtgtcaattttgcataatgtgacattgggagggactagtaaggcaagtggggatagacaccttaagattggtgatggggtgttgataggtccagggacttgtattttggggaacattaagattggtgatggagctaagattggtgcttgttttgttgtgttgaaggaagtgccaccaaggactactattgttggaaatcctgctagggtggttggagggaaggataaccctattaaattggataagatgcctagttttaccatggaccatacttcatggtctgattatgttatatag

SEQ ID NO: 55398 - DNA, 845 bp, Glycine max
  Peptide Sequence Number=SeqID_147083
atggggggcccggtgttgagagaaacgaggatatgggctacgtgggagtacgtgagctcagttggaggtgggcaacaggggatgggagaaacttcctgcttttattcgttaaccacagagtggtacctggagatatgtcgcggggaacctgtgatgtacctaaacatgcgagctcctggcagtcaacagataaaaggaacaaagaccacaaagcaaggaggcttgtggtggctggccagctgtgaattttgtgtgatatatgggttgtggcctctggtaatcgattaccaagggcttgaaaacgaggcctctggtaatcgattaccagcctgtgtaatcgattacacagagggatgggtcactggtaatcgattaccagagtctacccctttcttttctttcttgttgatcgtgatggcggcgcagctaatccgtgatcgagtagagatggagtgcctagagggagcttgggagaccctcgaaggcaacacgaggtgccgatttcagggtaccattcgattcacggctacttctttggtgcatccagatgaacctgcacggatgcttcagcgcacggtggagtggatactacccacgcctacaccatatcgtctagtggagccagtccaagtgatcgaggtgacgtcatccgaggaagaccctgaggaggatctggaggagctacctcctgagcctgctgtggatgcccttgactttctagagggtgatgaggatccacttcttgaggtggattctcccgaggaagtcatgtcggcatctgaggcagactctacggaggatagtggcccgggggagatggcgatcagcggaggctcttcatccta

SEQ ID NO: 55399 - DNA, 93 bp, Glycine max
  Peptide Sequence Number=SeqID_147084
atgggggttgttgttagccttgtagataattcccgacttatagataaaagctgggagcttaaagataatgttagagataaacatttgaattaa

SEQ ID NO: 55400 - DNA, 142 bp, Glycine max
  Peptide Sequence Number=SeqID_147085
atggcaagggacaaactacaatcttcagctgtttgtgacctaaaactaaaactcataagtgataggcaattagatggaagattatataacttgccaaatactgctgaagttgctgctttgattattggtgacgagcatacag

SEQ ID NO: 55401 - DNA, 1077 bp, Glycine max
  Peptide Sequence Number=SeqID_147086
atgtggcacgttaacaagcacaatggtagacaagaaatagaaatggtgttcatggaccaaacgggtgcaaagattggtgccactctttggcaagaactgtttcctgaatttgaggtaatgttgcattgtggttctgcatatgtgattcagaacattaaggttgttgaaaatcattctaaatacaaagtgagtaggattccatttttggtttacttggtgaaaactacttctgtgaaggaggccaaacatcctatgattcctactaatgtccatgttattactccatttgttgatattattgatggggtagcaccacgtgacactttagttaatgttgttggtgttgtggtcgaagtcattgagcataaaacagttaatcctacatatagagttacagtcaagttgagggataacagatatttgccatttgaggaggcatatgctcttcagcttaatgatgctatagagaaaaattattttgataggaagccattggtggttatgttaacacttgctgagatcaaagatcctaaaggtatgtcattctatgttggcggactatcagatcaaggaagtgtttctcaatcacaatatagccaatattcccaacgaagctctgtggacaagttcttgcataatgctcaaatgatgacactaggtgaaataagcaggctgagacaagactgttactgtttgactattggtacagtggatgaagtaatgattgatacaccctggagttataatagttgtccctactgtactaccacatttgatccattgaaatttggttccacttgtcgttcatgccagaacgaagttgctgacacagttccaagaatggggagaaggccaacttccatttctgggatgaaacatagtggtgatgacatcaaggtttcccctccctgtgttgatgaattattgggaaagacttgggttgttaggttcaagtatcgtgtacaaatgcgtcaatcatctgtgttggatgttactaaagatgaatatcttattcagacaatgacatcaacaattgctctgcatgtggatgaaccaagcaagtatagggaagggtaa

SEQ ID NO: 55402 - DNA, 528 bp, Glycine max
  Peptide Sequence Number=SeqID_147087
atgggaccacttcttccttttgaggaacttgtaaatgaagatgtttctgtggatgagcccttcaagcaagaagaagataataaagatgatactaacaaggattgtaatctaccaaacccctgtgctttattgcatgtaacaaacaggaaaaaggcaccatcgctgaagaaaagcttgtccatgagaactataagtgagatacagattgaatcattgagaaaacagctaattgaggaaacttctcttcaatgccttcattctaaggaatctatcgactctttaaattatgctcatagtggtagcttgaatgctgataaaaatgtgaattttagagagtcagatgctattcttgttatcaagagacttcaagatcagattaaggttttggaaatggaaaacttgtcaagccaaaaaagcttggataatgttgttggtctggcaacaaagcagaacatatgtgctagggagaaatatgaagagaaaacactcgaactacaaactacatcaatcagtgacggacctaggtag

SEQ ID NO: 55403 - DNA, 228 bp, Glycine max
  Peptide Sequence Number=SeqID_147088
atgtcggatatggatggaaacatcaggggttgtccagaaaagatctgtcagcagtgggcggtagaacagagcagaagagaaagtgtggatactaggggttgcctggtcgtgactggaagatgcgacgtggtgagttcagcaggagcaggagggaccagcgaggctattgactactatgcattgcacacaacccagttcaacatgattgggataaacacacagagatag

SEQ ID NO: 55404 - DNA, 450 bp, Glycine max
  Peptide Sequence Number=SeqID_147089
atggtagggttatcttctagaaaaccctcatcatcttctgcaatcaaaagaaaagccttagaggcgcatttgtggccgcgatggaacttctcatcgcaattgaaacagaggtcatgctctcgttgcaaggctaactcctcaagagacaatcacttgataggtagagaagggagtgttttcgaaggcgtaggtagcaaaggggaagaggatgacgccagagaaaacgaaggaggagacaacgtgttggaagatggaattggggcagagtttagccaagccagccgcctgtaccaacatcagtggttgcagggcctgaacttcaaggcgaatctccagggtcaagccggaaatgaagcagctcaagaggaattgcggtgcgagaccgatgattcggtttgccaggacctcgaactcagaaaggtatgcctggacagtgctgtgttgcgttaa

SEQ ID NO: 55405 - DNA, 258 bp, Glycine max
  Peptide Sequence Number=SeqID_147090
atggaacatggcgcaggatatgggagttacaagtgggcaaggagatgcatcagtactcacaaaaggaccttcaacttcaagatgtacctagtgtggggacgaaattcacatggtacaaacctaatgggacagcaaagagcaggttggacagatttcttgtatgtgatgaatggctttggaaatggcaaggatcattgcccagtcatgctgaaatctctcgagttattgactggggaccccgacctttcaagattttaa

SEQ ID NO: 55406 - DNA, 438 bp, Glycine max
  Peptide Sequence Number=SeqID_147091
atggcaatcgaaggtagaccgctagaaacaaacctgtcggaggaggactttcctccgagcacagaaagcgatgagcagagccgacgagacacggaggagcgacggactgaagggcaaaatcgcaacaaagaaccacaggttaataaccaggagtcactgacacgagttcaggaatgggtcacatctgattcctgcagcggacaaaaacaagttgaccgaagcaaacaaaagcctgataaaagtgaaaaaacacaggcacaaaggacaacaattgagcctaaccacgaccccatttccagaaaagaaaaggagattaaaagcaacaaaatctggtcagaaaaggagtcaataaaggtgatacaaaatctggcagcagaaattacagaaaaggagcatgcacaggaacaagaaaatagcagagaggacaaagacaaagag

SEQ ID NO: 55407 - DNA, 573 bp, Glycine max
  Peptide Sequence Number=SeqID_147092
atgaccggaagacttcttgccggttcattggcttttgagagctgcattctgcattatcttattgttcgtatcttactccctagatcttcaaaccttgctcaagtttttgaagaagatttcattgtcatgtgggcctttcataaaggtttacaaattgattgggcacaccttgttagatatcacatgcataaggcattgcgattgaatgccccattgctttatcctcatcttgttacccttttccttcaacacttcaacatccctcttgattctgaaccttatgttccaatcaagagatcattccttataggcgcttcagtcatagcatcctttggttatataaaggtgcatgatggctcttgggtgaagaagggtgctagaaatgttggtgaagaaggacatgaaggagaagattcatctcttctttcaaagattatggaaaggtttgataccttggaattgcaagtggatatacgcttcaatgaaatggagtcaagaatgacaaaggttgaagatgtatcttacatccggtcaagctttgatcttccaccaccgtcgccaccatcatcttag

SEQ ID NO: 55408 - DNA, 387 bp, Glycine max
  Peptide Sequence Number=SeqID_147093
atgaaagattgcaaaaatacaagtggtgaggatgtctccttcacctctaggatctcacaatcactcacaaactcatctcaagctctcaaaccggttcctgcttcaagctctggtggccttgttcatgctcgtgcgcttagcgcacttatggaccgcttagcacactatggtgtaggttgcgagacacttgaggttaagggaacgcgagagagtgtttttgaggaggagacccttgaagttgagggaggactagacgacaaggagagaggtggtgtggatgcagaggaagaagatggatatggtgacgaccccaaaagagttgaaggcggcaaggaaggaggaggagaccaagaggaagaaggccaattgggggagtccaggatgtag

SEQ ID NO: 55409 - DNA, 429 bp, Glycine max
  Peptide Sequence Number=SeqID_147094
atggctagtgctcccactccatgcgaagagtttgtgtacatggcgaagctagtggaacaagtcaagcattatgaggagatggtggagttcatggagaaggtctttgcctctaccgagagcgaggagctaaccgaggaccaccttgtcgtcatccgcaactaccgctccaagatcaaggtcgagctctccaacatctacgacaaaatcctcaaactcctcgacacgcacctagtcccctccctcacctctggtgactcgaaggtcttctacctcaagatgaagggagcctaccacaggtacttcactgagttcaagatcgatgccaaccgcaaggaggccgtcgagagcccgctctctacctacaaagctgctcaaatttgctttttctttttttctttcgattttttggatttttattttgtgatgtag

SEQ ID NO: 55410 - DNA, 1005 bp, Glycine max
  Peptide Sequence Number=SeqID_147095
atggttattagagcaaaggtcacgagtttgattcctagtgaggaaattgctgagggggagattgtttgtcgggttgtgatatcaattatcccgtggcagaggcctgggtggatcaactttttgagcaaccctaatttgcagttgatccgaaagaaggtggtaaaaagtgtcaagcaacaaggaagcaactctgaattatatggaaagatgcaagttgtgtttgtagaaatggatacaacaccaacaacaaaagagttggagaatttgaaggaggctgtaatgaaatctaatgaaaagaatgctgcaaaggaaaattttgatcctgataaacatatagatgcctatctacctgtacgagttaatgagcaaagaatgagcaacttattacagtctcttttgattggcctatcaattttttccgttaatatcatcaaaatgatacccacttcagttctatggggatattttgcatacatggcaattgatagtctcccagggaatcaattttgggaaaggatatcgcttctgttcatcccaccaagtcgacgctataagatattggaaggttatcatgcctcgtttgtggagtcagtaccattcaagaccatagctgtattcacaatattacagtttgtgtatttcctaatctgttttggagtgacatggatacctgtaggaggaatactttttccattaccatttttccttctcataactataagagagcatttgcttccaaagatattcaaacctaatcatcttcaagaactagatgcatctgggtacgaggaaattgttggtgctccacatattacacataatataccaccaagggaaaaagagtcaaatgaccctgacagtgatgatatgagctcagaagattattatgatgcagagatattggataagatgaccacaaataggggagaattgaagcttagaactgtaagccgaaataatagtaaaagcttcagctacagctccagtgaagacatgcaacattag

SEQ ID NO: 55411 - DNA, 516 bp, Glycine max
  Peptide Sequence Number=SeqID_147096
atgctgattgaaagagttagggttaggaagtatgtgttttttgtcataactaaacaagggctgaccattcttgctccagttgactcaccaaacactgatggaatagatccagttcaatttgggtctgctggcatgttcatatttgggatggattctataaagaagggtatgagccattacgtgttcatcgtctatcgtaatgccatcgcctctgtatctcttgctcccttcgcatttgttcttgaaaggaaagttaggcccaagatgactttctgggtattttcagagattatggcactggctttcttcgaaataatgctggaccagtgcttcgccctcttgggcatgaaattcacgtcggcatctttcctatctgctgttatgaactccgctcactctgttacttttgtgatggctgtcattctaagagttgagacttattacccggtacatgataaagggatggggttggaatgcagtggaagtagtttaaccggaggaggactagttaaatga

SEQ ID NO: 55412 - DNA, 228 bp, Glycine max
  Peptide Sequence Number=SeqID_147097
atggaaaaaagcaaaacatgtggaaagcgagaaggctcgagaacgcttccagactccacgggagctagaaaagagaaaggggaggaattgcaacagttggcacaaaaagaggaaaggggccttctaaacacaaaccttcagagaaggatgaagccttgcaagtggactgaagtgagcaaagaaggtgtcaacaggacagaattccgatatcaaccactcttcgtttaa

SEQ ID NO: 55413 - DNA, 282 bp, Glycine max
  Peptide Sequence Number=SeqID_147098
atgtctatgaaccatgaccgttctacccatgtagtgtatcctgataatgaaactcgagagtttgctgaagcaatacgtagccatttggacccaagtttgacttcttcaaattcgattcaagggggtgtaggtatgaagcggtttaaaggtctcatgagtgacctgattaaggagcatgatactttgaaagaagttggagtctttaacatggcttctgctcggggagaaaatgcctttcgcaactgtgttatagagtctgatctcttggatattggttattga

SEQ ID NO: 55414 - DNA, 888 bp, Glycine max
  Peptide Sequence Number=SeqID_147099
atgtcgatctatcacttccctcaccatgaccgagtccctcgtctccctcctcacattccaaggcctcctctcttctccctcctcacattccacggcgactccctcgtccagtccaacgctgaccacgacctcctgactgccttcgagatcggtgacgccgagctcctctacgagatccgcctcctcagcgccttgcaacacgtcgctgccacaagcttcctcatcgagaatcggtgtgatgggaaggccacgcaggagctcgcacatgcaatgaaggctttccctaataagggaggattcggcattggagcaggcgctgggcgtggcggagacgaaggcggtgacgaatgtgattttggaggaggaggctgcggcgcatgttccggtggtgaggctgaggattggggaggtggcggaggtgagttcggtggtgttgttgccggtcttcgcgacggaggagaaggagattttggaggcatgcaaaataaggttctattaatttgggattacatgcatcttcagacaagaaagttggaggttctaataaagaatggttcaagactttatgatcttcgtctacttcagaggggtgttgttcaatgttatgaagggcatgtgaattctcatactcatatgcagattagtgttgatccatctgagagattcgttatgtcaggtggagaggattgcaagctaaagttatggagtatcaagtctggtgaactgctttttgaggacaagttctctgattcagttatctccattgtgtgctataaaacatatggacatagttttaaagcagaagaggaaaaccaatacaagcatgactcatctcagggtgcatggcttggatcacttgaaggactgttttatatgtgctggttatga

SEQ ID NO: 55415 - DNA, 186 bp, Glycine max
  Peptide Sequence Number=SeqID_147100
atggagatatcatcctctttgatatcaaacattgtggtggtagggactactagcgacaacgtatcatcaaagagaaaaactctagatgaggcttcactgttatcaagcgagtcggagacccagcatgaccacagatcaacctccacttcttatgtctccacggacccaggtgccatgtgtgcatag

SEQ ID NO: 55416 - DNA, 516 bp, Glycine max
  Peptide Sequence Number=SeqID_147101
atggtaaccattcgtgcagatgaaattagtaaaattatctgtgaacactttgagcaatataatacagaactaaaaggtccaagtgggaaagaagctgaagtccctgaagaaagcgaagaagtgcaagccttgaaagcaaagcttgaaagaacaagagtggtcaagaaaaagctaaagacgatagtcactaaggtcaagaaagagtgtgacgagctaagagatgtcaacatgactatggttgaagcattagagtgggaaacaaagagggcccaaaaggaagaatggagaaggcacaagtttcgaggggctccatggggcagcaacaacgagctcaagcttagaagggccgaaaaggacgtgtcaagggtggaaaacatggtgttaaaggataaactgaaggcatgtcaaagtgttgattttcacgctctcgctaagccaacctgtcggcttagtgagccatctgctgagcgtaacactcctcgactgagcgcgaggaagaatatggaagaaggatga

SEQ ID NO: 55417 - DNA, 495 bp, Glycine max
  Peptide Sequence Number=SeqID_147102
atgggatttgacggaccccgtttccgcagtgaggaacatcaaaaccgctttaaagtgatcaagggttggtttttccataaagagagacgggtccaactgagagagggggaatacacgaagttccaggaggaagttgctaggaggcaatggactcaactcacagggcccatggctaagtatgacccggaaatagtcatggaattctacgcgaatgcatggcccaccgaggaaggagtcagggataagagctcttgggtgtggggccaatgggtcccctatgatgaagatgccatcaatcaattcttggggcatccattggtcctggaggaggggcagcgttacgagttcagtgaaatgaggagccaggcttcgggattttataaggaggctatagaccaattgctgtgcattccgggacaagactttgcacgaagcgtgacaggaaggtgggtgcggatcatgcgcactagcatgaacaccttgacacagatctga

SEQ ID NO: 55418 - DNA, 159 bp, Glycine max
  Peptide Sequence Number=SeqID_147103
atgaatctgaagcctccgcaagaatcacaggtggacatcgtcggctccgccaatgtagatgccaccgatgaatacgcgtggcaagggaaggttgctgcaacagccgaggacgatgtggagctcgtcgcggaagtcggtgatgctcttgtgcggccgtga

SEQ ID NO: 55419 - DNA, 759 bp, Glycine max
  Peptide Sequence Number=SeqID_147104
atgcaaagtaaacttcttgcctcaccaattctagatggaaaagcacttctgtattctttcgtatcaactcctgaagtgagaataggagttgcctttggaagcgatggaagccaatcacttcctgccactgaatggcctggtgtttcttcttggctgttggttcctggggatgcaggggaattgaagaaaatgttaacagaacctacaggattgcacgttcaggatcggaaattgatttacaagaaaaaagagagggattcaaagtcatatcttgatgttgagagggtcaaagatggatcaaaattggtgctgcttgtggacattgagagtagagaaagaaggttacttgagatgttaaaaattgctaagaaggagaagacattaaaatccttgacagaaataaaggtggaggttgataaacttgccaagaaggtagcagctttggaagctgctacttccacaggtggggttatagcagagttagatatagagaccttgacagagaatttgatgagaacattgattgcattggatgaaatttattatgagggtgaactaaaattgcagagaagagagcagggaacgacaatagtaggtggttgtagatacaggcgggccattcctgttggtcttcgagggctcttaaacattgatgccaattatggcattaggaaagctttcctaccacagatgttgcgtcaaaggctccttttggaaatcaatcaacaactaatcaagcagctagccagaactgcttaa

SEQ ID NO: 55420 - DNA, 483 bp, Glycine max
  Peptide Sequence Number=SeqID_147105
atgaaaattgtcgaaactggaaatgcaaggttcattgaaaatagtgaaataaatgagagtatagttccacgagaagtggaaactaaagaagttagagtgctagtccctttagcttgtgcctctagtggtaaggtgattgctcctttagttattgttacaaacaataatgaagaagcacaacacaataatgagcctatgatacacaacgaacctattgtagaagaatcacaagaagtagcattaaggaggtctcaaagagaaattagaccagctattttgaatgactatgtgaattaccaaagggttgtaagagagttggttgttagtgggtcttcaagactaaatgtgactctcatggcaaccttgaatgttacaaggctagacttgttgctaaggggtttacttagaaagatgacattgattataaagagacgttttcaccggtctcacggaaggattcttttaggattatcatggtattag

SEQ ID NO: 55421 - DNA, 186 bp, Glycine max
  Peptide Sequence Number=SeqID_147106
atggagtgcaagtgtgcgtcgccagagacgaagggacatctgccgggtcctcggtgctacaaaactaataaaaatgaatattgtgataagcacatgtgtgaggagagagaaagagagagtatgagtgggtgtgaagacattgaggcggtggtggttgcgacgctgtcggtggcggcgatgaaatga

SEQ ID NO: 55422 - DNA, 336 bp, Glycine max
  Peptide Sequence Number=SeqID_147107
atgggagacaaaaagaagaaggctcagatgtttgtaaagctagtgtctgctgctgggactggatttttctatgttaagaggaagccaaggcagttcacagagaagcttgagttccgaaaatatgatcctaggcgactaaaatgccgatgggtgggagtgttaacccaagagttctttgctccacgtggatatggttctcgtatgggtgagggggcgaaagtagaagagtctggaggcgacggcgaggctatcgacgatgatggcgttgttcaagtgtgtctacgtgtctgtgtccgtgtcgtgttcagtgtccgtgttggtgtcagtgcttcatag

SEQ ID NO: 55423 - DNA, 264 bp, Glycine max
  Peptide Sequence Number=SeqID_147108
atggaggatattatagagactgacccaggtgttccaagattatatctcaaacctgtgtctgaagtaaataagaaggaaatggatgttgtcctaactcaagaaatggataaggacaaatttactcgcatggaagatgcatatggagtaccaaagtctaagtccattgcatcaatggccaagaggctagagaagaaaaagaagattgatgatgtagctgagctagttggtctattttgttggatcaagtggcctcggaataattaa

SEQ ID NO: 55424 - DNA, 504 bp, Glycine max
  Peptide Sequence Number=SeqID_147109
atgtctcccaagatgtgtcctctagggcctgccccatccattgaacaagcaccaatggccaaggatttggttcagtgggtaatggaccatgatgggcccagaggagggggcaatgaaaaacattatgaagttgggttgcggttggtaggtgaaggcgggccgaagcttgacatagacccattgtccaacgtcataagtgacatattttcgcttggcatctacacgagtcttcatggtattctggaccttgagcaacctgcgttgaagggcaatgtgaatgacatgcctggactatattatagaatccacggcctcgatgttggaagagcctgctatgtactaaggttgagaatgggtgaaagcacgaagatactgctccaagacccgattcataacttcggtctggttgttagtttttggatggtatgtcgtactcatacgcaagcgggtgccacagaggcgaaaaagttccttccaaagcgagctgatgaatatagggtcgcg

SEQ ID NO: 55425 - DNA, 1044 bp, Glycine max
  Peptide Sequence Number=SeqID_147110
atgggtgccgtgggttctggaaaagagtgtggtatttggttagcagagcttcaatggctagaaaaggggtgtggcggaggagctggtgggtcgggttttatcatgggtaacaagcaaaggagtgtggcgggacatatgtgggttcaatcgaggatagacccattgcaaaccaaaacacataatggggaagtcatggcggtggccaaagagatgaaaggtatcgggggtgaaggaggaaaacaaggttttggtgaaggttcggaagggttgttgtctgcgataaagagaaggatgtgtcccttgcaacgatgggtccaagagaaggtgagggtaatggagatgaaaatggggaagtttgaggcagatggcaacggtcaccaaaattggttgcaaggccaatacctcacgacgaatgtctggctcgaggttgaagatgaagtagctgataaggcaatatggtggaagcctgatgacacggagggggagaagctagagccaagggcttgtaagaacctagaccaggaagtgatgaatccattacggaacatccactggtaccagcttaaggcaggatcgtccaggagtacgttggacggggccagaactggaagtggaaggcgaggtgtgaaaggtaagatgattgaggcggtcgaggatggaatcgactttatccacaaggtcggagtgtttgttagtgagggaggtctagttgacagaaagatgggaaatagcctccttgaggcgatcggtagtggttttgcgcgtggcgtgttcggccatggcaggcaatctgttttggaagaggttcaacatagtgaggttcttcatctctgcaaacctcgtcagaggctcgagagtgtggtgaggaagatagaaagcaagcttagtctaagtgcattgacatgttcccggtcactggttaccctaaaccaagtacaatgtgaagctgaggagttccatgaaagagcactggtaggacccgtcaccgaagcttggaaggttagtagcacaccatctgagaaagaggttgcatggagtaattga

SEQ ID NO: 55426 - DNA, 2319 bp, Glycine max
  Peptide Sequence Number=SeqID_147111
atggcatcttcgctatttcggttgatggcagcattcggaagggatgttatagttgcaaatactgttggaagttttgcattacttatagttctggttttgggaggatttgtgatttcgcgagagaatgtgcacaaatggtttgtgtggggttactggtcctcaccactgatgtatggacagaatgctatagctgtgaatgaatttcttggtcatagttggagaaaggttactcctaattccaatgaaacactaggagttttgatactgaaaactcgtggatttttcccagaagcttattggtattggattggagtaggagcattaattggttatgtatttttgtataatttcctgtttaccttggctttgcaatatctaagtccattcagaaaggatcaagcagggctatcccaagagaaattgattgagagaaatgcttcaacagctgaagagttgattcaattaccaaatggaaaaatctcttctgaaacaaagattgtagaagaagcaaacttaccatccagatctttttctggaagacttagtgatgataaagctaacagaagtggaaggaagggtatggttcttccttttcaacctctatctctcacatttgatgagataaaatattctgtagacatgccacaggaaatgaaaaagcaaggagtttttgaggaacgtctagaacttttgaagggtgttagtggtgtctttaggccaggagtactaacagctctgatgggcgtaagtggtgccggtaagactacattaatggatgttttagctggaaggaaaactggtggatatattgaaggaggtatcacaatatctgggtacccaaagaggcaagaaacatttgctcgcatctcaggatattgtgaacaatttgatatccactcacctaatgttacagtttatgaatctttattatattctgcatggcttcggttaccccgtgaagttgatcacgcaactagaaagatgttcattgaggaagttatggagctagtagagcttaattcaataagagaagcgcttgttggattgccaggagagaatggactttcaaccgagcagcgcaagaggcttacaattgctgttgaactagtagccaacccatcaataatattcatggatgagccaacctctggccttgatgctagagcagctgcaattgtaatgagaaccgtgaggaataccgtgaacacgggacgaactgtggtttgcaccatccaccagccaagtattgatatatttgatgcctttgatgaggctattcaaggagttcctaagatcaaagaaggttataatcctgcaacctggatgttggaagttacatcagcaggcacagaagcatctcttaaggtcaacttcaccaatgtgtacagaaactcagaactataccggagaaacaagcaattgatcaaagagcttagtatacctcctgaaggttcaagggatctacactttgatagtcagtattcacagactttggtgacacaatgtaaagtttgtctatggaaacagcatttatcatactggagaaacacatcatatacagcagttagactcctatttacaatgctaatagcattattatttgggatcatattttgggacattggcctgaaaaggagaaaagagcaagatcttttcaatgctatgggttcaatgtatgctgcagttaccttcatcggagtacaaaatggtgcctcggtgcagcctataatagcggtagagagaaccgtcttctacagagagagagctgctggaatgtattcagctttgccatatgcacttgcacaggttattattgaacttccccacatcttggttcagaccctgatgtacggaattatagtatatgccatgatgggattcgattggaccacatcaaagttcttgtggtatcttttcttcatgtacttcactttcttatacttcaccttctatggtatgatgaccctagccattacccccaacgcacacgttgctgccatattgtccagtgcattctatgcaatatggagccttttctcaggcttcattattcccttatctagaatacccatatggtggaagtggtactattggatctgccctgttgcatggaccttgaacggattggtggcttcgcaatatggagacaacagggacaaacttgagaatggtcaaagggttgaagaatttgtgaagagttattttgggtttgaacatgaatttcttggggtagttgcaattgtggtggccggtttctcagtgttgtttgcacttatcttcgcctttggaatcaaagtattcaacttccaaaaacgatga

SEQ ID NO: 55427 - DNA, 237 bp, Glycine max
  Peptide Sequence Number=SeqID_147112
atgcctcttctttccctcattttcgttttttccccttctcctctcaaaatcttttcttttttccgtagcccaccaaacccgtctcagaaaaatgaagatctcggactaattcaccgttggatcgttatgaaatttgagcaccacgttcgcaacccaattccgagcattctcaccgctgggaatttcgatattatgttttgttggttaattttgaaaatcgagataatacttggataa

SEQ ID NO: 55428 - DNA, 1068 bp, Glycine max
  Peptide Sequence Number=SeqID_147113
tgagatgtgaccaggaacgtgtccgtcctaggttttgtcgaggctcaccaagggtggaccttgggtttgatgagcctccttgggttttccttgctctgttgttcttagaaaaacaacctccttgtcgacggttccccgaccttgacaaggatcatgacatttgtgtcggatataagtcgaaaaggaatttcgttggctttaaggatgatctggttagctacctccgcctgactgttggtctgggggtgtttgatagaggttatgagatgcttgacacccaaactgtgccaaggggagctcatgctatggagattatcaggaggggtgcatggaacgtctgcgaattcttagcatcgtctgcacctctttgtgaaatcgaggatctcttcatgaagttttcgcatgacatagtttggttgttggctgttcaggcatttaagcaaggcttggagtgttccctaaatgatggtttagagatgcctagtctttttggagctagccaacttggagagcagtctaatatctattggcaacttgcccttggacaagctgggagctttgatgttgagcttgagagcttgctccaaagtgaaattgtcaagcccttcaaggatgatgcctgctccacttcccttcatattggacacttcgtccatgtagaggttccaccagtctggggtggtttagtcattgccagcaaagtctgccatgaattgggtcttcatggggtcgtgcagttcatattagaggcgccaagccgaggtaataagttccagcgctaccttctcaatcatttggtaccgcttctcggcatcatggaagatgttgctggtgaaatagatgggaagttgatgtttcacgtcttcctatacgagggacaagaaggcttggttggtttctatttcccgatgtgtgatcatgaaccccaggaactttcctccgcttaccccaaaaatgcatttttccaagttgaggcgcatatcgtacttatggatttctccgaatacctcttccaagtttgccacgtgttgggctatgctatgggacttgacggtccatcagtctttg

SEQ ID NO: 55429 - DNA, 3531 bp, Glycine max
  Peptide Sequence Number=SeqID_147114
atggagggcagtgacacacctagagttgatgctcaacgagtgagtagtggtttcaacatgtggaggagccattgcatgggtgttttctcaacttctgaacgtgaagaagatgaggaaactctaaagtgtgttgcaatagagagactccttgcaaaggcacgcattattaggagaagagacctcaaccaagttgaaggaaaaggagaagaagttgacatcaagcaattagagttatcagagagaaagagtcttctagagagacttgtgaagataccagaagaagaaaatgagaggttcttgttgaaactcaaggaaaggatggacagagttgggcttgaaattccaacaattgaagttcgatttgagcatttaaatgttgaagcacaagtttatgctggaagcagggcatttcctacattaataaacttctttgtgaatttgcttgaggggttcttaaattctcttcacacaattcgaagtccaaagaaaccgctacatatccttcagaatgttagtggaatcataaagcctagaagaatgacattgcttttagggccaccaagctctggaaagaccactttgctgttagcgttggctggaagacttggtaaagatttgaagcattctgggagagtaacatacaatgggcatggacttgaagagtttgtgccacaaaggacatcagcttatgtaagtcaacgtgataatcacattggagaaatgactgtgagagaaacattagctttctctgccagatgtcaaggaattggacagaattacgaaattttgacggacctattgagaagagagaaggaagcaaatattgaaccagatcctgatattgatgcctatatgaaggcagcagcactagaaggaaagcagaccagtgtggtcattgactacattctcaaggttttaggacttgaagtgtgtgctgacatcatggtaggagatgaaatgataagaggtatctcgggagggcagaaaaagcgactcacaacaggcgagatgctggttggacctataagggtgtttttcatggatgagatatcaaccggtttggacagttccacaacttttcaaataatcaactctatccagcaatccatccatattctgaatggaactgcacttgtgtctctgctacagccagccccagaaacttatgaactatttgatgatataatactattaacagatggccaaattgtgtaccaaggaccaagagaaaatgtacttgagttttttgaatcaacgggattcaagtgtcctgaaagaaaaggagtagctgatttcttacaagaagtgacatcaagaaaagatcaatggcaatattgggcgcataaagaagaaccttatagctttgtcactgtcaagaattttgctgaagccttccagtcatttcacataggtcaacaacttggagatgagttggccaatccttttgacaagtctaaatgtcatccatatgcattgaccacaaagaactatggtgttaagaagaaggagctgttgaaggcttgtgctagcagagaatttttgcttatgaagcgcaattccttcgtctacatattcaaagccacacaacttacttatttagctatattgacaacaacattatttctacgaaccaagatgagccgcaataccttggcggatgcagaagcttacatgggtgctctattcttcacagtcactgttgctctgttcaatggaatatcagaactgaatatggccgtcatgaaacttcctgtcttttacaagcaaagagaccagcttttttacccttcatgggcatattcttttccaccatggatcctcaaaataccaataacccttgttgaagttttcatctgggagcttctaaaacagtacttggtaatcttttgcattaacctgatggcatcagggctttttcggatgatggctgcattaggaaggaatattgtagtggcaaacactgctgggacatttgcactgcttgcagttacagcctttggaggatttgtgatttcacgaaaggatgtgcacaaatggttgctgtggggttacttttcctcaccactgatgtatggacaggctgctatagctgtgaatgaatttcttgggcatagttggagaaaggttagtcctaattccaatgaaacattgggagtattgatactgagatctcatggatttttccctgaagcttattggtattggattggaataggagcattgattggttatgcttttctgtttaattttctcttcaccttggctttgcaatatctcaatccattcagaaattatcaatcagggctaccccaagagaagctgctcgagagaaatgcttcaacagctgaagagttcaatcagttacaagcaagaaagagctcttctgatacaaagatggaagaagttggtgaaaataacaaagctactgatagaggaaagagaggcatggttcttccttttcaacctctatcgctcacttttgatgagataagatactcagtagacatgccacaggaaatgaaaagtgaaggaatctctgaggatcgtctagaacttttgaagggtattagtggtgcttttaggccaggagtactaacagctctgatgggtataagtggtgctggcaagactactctactggatgttttagctgggaggaaaactagcggatacatcgaaggaagcatcacaatatccggatacccaaagaaccaagaaacatttgctcgcatagcaggatactgtgaacaatttgatatccactcgcccaatgtcacagtttatgaatctttgctatattctgcatggcttcgtttatctcccaaagttgataaagcaactagaaagatgttcattgaggaagttatggaacttgtagagcttaattcattaagagaagcacttgttggattgccaggagagactggactgtcgacggagcagcgcaagaggcttacaattgcagttgaacttgtcgccaacccatcaataattttcatggatgagccaacctctggccttgatgctagggcagctgcaattgtgatgagaactgtgaggaacaccgtggacacaggacgcactgtggtttgcaccatccaccaaccaagtatcgatatattcgatgcctttgatgaggcctcggactctcagtggtgtgattctcccaagatatatgatggtccaataggaaacaactcttccaatctgatccagtactttgaggctattcaaggaattcctcagatcaaagatggttataatccagcaacttggatgttggaagttacatcagcagcaaaagaggcaaatcttaaggttgacttcacagaagtgtacaaaaattcagaactacacaggagaaaggagcaagatgttttcaacgcaatgggttcaatgtatgctgctgttacctccattggggttataaatggtgcctcagtgcagcctatagtagcaattgagagaaatgtattctatagggagagagctgcaggaatgtattcagctttgccatatgctcttgcacag

SEQ ID NO: 55430 - DNA, 150 bp, Glycine max
  Peptide Sequence Number=SeqID_147115
atggatgaggaagagaaaaaaccagaggaaaataaaggggaggagaaaaaagcaaatgaagaaggaaagaaagaagaagagaaaaaaccagaggaatcaaaagatgacaaggaattcaaggaggaatctgcgccgccagaaatcgtgtaa

SEQ ID NO: 55431 - DNA, 1089 bp, Glycine max
  Peptide Sequence Number=SeqID_147116
atgaagagggcaatcgccgttgttttgagagttttcgataagtaccccgacgcggttagagtttgcttcaagcatttagatgactacaaggcttacaaggaggccaaattggctcagatgaagcttctcaattatgcttcttgttctccggtggaccaaaatgtccctgtggctgaacctgaattcaatcgcggtggtgaagaggtggctgaggctgaacctgaattgaacgtcgatgaacgtgtagagcctaagaaccctagatgggctgtttatgggaggggtttggaagagaatactagacttggcagctgttacttcaagagagagagaatgatgataaaggataaatggcttcctcagcacactcttgctgcatgtggagaattttaccttttagattatctgttgaagcacaatgttgatatcaatgttttgaaaaatgaagagtcagggccattgaaggaatccacatccttgattgagcaccgtaagcagcatggattatattatcttccttcggagaagagtgagattgtttcagatgagtatcctcctgcaaatgatccaaagtctaacaataatataaagttttacttcgatgacctttatcaagctcttcccatttttcttaattcgctggtgcatcccgctgcggcaatcttgattttggtcatactcatcttcatgtttggagagatattgccgcaagcaatttgtacaagatatggattgacggttggagcaacgctggctccacttgtttgtgttcttcttatagttttcttccttttttcttatccaatcagaaaggttcttgattggatgttgggcaaaggacatgctgcccttttgaagacggcagagctcaagacttttgtgaattttcatggaaatgaggttttattacttgtgttccaattctttcaatatgactctggtttgtgctctgatgctggtaaaggaggagatttaactcacgaagagacaaccattataaccggtgcacttgaattgacagaaaaaactgcaaaagatgccatgactcctatatcaaaggcatttcccttgatctggatgcaactctaa

SEQ ID NO: 55432 - DNA, 627 bp, Glycine max
  Peptide Sequence Number=SeqID_147117
atggtattcttggatgcattgcatgacctgacacagagtgcgagttatgcttggggcgctgttgcacttgtgcacatgtacgataatttaaatgatgtgtccaagagcacggcaaagcagcttgtaggatatatcactttgttacagaggattacgaccaaaggagaccacgtgcatgtcgttggacctctgatggggcccgtacacggtgattcaccggccgaagagggttgtacgacagttcggctattccgccacaccctgttgctcctttgctgtcatatgctgaaaataatgatagatggatgtggtttgccaggggatcctccaagagtaccgccacttcaggaagaagaacaatttgttgaaccacatatgtatgagcaaccgatggcgacagcggcacctaatgaggcagacattgatcaacatgatcttcggcttgcagtgtatgactttgcaacaattgctgataggttggacaggctgctaaacctaaggattttgaccgaaggaaaagaagcctacgttgttgttgaagaatgtgttggcatcgcaagacgctacactggcgatccacctgtagcctacaagtccaggcgaaggcggcgtacggacggacattga

SEQ ID NO: 55433 - DNA, 243 bp, Glycine max
  Peptide Sequence Number=SeqID_147118
atgaatgtcgaaaatgatgaatatggtggtgttaaagttgattgctttgatgcctttaatacttttgagttgtttggtagtcgtgatgaagttttacaatggacccgatcgttggctcatgacattggatttgttgccgttataatgaggtcagacaccaataccggtgtacgaggaagagcttcatttttattgatagcttgtgaaaggagtggggagtacaggccaaagaaacataatttg

SEQ ID NO: 55434 - DNA, 402 bp, Glycine max
  Peptide Sequence Number=SeqID_147119
atggcggagctctatggtctgaacatgatggcggatggaatccaagacgatccaagcaacgtcacgcggttcgtgatgctgcttgcttgtggggcttctatggaggctggatctttgagcttcaatgagcccaatctacttggagtcttctacccaatgcccttgcgggataggattgcatcaggaacttccgtgctcttcaaagtgctttctgtgttcacattccgcaactttagtctaacgaagaccgagtcgcggccgcatcagaaccgtccaattaggctcgtggatgacgcaaacgcctccgtggctaaggttaagacagtggaaaagtgtgagatgaagagagtggtgggaagggaagaagggaagacacttggaggggagctcgagaggctttag

SEQ ID NO: 55435 - DNA, 1365 bp, Glycine max
  Peptide Sequence Number=SeqID_147120
atggactcgttggaagaacaagtgacacagggtgagtttgtcccccagggtcgtcatgatatacttaacacggccataggaagaccagatcatggaggtcgtgttcgtgcaactgggtctggggtcacaattagtcagtactatgggaggatgtcacgtgcctcaagtagttcatccatagcattcaccaaagaacagttggctgaaatagtagtaaccgttagggaacaagtcatgaaagagcttgaagaagaaaagaagcaaagcctacaggcttggaaaaaggagctgaaggatgccatcattactgacctatttaacggagacaaggactcagcactgactaattttgacttaaatgtgttaggtgcatgcgtgagcactaaggagagcaatgctgaaattgctgtgaacccgtctggggaagtgcatgttggtcgtgtaacaccgcctatggggttgtacgtccaaagtcaaaattgtacaaagcaggtggcgttggcaaaaattcatgatggaccatccaccatacattgcgtagcgtatgcagatgatgtcgtaagggttagcgtcgaacaagtaattgatggtgaagctgaagttccattaccgacatcagaaattaagtatgtgagagatgtcgttaacacattcattgcatggccattgcctttgcattcaggcatcactccagacaaagttgccaatgctgccgaattaaacaatgatgttcctaagcaggaccccttgcgtgagttgattaagacccttgttgacatttacgacaagcctgttgagtttgtgtgggatcttactgaatttgggattccaaatgtaaattcatcgttgttcttaacgtatactgatgtcagcgaaataacatcaggcgacaaatgcttgaacatagccatacttcaattgtggaccatgtatatgaatgagtggagtaatggcttgggttatcgatcggtgtatggatttcttgagcctcaatctacacacaatgcaaaggacagacatgggcaatgtgaagaatatatcgaaaaatggcttaaggaatcgcaacgacaactgtacataggagcttatttgaatgatgcccattggcaaatggttgtgttgtgccctaaagacaatgtcgtggtctggttttgttcagtgcgtagaaggcctgatgttcatatcaaaactgcaattaacaatgcatacaagaaattaaacacgactgctgatggcaaagttcctaaaattggaccccagtggcttgaactaaagactcacgttcaacacagaggctatgagtgtgggtattatgtgatgcatgagatgtggaacataattggcgtggagttgaagagtgattag

SEQ ID NO: 55436 - DNA, 402 bp, Glycine max
  Peptide Sequence Number=SeqID_147121
atgcagtcaacggcggtctcctccgtgaaacgacatagtagccatgcatttcacgacgttcctctcccagacacgacgtcaaggccatgcattcaacgacgttcctctcctggaaacgatgtagcaagtagaccttacctttcaagcattgattgctatacactacgtcggtgccgccatagcccgaccttaaaagcttacctttcaacgtcgttcctcgtgccggcaacgccttcaaaggcgaacctgcaactacgggcctctagtcatcccagtcgcaggaatcgtgtgtttctaaaacggtggaaggagaccttcgtaaactggccggaggcctacgacgacgtctcattcaaagatggtcgtgcaccgtcgttgaactccgataagcaccgatgttga

SEQ ID NO: 55437 - DNA, 888 bp, Glycine max
  Peptide Sequence Number=SeqID_147122
atggaggcgtttggtttgcttgcaggaaacggcaagaagatgaagaagaactattttcgtatttgtcgcgcatgttctgctgtccaatcgtgttcggtgacagtagaagcaacggactccgcgtcacaccagagtcgtacccgcatgcatgtccggtgtgagtctgacgcaggacatgccgctgaagtgtcgcatccatgcttcttagctttggatattgaacagatgaagagttctagtgctaacctaatcaagcaaatggatttcattgaagataccaagggaaggctttgtgtgccaaaggaggaggtgaagattgaggtgcccccagagttggtggaagacaatttgctccctctacgttataggcctttcaattatggggattacttccaatactttgtttcaactcttaaggaaaatgcattagatgtgtttgttgttgctacgtgcacccagcaatattgctggggcactcagcaaatagtgaatggacaattttgtcctttcgcgaaggctgtctctggaagatccttcttccggaaacattccggaagaccctttctctggaaaattttggaagaaccttttttcggaagaagaaggtgtgattctggaagaactccggaatacgttatggaagaaccgaaatgtttccggaagaagggtcttccggaagacaactttcttcttttggaagaagttgtgttagtcgtcgctcttcctatttcgtcggagaatgttggatttccagaagtacttctttcggaagttactaaggtcaatttcggaagaagtggtcccggaagtaggcctacgcctctcgggaacatcatcatggtcattctgtctatctctgtctataactctacctatagcacgacctaa

SEQ ID NO: 55438 - DNA, 402 bp, Glycine max
  Peptide Sequence Number=SeqID_147123
atgaacacttgtgcgtcaagagtccttctaaaacctcaaagaggagagacaacttcgtttatcactgatatgataaaggctaatgtttctctcctaagaaccataaaatgggatgaagtaactcttcctgaaaaatgggtcatggacaaggccacactgtcagttcccaaacccgttccaaccatagaacaaataaagcaggataattccggtaaggtagaaataaccttcaatagaagaaactctttctcatctagaatagaagcctcaagatccgagtatgaattagcaataaggtctttcttgttaacatatttccttacaaattatattcctacctccccatcaggctctgatatcagagatcaacggaaagagatcaaacagacagatgagaggtaa

SEQ ID NO: 55439 - DNA, 1407 bp, Glycine max
  Peptide Sequence Number=SeqID_147124
atgccaggatggattctcgacatgtcagatggctgccaggcaaacaaatccgtgtttctatgtagcatgtcagtgatgcacctgtgcttatggctgcttgatgagcttttcaatgggttttgggcctctgtcaaaggtgtcattgtacggatctatgtcaaattcattgtccaggcttgcttggtagatggtcagggctcgaattggagacccttcatccatgctcatgacttgagtaccttcagccactataaggtgagtcttggcaggctctctggcaagaggatagggtgctaccttcaggctctctacatagcactatcttgcttgcttttggttttccttaacggttacaatttccccgatcagggtagggaatttcattttcaaatgcggtgtgaagactatggcctcaagctcattaagtgtcttcatgctgatcaaatccacgtagcctttggtctctactctctcgcctacaaggtcgaggagtggattgacataagggatgttagtggagcttccctagtcaatgagaaccttggacaccatgaagttgacaatgatgatagagacgaccatggggtcgtcctggttaacagggttgatacccttgaagtccctatctatgaaagggataggagagagacttcgttgtactggtgtgtcaaaaaaatttatgtcgatgacccaaatggcgttcctattcttgtggtggctgccactctcgcctttgttgctagtgtctctatctttcttgatcttccgttctatcccttcttctgtctgcattgtgattcctctactgctcatcttggtgtcttcctaatcttgctcctgcttggtggggtgtgtaacgctcgtatctgggcccttttggaagaggctgacacttgtctggctcgtgcctcttgttcgacttgtaacgaggagcatggaatgcaatgctacctctgggttaagatttcagatctgggtggcagtgcgcacaaatatgtccaagaattttctaagggactcgtcgtctacttttcacagactggccaaggcgacttaggttatgcagtgagatttgctggttgcgtactacacactgaagtgttcgacgagggtgtcaaagttgtctatggatctaggaaggcatccaggtgctcatctggatttgtggtcccatcatattgttcgaggttgagtagatttcacctcaaggctcctcctcatgtcgtcgctccatctccacaatgcgattttggagttgttgaagagccagaccgagtgctaaccatggatgaacaagagatagttgacaagagactacaggatatgttttaccacggctccacggtgggcgccaaatgtacttaccaaaatttggagctggcacacgtcaaggtggacataactaag

SEQ ID NO: 55440 - DNA, 282 bp, Glycine max
  Peptide Sequence Number=SeqID_147125
atggtttcaaggtacgttttaaatgagattgctgctgagtttgagcgtgtacattatgctggcaagaatccttcttcttgtggttgtgtcatgagaaccacgcacagtcttccttgtgcatgtgagctatctaggtatgttgttgacaacatcccactagattcaatccatatgttttggaggagacttagtttttcagaccaagggttatgtgaggccaaagtcaccatcaaggaagagactatgttgaaaagagactatgtcgacctaaatgaagactga

SEQ ID NO: 55441 - DNA, 765 bp, Glycine max
  Peptide Sequence Number=SeqID_147126
atggctcagcataacaatgccaacattaacaacattgtgagccaacaacagcagctagtgaagccaatgttccatgactttcttggcatcaagaacaagaaccccattgactccaatgtcctttatgcccctaatctccacgtcacctcctcctcctcctccctctcttccaccaccgtgtcccgcggcggtgccacctccgacctcgcttccggactagtgggaaacaagagaaataattctgattccacttttattggttcctctagagattccttccaaatggtccctgattcccttcaaaattcacatttgataaagatgctccgaaacgcagctggaacggattgccttagatgtcctaatgacgatgaagtgctccttggtatgcagtcactgaagccagctagtggttttcagatattgcagcctcccactggcactaagaatgatgtcaataaatgggaacaatctattctcatgaatgttggccattccatgcagtatctacctcatggtggtcaaatactgctttttatggaccaaataacttcaagcaagatgagggataccaatgctggttcttcatttatctctcagttagctgctgatgaagggtctagaaccggaatcaagggcactgggattttgagttccataagcacaatcaatgcagtcactgagaaaacttcatctattcttggtggcatcagaccaaagcctgtgactaacatagacccagagtcttccacacctttgaagtaa

SEQ ID NO: 55442 - DNA, 294 bp, Glycine max
  Peptide Sequence Number=SeqID_147127
atgtcacattttagagttagtgatatcatagtgacgaggcggatcgttacaccacccagcttccctcttcctcctcctaagtcagctgcacctttgctgtctatgttgaagaaaacaagaaaagcaacagggctcgtatcattagctacaagacttgttggggcagagggaccaatgattcacgtggatcctgtcactgggaaagccgatggtccccacataaagaaattaagaacgtatttggggatcgtcgctcaagacaaggtagatgttacaattgataattggaaataa

SEQ ID NO: 55443 - DNA, 72 bp, Glycine max
  Peptide Sequence Number=SeqID_147128
atgtcacattttatagtactaaaagaaaaagcaagagcaaaaaaggccataaagaagaaggcagaaggataa

SEQ ID NO: 55444 - DNA, 186 bp, Glycine max
  Peptide Sequence Number=SeqID_147129
atgtatccaagtttacaaccatttcccccaagaaaagtggacatgttacatacggtgacaacaatattagtaaaatctcaaaagaggcaacatctaagccatctctatgaattaagttattggaagttgaaagttaaagagaagtggaagttggaagttgaaaaagaagttactggattgagttga

SEQ ID NO: 55445 - DNA, 698 bp, Glycine max
  Peptide Sequence Number=SeqID_147130
tcgtcggtgctggtgagatcactggagagaagagaggagttgttgaatggtggttggaggcgttgctcaggatgaggaagatgaagcatgaggaggtggtgcagtgtgattggcttttgagtgagggaacgacaggagtcagtttgaagccgttgtggatggtggaggaaacgggtacatcctttgtggtacaagtagagggtacatctacttgggttgttgtaactgagaacaagaaagggtacatctcttgtggatcagttcaagtggagggtacatccacttggttgttcaaagagaacaagggagggtacatcccttgtggatcttttcttgcttttggacaaatgtacatcaaggctcagataaacttgaaggtgctggacaactttcccaaggtgtgggaaccaaagaccatagtcatccaggaagcaagagatctgaaaaatcttgtctgggataagcgattgggcatcttgagagtccgtgaagaatctgatgaattagacaactctgatggatccatagatgatgaaatggccctcgtgtctagaaagttcaaacagatgatgaagaagaaaggaaagtttcaacactcctttagacgcaaggaatcaagattcaaaaagaagaaaagggaggaaaacaatgagatcatttgctttgagtgtagaaagcctagacacaagaaggcttaa

SEQ ID NO: 55446 - DNA, 474 bp, Glycine max
  Peptide Sequence Number=SeqID_147131
atgcagtcaagtgacagaagcccaagtaagcctaagcctttggtaattcatttcaccagagatattagcactcagatacctcgaggtttccggccctctgtagcaaagacgccagcacccttcccttataagagtgacaaggcagtaccgtggaggtatgacatacagggatccgatgaaaggcaggatgcgtctgtcatgcgtgttgggactggcatgccggctgctaagatcatgaatatttcgggtacaagtggcatgactcgtagtggacgtattttcgctcctcccgaactaccagcaaagttgaaagacaaggggaaggcaaaagcagatataggcgagagggagaagacgggcttgaccgcgaataacgaggcccttgtcggaaagtttgaagaggaaaaggatgaccttagcaagagggagatatcggctgaggaggcaaccaaatttttgagaatcattcaatag

SEQ ID NO: 55447 - DNA, 240 bp, Glycine max
  Peptide Sequence Number=SeqID_147132
atggaatggataaggagagagaaaggggcgagtttatggagggctgaatggaagggatttggttcaaagtttgaatgtatttggatggagaatgatgatgataacgatggtgttcagctgggattcaaaggctggaagggaccagtcactagaggcatgagcaagaggctccaagaggattgggctagagctgctgaagaaggccctagggttctcacaaacctcagggtagatttctga

SEQ ID NO: 55448 - DNA, 636 bp, Glycine max
  Peptide Sequence Number=SeqID_147133
atgcaagggataacttggctccaaaagctaaaggggatgaatagggaagaggcagaagtgcctgaggtgcaagatttgaaagatgagctcgaaaagacaagagtagcaaaggaaaagctaaaggtggaagtcactagagttaggaaagaatgtaatgagctgaaagatatcaacatgaccgcggctaaagttctagagcgggaaatgaaaaaagccagaaaggaagagtggagtaggaacaagtttcgaggggctttgttaggcagcagtattgagctcaaacttagaaaggccgagagggacaaatcaaggatggagagcatgatgttagaggacaaagaaggtgaactagttgctagttacgggcagatactggaagatgaacgggcgaaggtgtcggccttgcgggttgaaagggaagcgagagaaggggtgatagagttattgcataaagaagccatgaaatggatggatagattttctctcactctgaatgagagtcaagagcttccaaggttgctagccagagccaaggcggtggctgacacatactctgctcccgatgaagttcagagtcttttcaattattgccaacacatggttgaactaatgacccacataattaggaatcactaa

SEQ ID NO: 55449 - DNA, 232 bp, Glycine max
  Peptide Sequence Number=SeqID_147134
atggcgacaataagtgaagtgacacatagagaatccatccacaaggttgatagtgacacatggattgtaacacttgtggcggggttccaaggttcaggagttgagagaattgagagaaaagaaggagaaagagagaaaaaagaagaagaaatgaagccgaggcactaccgaatcacgaccgtgatcattccctacatcgttctcttgttttgtgttcctcatgcaacagtcg

SEQ ID NO: 55450 - DNA, 279 bp, Glycine max
  Peptide Sequence Number=SeqID_147135
atggagaagcagctacacttctttcatcagcttgtggatgtattgccatggattcaaaaaccatcccaattaactttgatagttggtcaaatgttccaaaatcatacaaggatggttgctttaatatgtgtttatgatacttcactatctagagaacaattaattgctaatgttcctaatggaattcacaaagatcagtggtcttcattcattgattatcatctaaggccagaatataaggaattatgcaagaaaaatactgaagttagaaaaaagtga

SEQ ID NO: 55451 - DNA, 4809 bp, Glycine max
  Peptide Sequence Number=SeqID_147136
atggaaggcagagcacaaaactccaatgacactacaattcccaagaaatcaagatctctggatcttaaaagtctatataaatcaaaattgacagaaaacactgcaaagaagaacttaaagaggattggcaatagtagtgggggtggtgatgagaagaggaagaaaaaaaaggctagaaaggaagtctctttaagtagcttagaaaatggtgatggtagcagtgagttgaagttaggggtgagtcagaaattgagtagtagtagtagtacgcttaatagagtttcatttagtgttggtgatgatgatgttcagattcccaagaggaagaggagttttgtggggaggaagaaatcagaacttggtctagcatcaaaagtggtggagcagtctggtctgaaaattggctacaacgatcaggtgccaaagttaggtagtgatgatttgggcagtggggttgagtctttcaagattaagcgtaagaaagaatttgatgaatttaaggaaaataggaatagtgattcaaattcagttcagcatgctaaggagaatggggattgtgcatctcattctgttgtaaatagtggtgattcttctttatcaaagtcacgaaggcagcataggaagcgaaaggcttcagctatagatagtactaaggtttccaaggaggctgaacctttggtttcaagtagtaaaatatctgacgatttgcaagatgaagaggaaaatcttgaggagaatgcagctaggatgctatcttcaaggtttgatccaagctgtactggattttctatgaaaggttcaaatggtttgtcctttttccaatcttctagtcaaagtattgttaaccacagtttgaagtctccgttaggttcagaatcaacatcagctgatactgctggcagagttttgaggcctaggaaacaatataaaaacaagagtaactccaggaagaggcgccatttttatgaaatccttttaggtgatgtggatgcatattgggtactaaaccggagaattaaaatcttttggccattggaccagagttggtattatggtctcgtggataactacgatgaaggaagcaagctttaccatatcaaatatgatgatcgagatgtagaatgggttaatctccaaactgagagattcaaactcttgttacttcgtagtgaagttcctggaaatgcaaagggtgagagagccttaatgaaacgtagcagttttgatcaccagaaaggaagcaaatccagaaaagaaaggcaaagaacagaagagaatgcaggggatgatcgttgtggtgagagtagtatggactcagaacctataatttcgtggttggctcgatcttctcatcggcttagatctatccaaggcattaagaaacagaaaacttctgttacagttccaagtacaacgtcatcattcttatatgatgaacctgttacggcaaaggggcatttagctaagagttctgtgagggatgttgaaaagaatttctctactggttctgtatcacaagataaattcagtgaagattttaaggataagtcttcattgcaaagtgtcacttgcgctaaagatggaaaacagcctattgtctatttcagaaggcggtgggttcataagccagctccaatatcccctcatatctctgaagaaaaccatgctattataagtgcatctggttctgttgccttggaccatatgtttggtggggttgagaatgtgaaaaatccaattgacagcagggttgaggtcgggggcccattgttcttcacttacaaggcaggagtaccaaaagtcttttgggacatgaagtcagcatcattcaaatttggcttaaactttccaatgcgtttggttttgaatgacttttttcaatcagaaaatttgtggttgctttacactgttttgctgcttcggttcggtacagttatggccaagtggcctagagtttatttggagatgctttttgttgataatgtggttggcttgaggtttctattatttgaaggctgcttgaacacggctgcagcttttgtcttttttgtccttagggtgtttcatcaacctgattgccaagggaagtatgttgacttgcaatttccatgtacatctattggattcaagttttctagtgttcatgttattaagaagccacttgtgtttgagttctataatttctctgaagtgaagaattcaaagtggatgcacttggattctaagcttaaagagcattgcctgctcagtaagcagctccatctttctgaatgcacatatgataacatccaggcacttcaaaatggatcaagaaggttctccataacttctatcagtgggtcttcctcagtcaaggtcacgcaaaagagtaggccagggattaacatcatgggtgtttccgaagtgtccactcaagctgttcagtgttctgatgctggcgagaggaaacttcctccatttgctctctcttttgctgcagcacctacattttttctttgtttgcatctcaagttgctgatggagcagtctgcagctcatataagatattgtgatcaaacaccaatatttgatcaggaagaccctggtttgatgacaaatggatgtactagcaccgataattgctcaaacaggaattctgaagttattcttaggaagggtatggagactttgtcaattggtactccaggtgatggagggtcttgtgctgactcagatcatccctctacttgcaatgaccgaattctcattcaaaattaccagaacattggtcttaacggtgctagtacttccatttctcatgattctgagaagctttgtaaagctcacttacctgaatggcaatcccaccatttggagcaagagttaggctctttatcttcaagttctttaaaacatcttgataaggctaatgatggttctcattcttttattggtgatctcagtattcaaattcctgcagttgatcaatttgagaaacctgatgaagatggtgatttatgtgatgctgaacactctcctgatatctcttggaatataaatggatgtggtattccaagctccaatccaactgcacgcagaagttcttggtatcggaaccggaataattccttgtcattgggatttcagtctcatgtgtggtctgatggcaaggttgattctctttgcaatgatttgagcaatggacctaaaaaaccacgtacacaagtatcatactcagtgccctctgctgggtatgaattcagttcaaggcagagaaaccatcatcagaaagggctttctcataaacgagttagaaaggccaaggagaagaagtcatcagatgttgatagggtccctgaaaagaatatcaaatgcttatcttgtggtgcaaatgtcttgattactcttggtgataagggttggagagaatccggggcccatgttgtactagagctgtttgaccacaatgagtggagactttctgtgaaacttctaggaattactaggtattcatacaaagcacatcagtttctgcagcttggatcaacaaatcggtacacacatgcaatgatgtggaaaggagggaaggattggatcttggaatttcctgataggagtcagtgggctcttttcaaggagatgcatgaggaatgctacaaccgtaacatccgttctgcttcagttagaaacatacctattcccggtgttcattttatcgaagaaaatgatgctaatggatctgaggaaacttttgttcggagctgtatgtacttccaacaagttgaaacagatgttgagatggctctggatccatcttgtgttctgtatgacttggatagtgaggatgagcagtggatttcaaatgctcaaaattctttaaaagacaacagtgaattttgttggatctcagaggagatgtttgagaagacaatagatgtgtttgaaaaggctgcatatgctaagaagcgtgatcattttactcctgatgagatagaggaactcatggttaatgttgggcctttgtgtgttgtcaaaatcatttatgaccattggcagcagaagaggcagaagaagggaatggctttaattcggcactttcagccccctctgtgggaaagatatcagaaacaagtgagagagtgggaactagccatgaccaagaacaatgccccttctaatggatgcctggacaaggttacaactttggagaagccggccatgtttgctttctgtttgaaacctaggggtctggaatcactgaacaagggattgaaacatcgatcccaaaagaagatttcagtctctgggcatgcaaacagtaatctagatcaggatggcttccacactttcagaagaagacaaaatgctttaccttttgccgatgaaaagttcctataccaaggccacaattacgattcttttgatgattcatcattggctctgacctcaccaagggtattcttacctcgtgatgctggcagcttgaaatactatcttactagtaatggagcaggatatagaaatcatatcccaaaatttcacaagtccagatatgattcacctggtagcaggcatcacattcttgctggccctaagaggcaagggattgaacagttggatgcttcagtccttgaggagttaagacagcgtgatgccatggctgaggctcgttttaagcgtcatgtggctatgctgaagagagatagggctaaaagattgctatataaagtagatgtagccattcacaaggccatggctgctctaatgactgcagaagcaatgaaagcttctgaggactcccttgttgaaatgaaagcttatgaggactaa

SEQ ID NO: 55452 - DNA, 324 bp, Glycine max
  Peptide Sequence Number=SeqID_147137
atgcacacacaaagtttcacaattccacactttcctaaaataggcctaactcacaaaaacagtcctcagtggagtcaccaactgtcgcaaccgacccttttgcgagtaagcgaggcgaggctcactggtgcgtcttccaaaggaggaaaatgcgcggagtcgccaccaacgtttatttgtggaaaacgtcggaaaaaccgaaggaaaccggtcatgaagaatattccagattcaggagttgtatttacgtttgaggaaggtcgacaaaagcggggctcttgctcctacgtaccctccatcgaagaggaaatcagacctacgtag

SEQ ID NO: 55453 - DNA, 129 bp, Glycine max
  Peptide Sequence Number=SeqID_147138
atggataagagcttgaaggtaggagaagatgagtggagggagaaggagagaaggagcacaaaattttatgcctcaaataagcccaataatccaagatcaagtccaagattctccactaagtgtgcttag

SEQ ID NO: 55454 - DNA, 285 bp, Glycine max
  Peptide Sequence Number=SeqID_147139
atggatgaagattcatggtcattggtgcgcaaccatttgcttaaagaactttccaaatggtctgatgagtatgtcaacctctttggtggcattgacagatttgaggaattaaagaggtccctacttgttgatggattattcatggttaccatggataagtggatggatatcaccgacatgggatatgtcattgcgtcaagatataatgtttatttaagagaccggtgcccgttaccgcctctagctttgttatggtctaggaattgtcattctcaggcaaagtag

SEQ ID NO: 55455 - DNA, 294 bp, Glycine max
  Peptide Sequence Number=SeqID_147140
atgtctaagctcagagaaagagaagacccaaaatttcagaagaccaaaatggacatagaaagcggcgaaagatttgcaaagaagcaatacgaaagaaagaagtgtctagcagtgacacaaaagagacagacaggaatagaaaagaagcttttcgctgggcaagggaaggcaaagttccagattagttttcactgcacggaggccggctggaaaagttcgagagatgtcgagttccacagggcttcactgattcaccgctttctagctgcgtgcgacagagttccagaggtatag

SEQ ID NO: 55456 - DNA, 192 bp, Glycine max
  Peptide Sequence Number=SeqID_147141
atggtggttgatgaggtgaagacgaagagatgtaacgaattacacacaacaaacacatgtcaagtgagattgatgcaatcctaccccgcaagggcattggatagaagactccaagtagattgggccagagatccaagggaaggccctagggttctcatgagccttagggtagatttcgagcccatgggctaa

SEQ ID NO: 55457 - DNA, 926 bp, Glycine max
  Peptide Sequence Number=SeqID_147142
atggctaagtttgacccaaagatagtcctggagttctatgctaatgcttggcccatagaggagggagtgcgagacatgcgttcatgggtgaggggtcagtggattccctttgacgcaaatgccctcagccagttcctgggtggcccgctagttttggaggaaggccagcagtgtgagttcaaccagaggaggaacagggtgtggatcatgcgcaccagcatgaccaccttgacccagacgtggatgatactgctgctcagcaatgtcttgcctagcgataataactccgatctccctctgcctaagtgccagttggtgtatgccatcctgacacggatgagcgtccacgtggcccaagtgattgctgacgccatctatttgtttgcaggtatgccacccaccaggcaccctctggacccggataagtctaacagggccctggggtttccggggttgatcacgggtctctgccagtcattcggggttcccgtcacccccagtaaggtgatccgaccgccgatcacccgggccttcatcgagaagtactgcacgcctaggcaggcacagggtgatgcacatcaggccgcagacgcactgccaccacctcatcagaccgatcccgttggatcactaggcatggagcgttatctacaacacttggttcgccagcaggcggccaaccactgggggcaggtgcagatacatgagtgtctctaccggttcagccttagtcagcaggggcagggtttcgctccttttgcatgtcctactccaaagcaatttggggctgaggtcgcatggcccggagattggcccgaggcccaggcaggggaggagcctgcaggatcccccggtgaggcagaggaggcccgtatggatgaagaaatgacggacttgctcggtttcttgggaggaagcggagccac

SEQ ID NO: 55458 - DNA, 1773 bp, Glycine max
  Peptide Sequence Number=SeqID_147143
caatcagtgagcacattcagcgtgacctgtgtttggcaaggttcggcggatttcgccgttgagcatcacgtggagtcgtgctcgtttgggcctcacaaggaggagttttcgtgtggtgaggctcccacggttaagctccgcctccgtccctttgtgagcttgaggagggggaagttggtgattgatgcagttttgttgcatccaagtttcttggtggtgcagaggaaggactttacttggttgggaatacccttcaatgaaggaggcagggagagaagtttctcggctgaagaggggatagattatcgcacgagaactaggaggcttgcacgagaggaagcctttgctcagtgggaaagagaaagggatggtgcagctagggaagctgctgaggtggggtactttgtttctgagcggagttgtggtctatccaaaggtgatgatggtttaaaggagattgaaactcgatcgttggagtcaactgagtctgcgccctttttctgtatgaatgatgggaagcacgatcattggttgatggacaaaggtgttaattatgatacgaaacacacagctttggaaaaatcatttggagtaagatttcctggattgggacttcgattttggtccagagtaatatcagggcttaggaaacacaagttgaataggaaggctaatgggagtaacatctttgcatctggtggtgctatcaaaaagataatattggaacgtagtgcatcagctgctcatgcatacttttgtgatcaaccacaatggaagtttgaggagccttcatcaccttctgaaagttatggttttatgagtcatgatatgcatttggtgaaaagtgaggttgacagaaatacaatatctgttattgttagtgatgaaaatagaagtgatgataaccaaagtggaacacaattcaaagatctgggattccagtcccccttagtaaatgaaaatgttagcagtcaatcagattatttaaagtttgtctgtgattcaactttacggacaagagagagtgaaattgaaaatttgcaatctagtgatgatgttgcaaaacctgctaatccaaatagtagtacagtgaaaaatgaggagtttgtaccatatgttgctgagaatcaaattgatgataatgatagttcatcagggggccaacagggtttgccatctgaagatttgggtattgtgaagcctgagcctcagttggcaacttattttcaaaatccatttgagcacttgctctctgatgtgggtctgaaagttgaagatattgtttcagaacatgttgatggggtagattttgtgcagtctgaaggcgttacgaagactctgcctgttacgctggattcagttcatttcagaggtgcaacactgatgctacttgcatatggtgacaaggaagttagcaagctgaaggcggtggctggaaaacacgctgaaaaaggcagtggcagaataggggctaccaccatatcaaaaagcgccgtcgaaacaacagccaaacgtgcgctgtcatgcaccaaaaataaagagaatcatgcaaggaaagggggttgcatgcactggcacgcgcttggaataggccctgtttggctgaagatagcacgtcagaaaagcagcctgtgtgggtgtgttagagctttgatggacatgtggtggccagatctgggtagatcggccctaggcgcacctgatccgggttgtcggaagatgggtgacgagcagaaaggtccacggggatgtggaaagaaggacgacaaatag

SEQ ID NO: 55459 - DNA, 264 bp, Glycine max
  Peptide Sequence Number=SeqID_147144
atgaaaaggcaaactgaagctttaatggatgcaaacaattatggttgcttatatgaggctttgactgttgctgccatgttatcaactgaaactacattgctactagggcagaggaagattgagagtaagaggaaacatacaatatctaaccttcctgatggttttggattgggtgatcacattcaattgctgcagatatatgagtgctgggatcaaactgattttgacattggttggtgcaaagataatggcttgaaggtgtga

SEQ ID NO: 55460 - DNA, 477 bp, Glycine max
  Peptide Sequence Number=SeqID_147145
atggcttctgttggacctgctttctccttttttggaaccccaaccatcacaactgcaaaacttaattggaagaactatttgtcttggtcattcaaaacttgtcactccttttcgaagaaggcccaagaaatctttgctaatgatatccaaagcttgtttgatgcaatcatgaaggttacaaccctcaagcaaaccagccatgacatgattgcacatgtaggtaagactcgggttgtaatggaagagttgagaaagtttcttgtggttgattcattggaagaagtgaacagaaaactggacaaattctatatggtcctcatcttgagaagcttacattcagactttgatcatgtgcgtgatcaagtgcttgcaggggaccaagttccatcaatggattccttcatcactagacttcttcgtgtgcctcatgtattgaaggatgaaaaccctgctgatgttgtggaaacatcagccatg

SEQ ID NO: 55461 - DNA, 192 bp, Glycine max
  Peptide Sequence Number=SeqID_147146
atgaacttgatgaaattgttgcaagagcataatagaactttcataaactggtttaacgaaacaatcatcagtgatgataatgcttccaaaacattaagattgttgactattggtccaaatctaaatgtccccacttggaagaggttaatggaaataccggtgttcatagagatcaaatgggattcactttag

SEQ ID NO: 55462 - DNA, 2230 bp, Glycine max
  Peptide Sequence Number=SeqID_147147
ggtggacatgactgaattgggctcctggacttcacacgtcggctttgagaggactaacgtggagggtggacacatgtctcagagtgccatggcaccacttcaactcctacaagttatcgaagagtctgtctccctttataaatggagtggacgtttgatttcgggtcactgttccttctcgaaatttccttatttccttgcatacgggcatcgcgccggattggtgggggcacttctcgcccttgctgtgcgaccttcctttattgtcggggagcctgtcccgattaatgtgatcctccttcttctgcttgtgaagttggcgagccctgaggactcctgcaagttagttgttcaagcttctgggagtgatgacttccctttcttgagggcggcgtcgggcagtccaccattcttttttatgtacagggacaaggagccccgcttctcgttctactggtctgaccttatcaggttcaagttatttgatgaggatttattgaccttagtggaaagggtcgataaagctattttggagcaactgccaacttcactggaggccattccctctcttccttcggcgagcgatcctcttgctgccttggatggtattatgggtgacttcgcctggagaccactcgtgaagcaggtcagacctacaggtgggattattccactgtttgttgctgtttctactgttagagaaaggggtcaacatgttggtgaggttggccctatttctattgttgctaaggttgaccctagtgctcattcctctattttggcaaagtggaagtgggatgatggtgctgggccatctggctgtagggttgatgcccagtgtgggtcgccctacgatcatgtaggatatgcctccggctccccagccatcgaggcttctgctctttcacctcgtcttgctgttgctgttcaagaggccaatcctgctattgctgaatgtgcgaccactaatgctcctatggtgctgccttcaatggtccctcctccctccactgttttggtggcgatgccaccttttttgtcttctcgccctcgcgtctccttggatcatttgtacacctctagtgatattgactcactatgggatgcaacttacaagccaaagcagaatgccccagttggctttgtgttaggctgtgataagaactttattaggtcagctggggagaatgaacaacggcaccaagaggttttgcacaaggtggcatccttggaggcagaggtcaccaaatggagggctattgctcgcactatttggagagtaaagtgccttaaggtagctaacgccatcatcgcctttcctgaggccataaggtcaaaccacctactgtcttccaaagttggtgttatgttggccaagttgctgcgcaccaggttggatggtgatgaattgttcaaacgctgcaaggacttgcaagtggagaaaaaggacctagttggcaaggtggagaacattgcgactgagaagggcaagcttgcaaaggtggttgctaatttagaggcccgacttaaggattcggagtccaggctaaaggagtctgagttgcgggctaccaaggagagggaggccaacaaagagcttgaggaggagcttctcatttacaagaaggaggatgtgaaagatggtgtcttgcttgatgaggaaaaaattcctccaaaggaggaagctgttgatgaggagcagggcgctacaaagtttgatttcaacctggttaaagatcttgccatccatctagtggggcttccatctgctttacggagcttctcccctaatgcttgtgaggagagtatgtttgacttgcccctagttgaaggtcttgccaaccagtctgggggtaggtcgcttgacctgcaaagtttctcctctgatggttatgatgaggcggaccttcggttttgcaagaatgttagcaagggtggaccttgggtttttgatagacttgtattcttgcatagatacaagcgtaatggtgtactcttgcatacgtgctttttacaagtggcacgtattggagccatggtgccctttggaggatcgactagggaattgtttgacctgagttttgggcgtcgtgctgttgcatacatgtcactcgctatgggttgcacatattggagacggggtgacttagtgctagaaggaaggctcatcaagggtgatccttgggttttaagagccttggagctgcgactatggatgctcttgtcttga

SEQ ID NO: 55463 - DNA, 882 bp, Glycine max
  misc_feature (59)..(59): n is a, c, g, or t
  Peptide Sequence Number=SeqID_147148
atgccgtatgctgacttgctaccatccttgatcaccaaccagatggcagtggtgaaccnctgggaagatctaccaatctcccttccctcgatggacaacccgaatgtaaggatgaatcctcttgttagtcattggggatcaacagttaatgcggcggaggagtgtggacctcggggaccgaagcggatggaagatgtgttaacctttaggaggttcatattggaagcgctgctcgaagcgggcatggtttgccttgacggggacatgggagattcttgtttggtacatccgggagcatcacacgatgtagaggcatgctcgatggtggaggacctgctacagaggataatggacaaaggcctaattaaggtttgtggctcgagaaaggggggaggtgatgtgtgcatgcaatcagttgataaaagcccaagcaaacctaagccattggtgatccacttcaccagagatgttgctgcacaaaagcctcgaggtttccaacctgtcccagttgagaagcccgccccttttccctacaagagtgacaaagcggtgccatggaggtatgcctcacaagggcttgacagaaggaagtacgcatctgttgtacacgttaaaggtgatttatcctctgctaaggtcactaacatctctggcacgagtgacatgacccatagcgggcggatcttcacgacacttgagtcaccagtgcaatccaacgacccaaaggggaaagcaaaggcgggcatggaagagagcaataatatgggcccgattccagatgaggaagtctcgactggaaggtttgccaaggaggaagtcgacttcagtagaaaaggaatatatgctgaagaggcaatcgagttcccgcgaatcatccagtag

SEQ ID NO: 55464 - DNA, 231 bp, Glycine max
  Peptide Sequence Number=SeqID_147149
atggctaagtatgatccaaaaatagtcatggagttctatgctaatgcattgcccacagaggagggagtcagagacaagcgctcctgggtgaggggccaatggatcccctttgatgaggatgccattaatcaattcccggggcatccattggtcttagaggagggccaacgctgcgagttcagtcagaggagaagtcaggcctcagggttcgataaggaggccatcagctag

SEQ ID NO: 55465 - DNA, 612 bp, Glycine max
  Peptide Sequence Number=SeqID_147150
atggagtccgcaaattcaaagaaacaattgatgtataccaagattcaaacctataggggaatgcttcttaatccaacaatgaatttaaggaatcgcctgggagtaagtggtctgattgcaaaggacaaaatgcttgtctacctcattacctacattctcactccgaggtcaagtaatcacgctcagagtcatcatttagtggactatgaatttccttatgtcatgcttgcctcaagattcattgattacttcaatgtcaatgtatctaatgagatagtggattttacaaaagcatctagtgagattaccgaaaggcatctcaagatgtttggaattaggtttgtcgaccatgagtggataatggctggagaaccagcagcaggaaacttagaacagatggatgaagaagttgaagctccacaagagcctgcacaccaatggattccttttaagtctctcattattcagaagatggacactatgtttcacctccatcaagagcactcagctgaagttcacagttcgttggagaacataacaacctggctggaaaacatagaaactaggctgacccttggcaacctccttaaccccaatgaggatgaagcttag

SEQ ID NO: 55466 - DNA, 277 bp, Glycine max
  Peptide Sequence Number=SeqID_147151
atggcattagcgaggagaaattggcacagttttgttagacccgtagagacccctcgtgggaggatgtgcagaaaaggcacaggccatccagacgcaaaacatcgccccccacgtgttgtctcgtggggcactgaggctgtgattgaccctccatctcccatcagacgacacgtgaagtggaagatggcccgcaccaagaaaactgggcagatgacgactaaggcagcaaaggaaattgatgagaagattgattctttggaggagcaggcgtcacagg

SEQ ID NO: 55467 - DNA, 549 bp, Glycine max
  Peptide Sequence Number=SeqID_147152
atgtcttccaaacacaaacccaagtacatatattttgttgtgccttcgtatagcgtatttttctattctgatttgcaggacccacctatgttattcgcattcggtatgacataccaatttaaggtcgtatttcatgttgataggaatatcattgaggtaccctctgtttatcataaacaatgggctccagattacctggattatgtggtgttggactacaatggaaagaagcaccatataagagttagaaaatttagtaaccgagtctacattgctgatggcctcaaacacttcaggagggatatgagaatatatgaaggagacgactatgttactgtccttggtgttcgtgggcatcatcacttttggaagttgagtatgcataatgggcttaaatgttttgctgagccatggttccaattcttaacagaaaacgatttgatggccagtgacgaagttgtcttttatttcaagccaaatcaacttctttgggaggtcattgccagaaagcaaactgtgtgggacgaggacgaggacgattccccatga

SEQ ID NO: 55468 - DNA, 424 bp, Glycine max
  Peptide Sequence Number=SeqID_147153
atgaagccaaaagtcatgtctcgcaaacaaaacctcctatgtgaactgcatacaaagaaaggtacttggaagattgtcgtgcgaataactgatatgtggcgtcttaacaaacataatggtcgacaatccattgagatggtgttgatggaccatacgggtacaaagattggggcaactctatggcaagaattgttccctgaatttgaacccaagttgcgttgtggtggtgcatatgttattcagaacatgaaggttgttgatactcattctgactacaaagtgaatgcaattaaatatttggtttattttgtgaagacaacgtctgtcaaagaggtggacagacctgagattcctcctaatgttcatgccattacttcatttgctgatataatttcaggcgttgcaaaacctgatactttagttg

SEQ ID NO: 55469 - DNA, 159 bp, Glycine max
  Peptide Sequence Number=SeqID_147154
atgaaggttacaaccaaagtagcgtggattatgaagattctgtcaagcaactatgcacttctaagttctaatgcattgtgcacctgtgatgcatttctcaattctcatgctgtagcaaaggggtatacttaccttgattgtccaaatggccatctataa

SEQ ID NO: 55470 - DNA, 477 bp, Glycine max
  Peptide Sequence Number=SeqID_147155
atgggtaagggtacgactggagtgtatgatatgaagacagaggcgatggaaaagatgttacttgattgttatcttcttgatgttggtttccaagggtaccctcacactttgaagaggggtgacctagaacaaagtttggatagggtggtgataaatatgcaatggagaatgttgttcccagatgctatcatttttcacctgtcacagtttaagtatgatcatcgactcccattggtggaattagatggtatttgggaatttttgcgaggaaaaaaaggcttgataaggaagttgaacaacctaaatagaaggttgggttcttcaaggaatccacaggtcatgcaagaaatggagaggatttggaaggagtatgaggaggctttggttcaggaagagttgttatggtttcaaaaatcaaggtccaaatggctctctttggaaatcgcaacacgagattcttccatggtaccattgtga

SEQ ID NO: 55471 - DNA, 180 bp, Glycine max
  Peptide Sequence Number=SeqID_147156
atgatagctgcttggaatcacaatttgatgctgatgtctttagtactctctgagatgcttctgtggtttgacagatgcaacaagttattgatgaggcaatatactagtaaggttgctaaggtatcatcttccttactcaaaatgttttggggaattaatgacattgtcaatagcctttga

SEQ ID NO: 55472 - DNA, 327 bp, Glycine max
  Peptide Sequence Number=SeqID_147157
atggctcacctcgacaaggacctcactctcttggtcttgcagtactttaatgaagaaaatttgaaggaagcagcacgctcgcttgggcatgaaagtggattatactttgacttgaaatattttgaggacatagtgcttgagggaaggtgggatgagactgagaactatctttcagtgttcacaaataaaaacgacgatctcggacacgttcaccgttggatcgtcgtgaaatttgaccactacgttcgtagcccaatttcgagcattctcaccgttgggaattctgatatcgtgtttgagctgagagaaatacctttcgcattgtag

SEQ ID NO: 55473 - DNA, 1134 bp, Glycine max
  Peptide Sequence Number=SeqID_147158
atggtgaatgcaattgggttaaatgttggaaagaagagaaaaggtagtgaggatgatgggatggcattgaaacgtgttcaaaagaaaaaagagttgcttgtagagactgatggagatgtgttgagtgctaaaaacgatggcaaaggtggtgaggaaaacagcaacattggctcactgcttcagtcaatagagaaaaacataggagcttttgatgaagggaagagtgaagaacggaatgggaagggtaatttgtcaagagaaaggaagagaagcaactcaaattaccaaccacaagatgatggggaaacgattattgatccaaagaaaatccaggctcctgtgaaggaagtcctgtctcaagtcctcgatgcagctactagtccactaattcgtagggaaggcacttctcttgaccaatttgttgactttacttatgccttcagaagttccttatatagccagggatcattatgcgaattatacaagaaaaatcaacctggaaggaagagaaagatgctagaatctgaagaagatggaatgttgaaagaactaaatctgtctactgatgaacatttatcatcactgaagcaaaattatgggccaaagaagagaagaaaggaaactgcttccggcaagaaggggaacgaggaaaatgctgcaggattctctatgccttcaagatctgatcttgtctcggtgtttagcaagtttggagctctgaatgaagcagaaactaatatgttccgcactaactacacagctagagtgtccttccttcgaacttctgatgcccagaaggcatataaccattcccaaaacaataacccttttggatctcctgttgatgtaacttttcagcttctgcattcctctgatgtgtgttgttgctcctatagtggatttgttttaactgaagggattattggattgcttttttcacggagtcctgcaacactaagtagtggtgtgctctttgagggtggtttactattcctcaacagctttagcatgaagagtacaaagagaaacatcaacccaattgccaacatggttgggattccaatacctaaatcagtgcaaatggggcaagacaaaatttctgttgacgatactaagagaaataacagtgcatga

SEQ ID NO: 55474 - DNA, 513 bp, Glycine max
  Peptide Sequence Number=SeqID_147159
atgtacttggaggagatgaaagagcaagaactaaatggttctgaggagaaatcaagcaacagtggtgaagatcttgctacaatgttttcgggtaggaatggagtttccctcactgttggtgttcctcattgtgacacattaaaaggaatacaccaaagctttgttgcaaaccaaaaaattcaactagcaagagggttggacgttggtgaaccaaaccagtttggtgcccaattccagttccaagttgacacaattccagttgtcacaactaatcatagacgacatgctatgctttgctgtgctcctgagcagaagttgaaagacatcttcgaattcacaacagcatggtcggtggtgcacttcgccaggagttggttatactggtctgcatgtctctctctgtctctatctctgtctctctctcacaacagcaaactccaacttatgtccaacaaatatgggatctggccactcaaccaggttggattttatcctgctttaatttacccttga

SEQ ID NO: 55475 - DNA, 213 bp, Glycine max
  Peptide Sequence Number=SeqID_147160
atggtcaagccccaaagcttacctagcctcaaggaggccgtgaagtccaagcccaagaagaagaagagaaccaacatccgatgtagcttcttgtggagcttatcaatgacagcaaaatggagatggaggaaaggtgattggagatgtcacttcaaggagaagatgagtcaagaacaagctcaccatcataggaagccatggataagagcttga

SEQ ID NO: 55476 - DNA, 819 bp, Glycine max
  Peptide Sequence Number=SeqID_147161
atggctcgcaccaacaaaactgggcagatgacatctgaggcagcaaaggaaatcgctgagaagattgcgtcacagggatcgtttgtcccccatggacgtcaggatgtcctgactgtttccattgggcgaccagagcactctggtcgtgtccatgcaatacttcggatcgactccacaaacctcccgcagttcttccttcatggacttgcactgcctccggagccagaggttggtccctcaggtgctcgtgccagcacaaaggagagttgtgttgatccctcagggaacgatccaaagacgggtgactcagacaaatgcgggttgtacattgaagaaaatcattcccgcctggttgtcctaggaagactttatgagggatccacaacggcacttaacaccttctttgcttggccgacacatctcgtgaaacatttatcagaacaggtagttgtgtttccaaaaaaacctccagaaagcccggatcctgaggtcgatgatcccctgtatctgatgacattgaccatcccacaactgtttttgaagcctctccaggttatgtgggatgctaccgtgtttagggtgtttaatcaaaacttcccgttgtacataaagcatgaaaatctctctgaaattgcacacggtggtcaatgtctcaacatatctgttatacagttgtggattcttgctttgaaaggacttgatgatactccgcaacctaaatccaaggctgttgctaggtggattgttgttaagaccattggtagcagagagattgaaggcgcttcacatccagtgggcacagtattatctaaaagttag

SEQ ID NO: 55477 - DNA, 269 bp, Glycine max
  Peptide Sequence Number=SeqID_147162
ttaaggtcacgctgttttgtgagaatgctccaaccatgtgggatcggcacaggcttaaaggagcattcaaaccaagtgtatttacccccaaggcctacacttcgaagagtccatcagggccactccctcctgattcaggagaatctgataaagcatcagcatcaaggccgcgtgctaagcgcgagatcagtgcgctaagcacagcaggtgtcttcagccaggctcagtgcaagattggcgctaaacccaaacccacttacttgcgctaa

SEQ ID NO: 55478 - DNA, 324 bp, Glycine max
  Peptide Sequence Number=SeqID_147163
atggcttctccaccagccttgcctcctcctcatcctcctgctcctcctgctcctcctcctcatcctttcgacacatcagcttcgccgtctgccgtgaagcggacacagaaagcctcatgtctacaatccttgtctactagatcaatcgatgctgagagaccagtggtccacattgatcctgctactggcaaggctgacggtccccacaggaagaaattaagaacatattttgggattgtggtgcgtgataaggtggatgtgatgtacgagaattggaaggaggtccctactactcagaaagacttgatttgggaggatatttag

SEQ ID NO: 55479 - DNA, 1167 bp, Glycine max
  Peptide Sequence Number=SeqID_147164
atggggtgtggcaatttattcttcacaattctgataactttctcagtggcactcataacatacaatatcataatctcagccaatgcccctctcaagcaggacttcccggggccctcacgcccttccatcaaggtggatcctctcatcaagatgccactgcacagaaaatcatcatcctcggaggaatcgaagaagaggttgttgttccacactgctgtcactgcctctgactctgtctacaacacgtggcagtgcagggtgatgtactattggttcaagaaggtaagggatgaaggaggagatgaatctgggatgggggggttcactaggatcctgcactccgggaagccggaccagttcatggatgagatccccacttttgttgctcagcctttgcctgctggaatggatcaggttgaggccttgaatccaaattataagatttctaaaggaggaaaaatggctattggaaatggttacatagtccttaacagaccatgggcatttgtgcagtggcttcaacaagcagatattaaagaagagtatgacctttacatattgatgtcagagccagaccatataattgtcaaacctatacccaacttagccagagatgggctaggagctgcgttccctttcttttacattgagcctaagaagtatgaaacagtgctaaggaagtactttcctaaggagaagggaccaatatccaatattgatccaattgggaattcacctgttattgttgggaaggaattcctcaagaaaattgctcccacttggatgaatgtttctctggcaatgaagaaggatcctgaaactgataaagcttttggatgggtgcttgaaatgtatgcttatgctgttgcatctgctcttcatggtgttcgtaacatattacacaaggacttcatgattcagcctccatgggacaaagaaattggcaagacatacataattcactacacttatggctgtgactatacaatgaagggtgagctgacctatggaaagattggagaatggagatttgataaaagatcttatgataaagttgctcccccaaagaatctgacattgccaccacctggtgttccagaaagtgtggtgactctcgtaaaaatggtgaatgaagctacagcaaatattccaaattggtggtcatag

SEQ ID NO: 55480 - DNA, 363 bp, Glycine max
  Peptide Sequence Number=SeqID_147165
atggtagtgacaatgcttatttgcctaagccaccatggtcaaaatggtggggtacctgattgcacggaagaaaaagaaaaacgcctaaggaagatgatggcaagattgattggtagccatattttacgcaataatcccactgcatgtgatcttggaaatacaaagacaaagattagagagagagggacaggtcacagggtgttgtgtctagcacccctcacattatgggatttggccattggtgctcataactacgaaggcatgggttggtttattgatgaagtcactaatcttttcagcggtgattgctgctatgccacgcccttccactatgcctcatgcttggactttctttttgcttga

SEQ ID NO: 55481 - DNA, 2718 bp, Glycine max
  Peptide Sequence Number=SeqID_147166
atggagagcgcgtggaagaggaaatgtgattcgccgtttcagccgtccacgtccgcggcggttccgtctgcaccggtgccggagccggagccggagataaacacaagccattgtctttatccacaatttcctcatggcttaagatcaaaatttgttggagggaagcaatgccctgtttaccaaagctttccccactcaattacccatggatcaggccaagccgacactggaagttcatttctgtctctcctttatgctcctccatccttgttacagcatgagtcttgggatttgtctaatcgcaagctttgcatctcatcttgtgattgtactgctgctattgggaattctgttgttggttccatagaaagtggaaccttccgaacatctggtgtggggttgatgacagaaaatttaataaaccgtaacctgcaaagttgggtgactacttttcctgagatttcttccagggcaatggttggtctgaagaatagtagtagttttgtcttccatgatattcagagtagcaatactgctactcagcccacaattcctggtggtgagaaagctagggagtctttttcttcttcaggtcagtgccaaggtacaagccctgcatgtagtctaaatgtttgctggtcagatgttcaaactacaccaactgttgctttagaacaaagctcatctaagtatgcaacaccttttatgagtgggtgccctcgtgtgttctgcatgggaaaaaataactcacatttccattgtcaatttaaaggtggccatcttcttcttagcaatacagggcttcttggtattgtttgctcatgccattgttgccacatgtctgttgctaagttttgcgagcattcagggttatatggtgttgacccaggggaagctgttcgtatggaaagtggggagaccatttctcagtggcagaagcaatacttcttgaagtttgggagaaatgcttgtatcccaagccaaagcttttatttacgagggtttcaaatgtcttctgatgaatcgtttgagtgtggatgctttcctattaggtctctgggaaatgagaatgaatgggactggccagaagtattatcaacaacaggaagtctgatgagatccaatgcatctgcatttgatatgtccaagactaatttgtctcatatgttgagttcatctgcagtcatgtcaaggtctgcaaagtcttctgactatgccgtgtttccaaaaaatgctcatgcagacaacaatttatttattgatgcattgtccggtaaacaagcgacaacaatccaggatggttgcaacattccactcaaaggttttactggtatttcacaaaacagcttgtatgatcagttgaaaaaccagctaacggtatctaatctggctatgtatacaactgcaccaaactttgttggaactcaattggatgatggttgtcagccaatacctcctttctttgattctcaaaaaaggaaaggaaatttgtctagtgcccactctcctttgcaaattccagcaagccttttgaaagaccatgattgcatcaaaaagaagaatgctaatgatggtcttgtaggcaaagatgcagcttcttccaatattgatcttaggcttggtcaaccacctcagacaggaaatctacttccatcatttgcagaaccacttctgtttaatgcccttgccagtcctccaaaatcacaacctctgaagcagatgattaataatgcagacctcagcagggaggaggaattacagaataattttagctatgctgctggttcaatcaaaatggttcaagaaatgcctcagcttaaactcaataactatatgtctgctgtgggtaatgcttctgctagagctagatcagaaactaaaaatgtggccgagggtttatcattttcaccatttctgcaatttgataatcaatctgggggaaagacaaaagctagtgaaaatttgtggaatgatgaaagctctatcatgcccaagaaactgtattctgattacggccacactggaaggcaatcaaacaattctggcataaggaccaataaaagtttgaacaatgataaaggggtgaactttgctaaagactctggtgttaaaataaattctggttttggtattggtcagttaatggaatatccaagctccatcaagagagctgttagtgctagtgatattttggttgttaacggaaagatacatgaatcaagcttaccatcagatacatctgtgtgtgcagatattttgcatggttcaaacaatgtatcttttcttgggcaagaaaatcatactccacaaagatccattccatttaaagggattttgaaaggccttccccatcatgtttcaagttctgtgtcaaatcagactcctattttgccacagcagcagcagggcattaatatggatgcttatttgcttgatgaaaacatgaggttgcttgcattgtcacagatactggagttatctaagcaacagcatgcattgtatcttaaatatatcaatcagaagcaagggagatccagctgtatttcaaaagttcagcattataggtgtgaggcttcaacatctgaacagggaacttctggtgcaacgttgaaattgtcccaaaatagaggaatttgggggaatcacgagagtactgttggtttagagaaactggcttccctcacaggcaagcacattgcattttttattttcctataa

SEQ ID NO: 55482 - DNA, 381 bp, Glycine max
  Peptide Sequence Number=SeqID_147167
atgtctgtcgttcactccgacttaaccttcgtcgctcaaggttcacactcactcacatcttgcactttggctcaactttcaattctcactctcacggagtggtttaagaagattgtggatgcgaggaaggtgttcgatgaaatgcctgagagaacttttatttcttggaactcgattatgactgcttgtgttggaagtctttcactaggtgatgggattgagtatgtttttggatgtggggttgtgggtttaatccccaagcaacccacggttcttgagatttccaataaccttgtaaaatcctttacaagcaaagatccacaagggatataccctcccttgttctctttgaacaaccaagtggatgcaccttctacttga

SEQ ID NO: 55483 - DNA, 747 bp, Glycine max
  Peptide Sequence Number=SeqID_147168
atgcaaaacgggattaaccggcaaaaatccctgaaggagaaactgaaatcttcgctatgttgtttctccggaaccgttcatagcgacccattggagcgaggagaaggagggttcttctacgacaaactacgcataccaaaaacaccgatttctccacaggggtccacgtcatcctcgtggttcaagataatgtcaccgacgagcaccaatttcggtgacccgcatccacgtgtcagggggcggagcctgaagtcgaggatgggccgcaagctcctccaccaccgtcagtcgcagtccgctgacttcagctacgacccttcaagctacgcgctcaatttcgaggacgacagcccccaagaatttcccttcaggaacttcagctcgcggctgccatcctcgccctcgccggtggattactccaccggcggcaaggagattgttgggtacgccccgtttctctgttcaccaaactccaacaatgggaccacgagcctcactccaatgacctcaccacctcatgtgccactgcctgattctggcgaccagattccaacgacttcggccctcaccttcgcgagcacctcttggagcgattcgagcaacgacaccgccttttctagagctaactgctacttgatgggagtagtggttataaaagggggcagaaaagaaaggcctaaagaagtgaaatcttatttctctcctctttcaaggaaatcaaagtgcattggagagaagttcatatag

SEQ ID NO: 55484 - DNA, 231 bp, Glycine max
  Peptide Sequence Number=SeqID_147169
atggagttgttagtgggagaggaagcaggtggaggcggtggcgggcgtgggtgtggatgcgttcagaaatgggaaattgggtgtgagtgtgtgaaggatgagagagctgtgccgcgagagagattgggagagcatgcaaaaattgagggaattgaaagcgtaaatgaaaaaggtaagtgtgaagtcttcgatggagtcagaagtccacatgttggtggtaaacgaaactaa

SEQ ID NO: 55485 - DNA, 1020 bp, Glycine max
  Peptide Sequence Number=SeqID_147170
atggtttcagtgagcattgtcttttttcatcggcttagtcactgttgtcgtttaatgcagctacaagtgaagtatgactacaacaaatgtaggccaattttgggacctttttcccagaattcctatttaggggtgaaagttggatattgtcccgcgtgtcaatcgaaaggaccattctctatcaatattgatcagacaacttataggaatttccacaagcttactcttcaagagggccctagaatagttcccgctggtcgagttccaagaaacaaggaagtgatattagtgaatgatcggattgactatgctcgcatagggaagaaattgtatcatggagaacataaaactgtatatgctagtggcaaaggagcttctgtcatgggtcccacagatgcagttcataaggatctagtgataacagtggataaacaccaaggagatttacacaacactttaatccaaaaccttaaagactcagatcctatcatttctcgttttgacattgtctgcgttgtgaaggatgttgttgaaccgaacactgttgaaatgcttgcaacgtttgtcgttgacaatcacttcaagtcacaagatgtccatatacttcctcaagagctaccgaagaagtacattacatatgccaagttgaatatttctccacgtttagatgatctcaaaatggttaaagatgaactgtcagaaacctatgttgaactgcagaggaaatcttcatatggacaaggagtccatatcgccataagacaccttgaatcaatgataaggatgtctgaagctcatgcaagaatgcatctcaaacaacatagctttagaaagtatgtgactttcaagaagaactataatgattttctcctttatattctctgtgagcttgtacagaatgcttttctttcagaagaaattgtcactggatttgcttcgggtctaacatacctagatgtcgaagtagataatctctgcaacaagttaatttctgacaattttaaaacggttaggaaataa

SEQ ID NO: 55486 - DNA, 390 bp, Glycine max
  Peptide Sequence Number=SeqID_147171
atgtgtccaaagcatgtcccacaagtatcaatcatagagtgcattttacacttaaattctttgatgtatagcaaccagacaatttccatccatcaatttacaaacaaaagaggaaaacatcatcatggtcatggagaagctggggaagccttcttctatgattggaaacaacatgatcattgtgagcgtcaagctcaatccccgcaacactttgtgttagtgggatgcaagaatgatggaagggaggccttctacatcggttctaatggcctttctacatcgattatgacgcgtggtggtaacacagtgtcgttgaataccgacatcggttggaggactgtctttgaagggcgacctttctacatcggttgtgtaactcaaccgatgtag

SEQ ID NO: 55487 - DNA, 69 bp, Glycine max
  Peptide Sequence Number=SeqID_147172
atggaggatgcggctgaactaagtttcggagctaatacacaattccaccaatcaccagaatttggatag

SEQ ID NO: 55488 - DNA, 513 bp, Glycine max
  Peptide Sequence Number=SeqID_147173
atgtttaaaagccaggttcttgacaaggaggtgtttcaaaagcagatgttggagaaacttatatggatttgttccgttatgcttgatggagcacctcatggaggggttttagtaggtgtcgcggacaaggaattctgcactgaagcccagaggggctcttcgttttttaccctaattatgtcctttaaatgctgcattaattactgtgcatgtgagagagagagagagaggggaatacggacagtcaaagcgccggaacagccaagagccaccactagccaccactcagtgcccctctcctcctccgtgaaccaacagccaacacagccaccgaaaaccaccgcaaaccaccaacacagccaccgaaaaccaccaacacagccaccacccaccaccgtacaaacaaaccacaaaaaaaaccaacagaatcaaaatccgaaacacattcaaaccacaaatcacacgattcgtaccccaatcatcgcacagaccacggaaaccgaaccggcataa

SEQ ID NO: 55489 - DNA, 228 bp, Glycine max
  Peptide Sequence Number=SeqID_147174
atggaggcggtggtgggcgtgggtgtggatgcgttcagagaagggaaagggtgtgagtgtgggaaggatgagagagctatgtcgcgagagagattgggagagcatgcgaaaattgagggaattgaaagcgtagatgaaaaaggcaccaaacctgctttgcataggaacagttataaaacacatgccaatcattttcaaaaattttattgcaaaaaggaaagattctag

SEQ ID NO: 55490 - DNA, 606 bp, Glycine max
  Peptide Sequence Number=SeqID_147175
atggctcacctcgacaaggacctcactctcttggtcttgcagtactttaatgaagaaaatttgaaggaagcagcacgcacgcttgggcatgaaagtggattatactttgacttgaaatattttgaggacatagtgcttgagggaaagtgggatgagactgagaactatctttcagcgttcacaaaggtcatggataacaaattctcaatcaaaatgtactttgaattgaggaaacaaaaatactttgaggctttggaagttaacgatcatcacaaggccctagatatccttctgaaggatctaaaagtcttcgccaatgggaatgaagcgttgttcaaggaccttagttactttctgattgttgataatataaggaaccttaaaccatcatatggagatgtaaattctgcaagaaaggatttgatgtggcttcaaaatcctaatcaagagccagaccttttaatggactattgtaattccgaagcatctacatctgctccaaaaaattcaggaacaactatggagtggaaaccttcaaccaatggaaggccaattaatatggatttagatgaggtagaaagataccttggatatgcatgtatgtag

SEQ ID NO: 55491 - DNA, 204 bp, Glycine max
  Peptide Sequence Number=SeqID_147176
atggagatgatccaaagacccaagtccactctaatagctttaaaaaggaagtcaagccaaggagaaaacacacaccaagtgatgagaatcctgaaactggccaaatacaggctaaaggcccaagtgaagaaggacgaaggcccaagtggagaaggaaaaagcccccgagtggagaaggatgaaggcccaagtggagaaggatga

SEQ ID NO: 55492 - DNA, 540 bp, Glycine max
  Peptide Sequence Number=SeqID_147177
atgttgcaagctgggaaactgttaatgacgatgaaatggaagtccttgaggattccagagagagatatgcatgtctatagtgagagccccatgactgatgccttgcagctggtatgctacaacacttgcaagaaaccaatcaaggacagtcaatttgctgctcatgcagaactttgtaggtcattacagctcacaaaacagactatgttggagcttgatgacaacattgggaatcggaaacctcctaggaaggaaaagaaaaagttaggagcttcttccgcaaaccaagcttctgcacgtagggagcagagaaggtccgagtctctggataatattgactttgctttgtcacaatcctacttgaatagtcaagtcagagtggttccctttcccaatgaggtaacaggaaagcttttcagctccaacacttccttcgaatataaaaccgtgttctacatgtctagcgagggaaaaaatttgctccatgaggtaggagaaatgcattatatggaaggtgcaaccagagaaggcattcattaa

SEQ ID NO: 55493 - DNA, 321 bp, Glycine max
  Peptide Sequence Number=SeqID_147178
atgaggagagtgcatcctcgtcgcatcgattcaggatgccaaagatcgcttttcgcagatcgactcaaacgtgacgccgacgagaaagccaagcttctactacacgctgaggagaggcgaaacgacgcgttattgaaatcggagagctgcaagggcgacaaggtgacgctgctggcgagaatcggcgagttggacgacaaattgagattgaagacacaagagattgaggaggcggagatgaagcgggtcgaccctagacgcttccattctttctttagcgatggcggcgttttgtctccgctttacccattcattcattaa

SEQ ID NO: 55494 - DNA, 231 bp, Glycine max
  Peptide Sequence Number=SeqID_147179
atggcgggactgtgcatggggtgtatcgcaggcgccaatggcggtatgggcctatatggaagccttctcgccagtgggagaagcaagatagtcttctcgctagtgggagcagcgagacagcgtccacgtcagctatctcgccaatctgcttggcgacaccctctgagttgtcttgccactgctaatggcggtactattttctcgtctgtgctgctggcgggatcctcgtag

SEQ ID NO: 55495 - DNA, 498 bp, Glycine max
  Peptide Sequence Number=SeqID_147180
atggctgcttccgccgcactcgacgatgccaagcacggcttctctcgatcgaagatgtacaaggaaaaccttgccggcaccttggacgcctacgaccgccacgtgttcctctgctacaagagccacctctcctggccaccgcgtctcgaggcctctgatgccgatcctcttcccatgcgcgtcaccaccgtctggagagctcgcaaaaatgacatcaccgtcaaggctcgaaggaaaaagatcagtgaaaggatgaaaattcttcaggatttgttccctggttttaataaggttattgggaaatcattagtccttgatgagataattaattatattcaatctcttcagcgccaagttgagtttttgtcaatgaagcttgaagtagtgaattcaagacttaactctggtattgaagcgtttcctcctaaagatatgtcattcatgtcatcagagtgttttatttgcaaatactttaccatatctatgattatcctttaa

SEQ ID NO: 55496 - DNA, 381 bp, Glycine max
  Peptide Sequence Number=SeqID_147181
atgggtcaaaaccgttataaaatatcctacataaccgacgtagaaaactgcttttgtagtagtgattgcatattgcgcattgaagcgcttgacaagagtgtcaaagctattgatagaccttggagaaagtcaactatatcaggcactcaggcaatgtgtgagtggagtattggtcgccctaaggtcgtctcacatgagcctttagctgattgtgtgtttgacatggctgctggaagtggattgaagctttcaaaagaggtcttgcatttgagtctaaaccgggtgctaaccatgggtgaaagagagatatcgagagatcgtgaggtccttgttgatagtggcttttatggtgacgtaatagtccttgcagataattattga

SEQ ID NO: 55497 - DNA, 141 bp, Glycine max
  Peptide Sequence Number=SeqID_147182
atgcactatgacaaaaacaagagatgggtagagaaggcaaccgttggtgaagtgtcataccctaatttcgtctggggacctttgcttgatgacatgcgacctttctttggtccttgtgaggtgcttggcatccatcattag

SEQ ID NO: 55498 - DNA, 408 bp, Glycine max
  Peptide Sequence Number=SeqID_147183
atgtacacaagtggaacaactagagatcccaaaggtgtcattatgtttaatgaggctttcatggctgaagtgttgtctgttgaccacatacttatgtcagaaagtcagagtggttatactactacaaacactcccagctgccaggcaggagacttattgcatcaccaagggctcatcaataggattttggcaaggcgttgtagcctcccaggctggccaggagtaacaaaatatgtaggattggtatgtgctcagcctcatcgtgaggaactcaatcaagacctttttaaatgttggaaggatcctcatcatggtataatttatggtggcatgatcaggaatgaaaactcaagcatgtctgaggaccagacatcggaccatgtcatggaaaccttggttgtagtttga

SEQ ID NO: 55499 - DNA, 384 bp, Glycine max
  Peptide Sequence Number=SeqID_147184
atgtccaggtttcggaacaaagttagacaagatggacaaaagtgcaataagcgtgaaggaagcactaagacttactcacacaagttagacaagaggcacaagtcagacaaacaccaacctctcctaaaaaggccctggtacgagtgttacacacctttgacgaccaatcacactacaatccttgaggaagctttcaacttggaggtacctatcaggctacctccaatgcatcctcccaggttccatcgcagtattggtcacaacacaaaagagtgttggaccctaaaggacaagatagaagaacttatacatgttaggtatctagcccagtttattaagaggctggacaaccaccaagcaagagcgagacatagaggacactaa

SEQ ID NO: 55500 - DNA, 408 bp, Glycine max
  Peptide Sequence Number=SeqID_147185
atgcgtaaggagaaaataccgcatcaggcgccattcgccattcagcctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccccgagggaaccaatttctctcctccttttcattgagtgcaaaactgatttgccttggaaagctggagagattaaaaggatcaaattctggagattagttccatcgataatactcctcaattctcgtaaaaggttactggtagtagcaggtagtggcaagtgccaaaagatgacaatgtttgtgattctgggactacaagttgtaatctcctattcataa

SEQ ID NO: 55501 - DNA, 99 bp, Glycine max
  Peptide Sequence Number=SeqID_147186
atggaggcaaacgtaacaaaggtgttgacggcagtcggcaaccacaaagatgagaggaagaagacttttacgcaaaacacaaagacaacgcaggtgtga

SEQ ID NO: 55502 - DNA, 96 bp, Glycine max
  Peptide Sequence Number=SeqID_147187
atggaagttatggtggcggtgcgacaaagaacacaaagagatggaggaggaagaagcttgatttgtggtgttgtacagacaccgctagggaggctg

SEQ ID NO: 55503 - DNA, 312 bp, Glycine max
  Peptide Sequence Number=SeqID_147188
atggctgatctctttgcgtggctcatctccttcttcattcttattgccttaattgtactcgtcatttaccagttaatgtgcctggcagacctagaatttgattatataaatccatatgattcctcatctcgaataaacaaagtgatattgcctgaatatattatagtaggtgtcctattcggcttctaccttgtaacagggcattggataatgtcattgatctgtgctccttacctctactacaatgtgagatttagtgtgactacccaggaaaagagtaacttattgatggcacaagacaaggcaacttga

SEQ ID NO: 55504 - DNA, 363 bp, Glycine max
  Peptide Sequence Number=SeqID_147189
atgatgacaacaaaagatgatgacaaaggtgatgaacaaaaagctcaaagatcaaagaacaactcaagtgaatcaagaacaagtcaagagttcaagaatcaagaagaattcaagactcaagaagaaagtctacaatcaaaaatcaagattcaagatctcaagaatcaagatcaagattcaagaatgaagaaaagactcaaacaagataaagggtacatctacttgggtttgactgagaacaagagagggtacatctcttgtggatcagttctagtggagggtacatccactaggttcaaagagaacaagagagggtacatcccttgtggatctttgcttgtaaatggatttttacaaggttga

SEQ ID NO: 55505 - DNA, 2274 bp, Glycine max
  Peptide Sequence Number=SeqID_147190
atgcgagtgaaggaaatgcacccgttgtgctgcatctcgctggagagtccggggatcgggagcgactcgccggagccggaggcggcggcgctgtcgaggacgaggagtcttccggcgggcggatctgacgtcattgcgcggcggggatcggaggctactgtggccggagttctctacaagtggaccaattacggcaagggatggagatcccgctggttcctcctccgcaatggcgtcctctcctacgccaagatccgctggccggaaaacctcaacctcctctctccggtcgacgacgtccgcctcatcggagaagtcaccgccaaccgtctcgccagagaagccgcatccgccaccgtgcgccgtaagaatcacaaacctccttcctcctcctcttcctccgtcgtccatctcaagatctcgtcgttcagagagagcaagtcagacgatagacggttctatatattcacggccacaaagactctccatctgagaactgattcgaggaaggaccgtgtggcgtggatacaagctttggtttcaacccgtggattgtacccacttcgaccactcagtgaccatctctccctcgcgccaaatcatatatctgtgtcaaccgaggggcttaagaaacgcttgcttgaagagggtagcagtgagagccttgccaaggattgcgagcaaatcatgctcgcggagttctccgaattgcaagagcaacttcagatcctgtgtcaggaacgaatgaatttgcttgatacaataaggcagctggaggctgctaatattgaacctgaggccactgccttgcatgacagtgaataccaattaacaaagaatgaattttcaagtctaggacgtggaaaatatagtgaatgcagtactactgaatcatctgatgatattgagaagcaggagatggaggaagtgtcagatgaagatgaaatctcatattatgacactaaagagtattttacagaacatggttttaggtgtgggtcaacaggaggtttggatccaatgaacatgtctggggaagttaacacacaatgcatagatttggagaacagtcttgttgggcagacgatcaatgaatttaggtaccctctgatagcaaggcgaaagaagcttccagatcctgttgagaaagagaaaggcgtcagtctttggtcaattatcaaagacaatgtgggcaaagatctcacacgagtgtgccttcctgtatactttaatgagccaatatcatctcttcagaaatgttttgaggacttggagtactcttttcttctggatcgagcttatgagtatggaaaatcaggaaacagtctacttcgggcactgaatgttgctgcctttgcaatttctggatatgcatcatctgaaggtcgtcattgtaaaccctttaatccattgttaggggaaacttacgaagctgattttcctgacaaaggagttcgtttcttttctgagaaggtgagtcaccatccaactgtcgttgcctgccactgtcaaggtagaggttggaagttttgggctgacagtaacattcggtcaaagttttggggaaggtcaattcagcttgacccagtgggagttctgaccctagagtttgatgatggtgaaatatttcagtggagcaaggtcacgactacaatttataatcttatccttggcaaaatatattgtgatcatcatgggaacatggacgtccgtggtaatcgccaatattcgtgcagactcaagttcaaagaacaggcgattcttgatcgaaatcctcaccaggtgcatggctttgttgaagatgtaacgggaaaaaaggttgccacattatttggcaagtgggatgacagcatttattatgttaatggcgaagtgaatgtgaagccaaaagatttcactatgtcgtcagtcacaaacttgttgtggaaaaggactatgccaccttctaatctcacccgctacaatttgacatcatttgccatcacactgaatgagcttactcccgggctaaaggagaagcttccacccacggattccaggctgagaccagaccagcgacatctagagaatggggaatacgagaaggctaatatggagaaacaaagtcaaggaaaatgcaagaaaatggatggcagcctaggtggttccacagagaaaatgaaaatggaacgttccgatatattggcgggtattgggaagccagagcccaaggaagatggattggatgcccaaatatctttggtgaaattcatgaaggcaattttgatcctttag

SEQ ID NO: 55506 - DNA, 318 bp, Glycine max
  Peptide Sequence Number=SeqID_147191
atggcagggaaggttaagactaacaaaaggcattttacatgttttaattggcagagatcacaccttgggtcgctgaagcttgaacaactttcagaagctgataatgattacttggtggctccatttttggaagtagagattatggaaacaatgtgcgatacggttgtgagagatctgagaatcaaggaccgaatggtaaaattcaaatctatctattaccacttgaaggtgaaggaagggggagggaaggttgtgggcgcggtggtgggaggtgttagtgaggtggaggcaagagacaaaggtgccaagggaacatag

SEQ ID NO: 55507 - DNA, 330 bp, Glycine max
  Peptide Sequence Number=SeqID_147192
atgataggtgtcgtgactctggacttgcacagacagctaagcagcttcccaatccgcgtggcccaacatcttgctgtgacaattcatgcacaaagccaacgcatccacggccatggactctcggagataactagtgatgacaacaagtttcagaactcgaaccaggtcacggattgtactgaacgagtcacggagtcactctcgaaatcagagaaacctttaagaaaactccaaaaacttcaattgcctctctctctcgctctgtcacttagaagaagccttggtggatggatgttctacgtacatgctgccatgtgtaacatttactag

SEQ ID NO: 55508 - DNA, 810 bp, Glycine max
  Peptide Sequence Number=SeqID_147193
atgggaagcagcgaagaagtggttggcaaagaagaggttatcgcaaaactcaaggacgatggcgactttgacaggcttcgtttgaagatcgttcgcaagctcaaggacaacgaagagttgcgacaacatattacctcaattgtgaagcaatcagtggcactcaatcgtgctggagcagaaaatatgaaacctagacaactttctgatgccatacatgaagaagttggtgataaagtaatgagccagatatccgatagtttatggcaaataatccgatccggggatgacatgaaaagtgaaatcatggaaacagtgcaatctgtgtatgacaaattggcaaacccgaaagggaaagatgaggttatgatgtccatgtctgatgtgatgccaattcatagacaaggggaaacagcttcagctactgagattgatgatactttgcatgaaaatgagcctgatgagccgccaggtttcactctcttgcataatcatttgaataataactatcatgaagagcaggataaagggaaggtgcaagttcagaagcaaggattcactgcagagcagaaagaagattcccatccatcacaggatacacttggtgaagatgatgttaatagcaatgcaccgccccctggattttcaatggatgtggagcaaaaaccatcttctgattgtagtgatgaagaccctgatccattgctggcgttcgatgtcacaggagtcctattttctgtttttgatcatgatgaaccagctaaaaacaagagacaatctggaggtctcttgacatccccattcccgatctaa

SEQ ID NO: 55509 - DNA, 282 bp, Glycine max
  Peptide Sequence Number=SeqID_147194
atgattgaagacgtgttggtcagggaaaagcattttatcatcctagcagactttgtggtcatgaatatctctgaagatattgacatccttgtaatcttgggaaggccgttcatgttaactacaagctacatagttgacatggggaagagaaaactagagttaggttttgaagaccagaaaattgatttcgacttgtttgtggaagacaagcctgctccagaacacaatgtttgcttacaagtaatgggagaaggtcaagaggttctgaaggaacttgcttga

SEQ ID NO: 55510 - DNA, 495 bp, Glycine max
  Peptide Sequence Number=SeqID_147195
atgacaccggtaaaccgaaaggcaggaacaggagagcgcacgagggagccgccagggggaaacgcctggggggcggagcctatggaaaaacggctttgccgcggccctctcacttccctgttaagtacaagcgtcaaaattaccggcaaattccatcggaaattccgcgcccgttggggtaagccactagttctgagcgtcgccgcatcgaacgaccgagcggtagcgagctcagtgagcgaggaattcgcggaataccttttttacaacgtcgtgccacatgggaagcacttcactgacagcgttcacagccaacatagtaatcgcctatgcagcacatccgccctagcgccagctggcgtaatagcgcaagaggcccgcactcgatcgcccgggttggccgattcattaatgcagttggcacgacaggttcctgatggcgaaagcgggcagccctgtagcggcaacgcattaacgcggcgggtggtgagttag

SEQ ID NO: 55511 - DNA, 225 bp, Glycine max
  Peptide Sequence Number=SeqID_147196
atgacaatgcttataggttggacctcccagaagagtggagctgatattgaggaggaggaactaacagatttgaggtcaaatcctcttcaagggggaggggatgatgcaatcctacctaggaagggaccagtcactagatccatgagcaagagacaccaagaggattgggctagagctgctgaagaaggccctagggttctcatgaacctcaggatagatttctga

SEQ ID NO: 55512 - DNA, 738 bp, Glycine max
  Peptide Sequence Number=SeqID_147197
atgctcttgaccagcatctgcgcgaactggccttccagttggcgcgcgaccttgtcgatcttggccggatcgttctgttgcgccgggtgcagatcgaatgcgggattgatgcgcatatcagatcacctcgagctcggcactcagggcgccggcctgcttcagggcttccaggatcgcgatgagatcgcctggtgctgcgcccacggcgttcaccgcgtgcacgatctcgtccagagtggtgccgccgctgaacttgaacatgcggctgccgtcgttggtggcggtgatggtcgactgcgggctggccacggtgcggccgccggacagcgcattgggctgactgacgttggtgttttcctggatggtcacggtcagcgaaccatgcgagatcgcagccggtcccacgcgcacctgctggccgatgaccacggtgccggtgcgcgaattgaccaccaccttggccggcgcgctgccgggggtcagttccaggttctcgatgcgcgccagcaggccgatgcgtgcgcccggatcggtcggcgcggtgaccgccacggtcacgccgtcgaccgcacgcgcggcaccttcgccaaaggcgttgttgagcgcggcgaccatgcgcgagaccgtggtgaagtcgttgttgtgcaggttcagggtgatgtcgccgccattggccagcggatcgggcagggcacgttccacggtggcaccgttgggaatgcggccgacgctgggcac

SEQ ID NO: 55513 - DNA, 324 bp, Glycine max
  Peptide Sequence Number=SeqID_147198
atgtggaattacctggattttgtggaagcttgggaggatttatggggacccgacgttgagaggaacgaggataagggctacgtgggagtgcgtgagctcagttggaggtgggcaacaggggatggtgggttatacgtgatttgtggatgtggagaatcgttttgcaccatcgcccgaccgccacctagtaccacatgtgatggagtggtaccctggagatatgtcgcgggggtcaggagaccttggggatgtcaggtggggtgctattgcccaaaaaccaagcttgaccaatcccgacccaacccgggcatagtcggtcagtga

SEQ ID NO: 55514 - DNA, 1300 bp, Glycine max
  Peptide Sequence Number=SeqID_147199
catcagcttctgcgtgccgcagagcgagcaggcgcgcgcgcgtcgcgtgctggaagaggaattctacctcgaacttaaagatggcctgctcgatccgctcgacgtgctggagcagctggcggtgatttcggtggtgggcgacggcatgcgcacgctacgcggcatctccgctaaattcttctcggcgctggcacgcgccaacatcaatatcgtggcgattgcccagggctcctctgagcgctccatctccgtcgtggtcagcaacgatgacgtcaccaccggcgtgcgcgtggtgcatcagatgctgttcgccaccgatcaggtgatcgaagtgtttgtggtgggcgtcggcggcgtcggcggcgcgctgcttgagcagctgcaccgtcagcaggcgtggctgaagggcaagcatatcgatctgcgcgtgtgcggcatcgccaattcgcatgcgctgctgaccaacgtgcacggcatcgacctcagcaactggaaggcggcgctggcggaagccaaagagccgtttaacctcggccggctgattcgtctggtgaaagagtaccatctgctcaacccggtgatcgtcgactgtacctccagccaggcggtggccgatcagtacgcggacttcctcgccgaaggtttccatgtggtcacgccaaataaaaaggccaatacctcgtcgtggaattactaccagcagatgcgtgcggcggcggcgaaatcgcgccgtaagttcctttacgacaccaacgtcggtgccggtctgccggtgattgaaaacctgcagaacctgctgaacgccggcgatgagctgatcaagttctccggcatcctgtcgggctcgctgtcgtttatctttggcaagctggatgagggtgtgacgctgtccgaagccacccgcatggcgcgcgagctgggctttaccgagccggatccgcgtgacgacctgtccggtactgacgtggcgcgtaagctgctgattctggcgcgtgaggcgggtcatcagctggagctgagcgacatcgacatcgaaccgctgctgcccgccagcctgacggacatcgccgacgtcgatcagtttatggcgcggctgccggagctggacagcgcctttgccgcgcgcgttgccaaagcgcgtgatgagggtaaagtgttacgcttcgtcggcgcgattgaagagggcggcgcctgcaaagttaaaatcgatgcggtggacggcaacgatccgctgtacaaagtgaagaacggcgagaacgcactggcgttttatagccgctattatcagccgatcccgctg

SEQ ID NO: 55515 - DNA, 449 bp, Glycine max
  Peptide Sequence Number=SeqID_147200
ggtctgaggtaggttgtttctttggtttcttggggtggtttgagagtttaggatctgatggtggtggagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccg

SEQ ID NO: 55516 - DNA, 525 bp, Glycine max
  Peptide Sequence Number=SeqID_147201
agaacgccgaactgagagacgtcaatatagccaccactaaggccttggagcaagagaccaagaaggcccgtaaggaagaacatggccggaacaaattccgaggggctctgtggggcagtaacagcgagcttaagctccaaagagaagaaagggaccaatcccgagtagatggcttgattctgaaggacgaattgaaggcttgcctaaggtcaaaaaggagtttgtctcagcggttatgcgagaccgaaacaaacatgttagccatcatcaacaagtaccaagaagaattaaacttagccaccgtccacgagcacaaagtggcggacaaatacgcccaagtgtacacggaaaaggaggctagaggaagggtgattgactcgttacatcaagaagcaacgatgtggatggaccggtttgcacttactttgaacgggagtcaagaatttccccgattgctggcaaaggccaaagcaatggcagacgcctactccgcccccgaggagaaccacgggctcctcagctatt

SEQ ID NO: 55517 - DNA, 252 bp, Glycine max
  Peptide Sequence Number=SeqID_147202
atgtggaccaccacgggggaggagctggccacccagctcgcccaggcgagcaaggttgcttcctccggaagcaacagccttctggaggaaggatctggaaggcccaactttcgaagaagttacagaaactcacggattgtgcaaaaacacatcttttcgatttctgacaagtctcgggacttcatttattgtgcaacaaaggacgccaagtatctcaaatcggctaaccaaaggttgcatgtcatcaagtaa

SEQ ID NO: 55518 - DNA, 499 bp, Glycine max
  Peptide Sequence Number=SeqID_147203
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaaggctgcaccggtgcgtcagcagaatatgtga

SEQ ID NO: 55519 - DNA, 561 bp, Glycine max
  Peptide Sequence Number=SeqID_147204
atgtccaaatcttgtgaatttgggatgaccggccctctcgatgagtcgatctcttgctttctcataaggttggacccttgggtactagtacctatcaccttcagaggactgtacgccctcaccgtcagaggactacacgtcctcgccttcagaggacttcacgtcctcaccttcagagggctacacgcctttgccttcataggactagacgtcctcaaattcagaggactacacgtccttgccatcagaggactgcacgtcctcgcctttaaagggctatatgccctcaccttcagaggactacacgtcctcaccttcagagggcttcacgccctcacctttagagggctacaccccctcatcttcagaggactacacgtcctcaccttaagagggctgcacgccctcgccttcagaggaccaaacatcctcatcttcagaggaccaaacatcctcatcttcagaggactacacgtcctcatcttcacagggctacgtgtcctcgccatcagaggactccatatccacaccatcagagaactcaaggtcctccgcccttaa

SEQ ID NO: 55520 - DNA, 874 bp, Glycine max
  Peptide Sequence Number=SeqID_147205
aggactacatgtcctcaccttcagaggactacatgtcctcaccttcagaggactacacgtcctcgactttagaggactacacgtcctcaccttcaaaggactacatgtcctcaccttcaaagggccacacgccctcgccttcagaggactgcacgtcctcaccttcagaaagctacatgccctcacttttagaggactacacgtcctcaccttcagagggctacatgccctcaactttagaggactacacgccctcgccttcaaaggactacacgtcctcacctttagagggctacatgccctcaccttcagaggactacacatcctcatctttagagggctacatgccctcacctatagaggactacatgtcctcaccttcagagggctacacgccctcgcctttagaggactagacgtcctcaccttcagagggctacacgccctcgcctttagaggactagacgtcctcaccttcagagggctacacgccctcgccttcagaggactacacgttctcaccttaagaggactacacgtcctcacctttagaggactatgcgtcctccccttcagaggactacatgtcctcgcctttagagggctacgcgtccccactttcagtgggctcgacgtccgcgccttaagagaatttaaggatcgtgcccacaagacacccagtggacccggagaagtccaacagggccctggggtttccaactctggttacgggcctctgtcagtcctacagggtgcccgttccccccaacaagggatcgtgcctgcaagacacccagcggacccgaagaagtccaatagggtcctgcggtttccagctctgattacgagcctctgtcagttttacggagtgcct

SEQ ID NO: 55521 - DNA, 330 bp, Glycine max
  Peptide Sequence Number=SeqID_147206
atgggaaatgcgagatttcttgaggaagttgagtttgggaaggaggagaacataaagaatgttgtctttaaggaaaaacctgttatttacagtgatcaagtcctcatacctattactgttcaagacacaactccagtaatagaagacaatgttcaaactattgacattgttccgaaacaagataacaatgaggttccccctcaaatacctttagagcaacctcaacaatctcaagaagtgtcattaaggagatccattagagagaggagaatgcaatctcaaatgattatattatatttctccaagaacataaggatggtgttggtttaa

SEQ ID NO: 55522 - DNA, 243 bp, Glycine max
  Peptide Sequence Number=SeqID_147207
atggcgagggcgtgtagccctctgaaggtgaggacatgcagtcctctgaaggtgagggcgtgcagccctctgttggcgaggacgtgtagtcctctgaagacgaggattgactgtccttttgaaaaaggtgataattcatgcaacctcatcctatctttttgcaaatctctccgggaactccctcagagtgttcacttgaggctcatgcacgatgcccctcattgccccagtgtaaggctttga

SEQ ID NO: 55523 - DNA, 168 bp, Glycine max
  Peptide Sequence Number=SeqID_147208
atgaccaaatttggtctcttcttgtcatcgggcccgccgcctccggatgacaaaagggtgcggataaccggtcagtatgacaaagattatggggcggccgacaaaagcaaggctcttgctcctacgtatcctccaatgaggaactcagacctacgtagttctggataa

SEQ ID NO: 55524 - DNA, 715 bp, Glycine max
  Peptide Sequence Number=SeqID_147209
gcgagatctccgcgcaaacggtgtattcgctgaaggtgctggtgcccatgtagtgataaacaggctcgccattgtacgagaaacgggtggtaccgtccggcatcagccctttcccctgggtggcgcgaactgcctggcagaggttggtcttaccggatttacagaacttacattcgccgcattccgccgtgtacagcgggatcacgtgatcgcctggtttcaggctggtcacgccctcgcccacttccaccacaatcccgcccccttcatggccgagcaccgccgggaacacgccttccggatcgtcaccggacagcgtaaacgcatcggtgtggcatacgccggtatgggtgattttgatcagcacttcgcctttttttggcggcgcgacgtcgatttcaacgattttgagcggctggccgggtccaaatgcaactgcagcgcgagatttcatattataagcgcgcagcaaatggccgacttccgccatgcgtacggctcgctgatccggcgtggtttcccccgtcaccagctcatctttgaggtgaatttcgaccatttcgcccatcaggccattggcagccccgcgcacggcggcaatttgctgcagaatggccagacaggggtcgcccgactccagcgcgcgttcaagggcctcaacctggccccgaatgcgacggacgcgggtaagaatacgttttttatcttcgggtga

SEQ ID NO: 55525 - DNA, 159 bp, Glycine max
  Peptide Sequence Number=SeqID_147210
atgggggaaagcaaaaaagaaagagaattctcgatcaaagatcggaagagaaaagaagaaatatgcagaaaggaaatgatttgcaagatcaagtcatggcatatctatggttcggaattaggacgaaacacttacctatgtgagattaatacactttga

SEQ ID NO: 55526 - DNA, 234 bp, Glycine max
  Peptide Sequence Number=SeqID_147211
atggcctcctatggtgtggcgtctcctctctctcttcctttctccattccgctgccattcatcttccaagaagcgaaggagtccattgatgaagaagatcctaggcctacaagctccaatggagcttacatcagatgggttaagccttctctaaggttgccttactggtcagtactcgtcctccatgatgatcttatgcatgcaataggtaggactaattcccttgaggtctga

SEQ ID NO: 55527 - DNA, 258 bp, Glycine max
  Peptide Sequence Number=SeqID_147212
attttttcagaagaagatagatctcctccagcacaagccgttgcagcccagaaacgcaaattgctatataatcatggaggctgcacgagttctgtaccaagtccgggatcgaagagttattttcgtgatgtcgtgacatccggtacgacatctgtcccctggtatcagaatttcactctcggacacggaaacaccgcacacactccatacatcttctcaaagatcccaacggtcagatcatggacaagtgtcttgtga

SEQ ID NO: 55528 - DNA, 346 bp, Glycine max
  Peptide Sequence Number=SeqID_147213
gcttttcgtcttacagatagcaaaaaggaatgtttatacggataaccactcgggtatttccgcccgtcagcatgactcaaaagtcagtatgacagatcttgtgagcgcggaagatgacatagcaaaaacgaatgtttatacggataaccactcgggtatttccgcccgtcagcgtgactcaaaagtcagtatgacagatctgttgagtgcagaagatgacgcttttcgtcttacagatagcaaaaaagttttgaaagtgcggacaaccacttgggtggccgacaaaagcgaggctcttgctcctgcgtatcctccaatgaggaactcagacctacgtagttcttga

SEQ ID NO: 55529 - DNA, 974 bp, Glycine max
  Peptide Sequence Number=SeqID_147214
ggatgcccggcaggccggccaggaacttgtcggtgacgtccttgcccaggccttccttgcggaacacgcggccggcgatttccagggtctcggtcttgagcaggcgctcgcccggcttgccgcggccgtcgaaccacttgagttcgaaacgggccacgtcgacgtcatggatcttgcccatgttgtgcgccaggcgcgtcacttcgagccagttgccgtccgggtcgaccatgcgccaccaggccaggttgtcgagcgcggtgccccacagcacggccttcttgccgccggcgttcatggcgatgttgccgcccacgcacgaggcctcggccgaggtcgggtccacggcgaacacgaaaccggcagcctcggccgcctccgacacccgcttggtcaccacgccggcgccggcatggatgacggccacgggctcggtgagcccgggcaggatacaggactcgaccttgcccagcttgtcgaatttctcggtgttgatgacggccgacttccaggtcagcggaatcgcgccgccggtgtagccggtgccgccgccgcgcggcacgatggtcaggcccagctcgatacaggcggtgaccagcgcggcgacctcgtcttccgtatccggcgtcagcaccacgaaggggtactccacgcgccagtcggtggcgtcggtcacgtgcgatacgcgcgacaggccgtcgaacttgatgttgtcgcgcgcggtgatgcggcccagcaccttctgcgcctgcttgcgcagcatggcggtctggtcgaactcgccctcgaaggcggcaatggcggaacgcgcccgacccagcaggcccagcactttctcgtcgcgatgcggatcgtggccggcctcggccggcgcgccgggttcacggcggcggtcgatctcgcccagccgatggtgcagcgcgtcgatcagctgcttgcggcgcttgggattgtccagacaggtcgtcctgcag

SEQ ID NO: 55530 - DNA, 396 bp, Glycine max
  Peptide Sequence Number=SeqID_147215
atgggtgatcaagaggagacacaggaacagatgaaagctgacatgaaagagcaaatggcttccatgatggaggccatgttaggaatgaggcaactcatggagaaaaacgtggccaccactgccgctgttagtttggctgccgaagcagacccaactctcctagctatcgcgcaccatcctcccccaaacgcggtaggactagaaaggagcacaccggggcacagcaacaagccccatttgggatacaaccgggtggcttacccttatggattatcgcctaattacacgccgccagtcatgcatgatgacgcgggtcatgcctcttcccccatccttgaaggggagcctcctcgacagcccgacgaggtccatgaagatcatcgagggtatgcctaa

SEQ ID NO: 55531 - DNA, 612 bp, Glycine max
  Peptide Sequence Number=SeqID_147216
atgcatgatgaccgttggttggtttctaccaaccaagcggatatgatcggaaggctgcttgctaattcattggctcttgaaagccgcatccttcattatctaattgtttgtatcctactccctagatcttcaaaccttgcacaggcacatctagtccggtatctcatgcataaggcattgcgattaaatgctcctttaccctatccacacttagttactttgttccttcaacattttaacatccctcttgattttgaaccttatgttccaatcaagagatctttcttgatcggtgctgttggggttgcctcctttggttaccgcagagagcgtgatggctcttgggtaaaaaagggtgctcaaccaaataataatgaaggacacttaccagttgaaggggactcttctctccttcaaagtattttggacagttttgatagacttcaaacctatgttggtgagaggtttgactccttggagcatcaagtggacacacgattcgaggagatgaactcaaggattacaaaggttgaagaagatgtcaccatcatccgcgactgtcttgatttacctccaccaccaccatcatgtagaagcaaagcttcatggtga

SEQ ID NO: 55532 - DNA, 204 bp, Glycine max
  Peptide Sequence Number=SeqID_147217
atggctgcattagagagagagggtagcagcgggctcgtttccacagaggcacaactcaccacctcaaaggattggaaagctgtttccaaagattctttcgctgcttcaacatatgatgtggaagaggggcagcttaccaacatatcctcttcacccgacactatcactaaaagtccaccaaccgcgaacttcaatttctggtga

SEQ ID NO: 55533 - DNA, 372 bp, Glycine max
  Peptide Sequence Number=SeqID_147218
atgaagagagaatctcctctatccctgcattacaaattgtttgaggggacacatgtcccagacattgtctcaacatcagggaaagctgcttcaggtgctgtgtccaaggatgccttgattgctgaactcaaggacacatgcaaggtgctggaagcaaccatcaaagccaccacagagaagaagatggagctagaacggctgatcaaaaggctctcagaaagtggcattgatgatggtgaagcagcggaggaagaagaagaagctgaagaagaggaagaagcagccgaggaagaagaagaagctgctgaggaagaggaagatgcagcagaagaaacagaatccgatgatgaggattctgaagccaccccatga

SEQ ID NO: 55534 - DNA, 1035 bp, Glycine max
  Peptide Sequence Number=SeqID_147219
tacccgagcgtcagttgagtcacgaggtttggcagcaactatgcaactcagacgttctgctgatgctggacacgcccgctggtttggaacggcgctggacaagcgccgagtttggcagggttctagccaaggggatcagcgttatgagtgtccactgggcaggtgcaaccatgtctccaaggattgtaacagccagttgtgtgcagctttcagagcgcgcagtaaatccgcaatccggtcagcttgaggaagattcgttgcaaggtatctgtttaaagcttgaggagttgctgagtcagaaccatgccgttcgttccgttaacctcaaaagcaaggtgcgtatcgccgcagaagctaatggtggaaggttattgggcgtcggcgcccatcaagtagcctatattcaattgccaaatcgcaggcctttaaaggtatcactcacacttggaacccacgcgcaaacggcgtcatggcaaaacgaatcccgggcgcttatctatgatcatattggtttaaacacaagctgcttagagcgtgcagtatcggcagatcaacagtcctatccatgggtgaaagccactgaggcggatgtacattttgcctattggaaggaagattatgccgtccgtgaactggtgattgccgtcttgcataagtacaaaatcgtatggggtggccatcctgctatcacgccgatgctatggagcatttgcgaggacttgaatattgattattctgaagctgttgtactgtaccagagcaggttttttgaagactattttcctgaagagaatcgtcgcttcaagaatgttatttttaccaatgcggttgatggtgatcgagaatccagcttgctgctcatgagaaaagaaatgctttcccggccagacctggttggggcagtctttattggagggatggaaggcgttgaagtggagtatgaaatctttaaacactatcatccgggtgccagtatcttacccgtaccatcaccagggggcgctagccttaatttggccatagactatggctatg

SEQ ID NO: 55535 - DNA, 465 bp, Glycine max
  Peptide Sequence Number=SeqID_147220
atggcttccagaaagagaaagagcattgataatgttctggggagaaacattttacctgtgaggaaggtagagctctatcacaccgagctagatgactttaaggctgaattggaaagttgtaatttccataaacgcctcaccaatttagccgatggtagcatagacctggctttggtgaaagatttctatgcaaatttatacagttctgaagaccgtccaccaaagcagttcagagtcaaaagtcatttggtgaagattgatgctaacagtctcaacgcattcttggagacacctgtggtactagctgatggagagactctacccgcatactctagatactgctggttgcctacggacttcaaagagatagaggcttccttatgcatacctggccgagggttcatcttgaactctgagggccatcctgggaagattcttaggaaggatttgactacactggctcag

SEQ ID NO: 55536 - DNA, 1258 bp, Glycine max
  Peptide Sequence Number=SeqID_147221
ctcgcttactcccgtattactgcgacagctgaacgcctgggaaaccacgcttccgccaggtttgaaaaaactgacgattgggggcgatctggctgcgccaaaagaggtggaagccttcttactccggcagccatggcttgagctatatctgacttatggcatcagcgaagccggaccccgagtgtcgacgtgcccggcacatctgctggggagaggatattatgcttcagccggacgtcctattgaccagacggaagttcgcatcctgccaggtgcagacgggcaggacgggcagggggagttgctgatctgttctgataccttgcttgtaaaacgtatcgggcggggtaaccgacaaacgtttattgagcttgatggcaaacgctggcttcgcactggagatatcttcttccaggacgctgatgggttcctttttttcaaaggcagaatcagtgatttcattgtcattagggatgagaaggtcaatatcggtgccgtgaaacagctgtgccgggaaattaaaggggaatcagatgtgtttgaaacatggccagcggacatcgttcgcctcaagtttcctgaggaacactgggattattatatttcacgttatgagcattttcgcgacgaggtcatacgtaacctgacgcctcaggactatcttcgcgaaatgctgaaacaaacacagcgtttaccctgtttctgttcggaaatggccgatgtcgcggcgatactgtatagccagattatcaataaacccaatgagcggattcggtattttgatatttctgcatatgcccaggtgctggaccgtaaaagaaggaaagtggttaagcctgccgagctggatgggtttgatgcgacagatatcacattcgatttcattgaaggaaaaatgatgactactacaacgtatgtcgccgatgtagacggcatgggatggacaactgcgtctggcgatcgtatcgaggatgttttccagactttactggaaaaacaaaccggtattgcgcctgcgccatcggatcgaggcttgcgtaccgatctggccgccatgctgccgggtgaatggcctgccgaaatgcgcgaaaaattgatcgctctgacgaaacgcacggcccgccaggcgctagaggattcgggtgcagcagaacctgtgccggaggagcgacgctttttgattgtcggaaccagtctgggattccgcctcgacagcgaggcgtattgccgggagccgctcgacggctgggtcaacgag

SEQ ID NO: 55537 - DNA, 567 bp, Glycine max
  Peptide Sequence Number=SeqID_147222
atggcgacttattctagcaacgatttccgtccgggtcttaaaatcatgttcgagggcgaaccttacgccgtcgaagccagtgagttcgttaagccgggcaaaggccaggcgtttgcacgcgtgaaaatgcgtcgtctgctgaccggcacccgcgtggaaaaaaccttcaagtctaccgattcttgcgaaggcgcagacgtgatggacaccaacatgaactacctgtacagcgacggtgagttctaccacttcatgcaccctgagtctttcgaacagcatcaggttgacggcaaaaccgtcggcgacgcggccaaatggctgcaggataacgcagagtgcatcatcaccctgtgggatggccgtccaatcgccgttcagccgccgaacttcatcgaagcggaaatcaccgataccgatcctggcctgaaaggcgataccgcagggactggcggcaagccggctaccctgagcaccggcgccgtggttaaagtgccgttgttcgtccagatcggcgaagtgatcaaagttgacactcgctctggcgaatacgtctctcgcgttaaataa

SEQ ID NO: 55538 - DNA, 1132 bp, Glycine max
  Peptide Sequence Number=SeqID_147223
atgctgagcgtgattgaccgccttgagcatttgctctacctgatggaatccgagatcgacatcttgcaggttgagaagcgtatccgtggacgtgttaaacgccaaatggaaaagagccagcgcgagtactatttgaatgagcaagtgaaggccatccagaaggagcttggcgagcaggatgaaaacgctgagatggaagagctggaacagcgtattaaaaatgctgcgatgcctaaagaagcactggctaaagtcactgctgagttcaaaaaacttaaattgatgtcacccatgtcggctgaagcctctgtggtacgcaattacattgatacattgctcaatctgccatggaaaaagaaaaccaagatcagcaaggatctgcaggccgcagaagcgattttggacgctgaccactatggcttggacaaagtaaaagaacgtattgttgaatatttggctgtgcaacaacgcgttggaaaactcaaagcgcctattttatgcctggtagggccgcctggggtaggtaaaacctctcttggccagagcattgcaaaagccgtgaaccgcaaatttgtgcgtatggccttgggtggcgtgcgtgatgaagcagagattcgtggtcatcgccgtacttatattggttctatgccaggtaaggtactgcaaagcatgaccaaggttggcgtgaaaaacccgttattcctgcttgatgaagtggataaaatgggccaggacatgcgtggtgatccatcttcagctttgttggaagtgctggatcctgagcaaaaccatacttttgccgatcactatgtggaggttgactatgacctcagtgatgtcatgtttgtcgcaaccgcgaacagcatgaatattcctgagccattgctggatcgtatggagattattcgtctctctggctatacggaagatgaaaagatcaatattgctcagcgctatttgttgcctaagcagctgaaggcacatgctttgaaaaccacggatatttctgtggctgaaagtgtgttgcgtgacattgtgcgttactacacacgtgaagcaggtgtgcgtcgcctggaacaagaggttgccaagatctgccgtaaagcagtgaaagagcaactgctggctaaag

SEQ ID NO: 55539 - DNA, 607 bp, Glycine max
  Peptide Sequence Number=SeqID_147224
tcttgctacatgtcctcaccattgaaggactacacgtcctcgccgtcagagggctacatgtcctcacctttagaggactgcacatccaaaccttcaaagggctacaagcccttgccttcatagggctacacgccccaaccttcagaggactacacgccctcacattcagtggactacacgtcctcgcgttcagaagctacatgtcctcaccattgagaggactacacgtcctccccttcagagggcaacaagccctcaccttcgtagagttacacgaccttgccttcagagggctgcacgtcctcgcctttagagggagcacgcccttgccttcagaggactacacggctacacgtcctcacttcagagggctacacctcctcgcctttagaggactgttcgtccatgccttcagaggactgcacatcctcgcctttagaggactgcatgtcctcccctttagaggacttcacatccacatctttagagggctgcatgccctcaccttcataaggctgtgtcgcaacctacccttcggcgggagggcgacgcgtgactcgcgggatgcgtgttccacgaaaggaatacgcgcggagtcgccaccaac

SEQ ID NO: 55540 - DNA, 162 bp, Glycine max
  Peptide Sequence Number=SeqID_147225
atgaggtggaaggtgggggatggagagaaaattagattctggaaagacaagtggattaatcaacaggaatcactagcagaaagggaggtagaaggacaaagcatacagcaacagcaaactgacatttgggagtggctaggagatccatcagggaattactaa

SEQ ID NO: 55541 - DNA, 438 bp, Glycine max
  Peptide Sequence Number=SeqID_147226
accaatatcctggcgctcaacgcagccgttgaagcggcacgcgcgggcgagcagggccgcggtttcgccgtcgtcgcgggggaagtccgtaatctggcaagccgcagcgccaacgcggccaaggaaattgaggggctgattgctgattcggttaatcgcgtagaacagggggcacagctggtgggcgacacgggcacgaccatggatgccatcttacgcgacgtgacggaagtgacgaccattatgaagcaaatcgcttccgcttctgaagagcaaagcaagggcatttcgcaggtcgggattgccattacgcagatggacggcgttacccagcaaaacgcctcgctggtggaagaagtttccgcggcagccgccgcgctggaacgtcagaccgaagagcttcagcgttcggtgcagaagttccgcctgacggcataa

SEQ ID NO: 55542 - DNA, 396 bp, Glycine max
  Peptide Sequence Number=SeqID_147227
atgaggatcaaaaggtctattaaggttgtaatggggccaaggacaaggtatggagaaatatggaataagtggctaaatcccaaaggaatagaggagcaaaggggaataacctttgagaaacaacatttcattcagcatgtccaaccatttaaccaatatacaatgtacataaggtatggcccaaaatacatcatgaagcatagccaacaaaacaagttgtccaatgaaacaaaaaccccccacacttattcccaaaacaattccaaagctccaaaattccttaaggatatggacgcatcaacaagaatcaagccaaggctattgtgcaagcaatcaatggggcaaaacacaccaaatgattataatgatggatggctcaaattctcacaaaggtaa

SEQ ID NO: 55543 - DNA, 328 bp, Glycine max
  Peptide Sequence Number=SeqID_147228
atggagagatctcatagcccaagtcatcccgctcatgacggagagggagatgatcacaattatggattgaatccggactacgaaaaaggcaagttcgaatatgcttccaatgtggcccccaacaacaacagaagagccccagtagtgggcgcgaggaaaaaggaaggagatgcccacgcggtcaccatcgccccgacaatcatttggtggtggccatacacggaagggtcttccagcgaccctaccccaggtggtatgacccgggtgccaaatgtgagtaccatagtggagctcccagacacaacattgactcctgcctcccgttcag

SEQ ID NO: 55544 - DNA, 48 bp, Glycine max
  Peptide Sequence Number=SeqID_147229
atggagaattgcactaagcaatcactacgcatagctccaaactctaag

SEQ ID NO: 55545 - DNA, 705 bp, Glycine max
  Peptide Sequence Number=SeqID_147230
atgcccactgggaggaaggaagccatatcttttctctgggttctatccctccacgacaagagtttccaaggtagtgaaaacctcagcacaagagttggaccgtgtaaagcaaaacagaaatggagtagtcggagtaccaaggaagtgtttggaggaaaagggcaaaggccttggcaaaatcaaggcgaatgggcttcttttattgacatcttggcgcttttgatctttggagttgtcctctttccgaatatggaagggttggtggacctagcagtgatcgacgcttttctcgcctatcataaccacaaagaaagcccggtcgtcgccattttggccatgtatgacacgttcaaccggggatgtagggccgtctatccgctacaaggtcaccgctcgtgcgtcgaaaaaggaaaggcgaattgggaccaactcttggctagcatggagaggcgtctgttaattggttccctcgctggaaggaaggaagaattaggattctatcttcatgcgaaggatgtccaaatgtcccttgatggaacaaggggttgtattaattataatcccgtcctcgtcataagacagcttggctaccccatgagaggagtgccatcagacgaaagcatcacgcctttcatcgcatggggtttcagtgaccacaacgcgagggtattccaaggagttcgcaaggcatgggatgcggcgtga

SEQ ID NO: 55546 - DNA, 615 bp, Glycine max
  Peptide Sequence Number=SeqID_147231
gaggtgcaagaccagatgaaggctgacatggaagccatgatgagtatgagaaaaatgatggaggtcaacacggctacagtcgttgccgcaagtactaccactgaggtggacccgactcacccatctggcattaatcaagcaagtcatccagtcccggatatgcattctttcccaccatatggtttgcctcccaactatacaccgcccaatgttgcacacactcccgatgagaacgtcgataactctgctcccatgcccattgagagccaacaaccccaatctggtcatgcacaggtccctcaacccatgggggagacatatgaagcaccccgagaccacactctagccgactctgagcctcacctcggatatgccactgaggggcaggcttttggtggcatacccctgccaaacactttgggggggccctcggtatctgccacaaccacaacccttacattttgtggtggaaagactacttcctaccatggcagaaattatgcctttgctgacatggtagagttgtgcctagtgcccgacgtggtcattcctctgaagttcaaggtgccggatttcgataagtacacgggactacttgccccaagaatcacctga

SEQ ID NO: 55547 - DNA, 468 bp, Glycine max
  Peptide Sequence Number=SeqID_147232
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcagctccctcgtgcgctctcctgtacctgcctttcggtttaccggtgtcattccgctgttatggccgcgttatgtctcattccacgcctgacactcaattccgtg

SEQ ID NO: 55548 - DNA, 66 bp, Glycine max
  Peptide Sequence Number=SeqID_147233
atggacacccgtctccgtgtgattggtgatcccatgaatgaagttcaacgggggtgggggtcataa

SEQ ID NO: 55549 - DNA, 231 bp, Glycine max
  Peptide Sequence Number=SeqID_147234
atgtggacggaccgatttgctcttactttgaacaggagtcaagaacttcccccattgctagccaaggccaaagcagtggcggacacctactccgcccccgaggagatccacggacttctcagctattgttgttggtcatcgtcctttgtcacgggaagccggaaggtccatatcaccttactaattgtacacatggggcactgcgcccaatgcgcaagtaagaaaatctaa

SEQ ID NO: 55550 - DNA, 441 bp, Glycine max
  Peptide Sequence Number=SeqID_147235
atgatacgcggagataccttacggttatccgcacccttttgtcatccagaggcggcgggcccgatgacaagcagagaccaaatttggtcattctgcacccttgtgtcatccagaggcggcgggcccgatgatacgcggagataccttacggttatccgcacccttttgtcatccagaggcggcgggcccgatgacaagcggagacgaaagtttgaggcggcgggcccgatgacaagcagagacaaaatttggtcattctgcacccttgtgtcatccagaggcggcgggcccgatgacgatgttctgacaagcagagacaaaatttggtcattctgcacccttgtgtcatccagaggcggcgggcccgatgatacgcggagataccttacggttatccgcacccttttgtcatccagaggcggcgggcccgatgacaagtag

SEQ ID NO: 55551 - DNA, 237 bp, Glycine max
  Peptide Sequence Number=SeqID_147236
atgggggtgcaaatagcaaccaggcccacttgggccctccagaagattcctccagaaggttgttgcttctggaggaagcaaccctgctcgcctgggcgagctgggtggcaaaaaatccaagccgaggcgcttccgaaacgtttccgtaacgtttccgtgaggaatttcgtgaaggtttcgaccgttcttcgacgttcttcattcgttcttcatcgttcttcaatcttcaacgggtaa

SEQ ID NO: 55552 - DNA, 564 bp, Glycine max
  Peptide Sequence Number=SeqID_147237
atggatcaacttcaacagcaagccttccgcaaagcctatggtaagatttgggacctagctagggtagaagtctccatggaaccgattgcatccctttcccagtattatgaccagcccctaaggtgcttcacattcgaggacttccagctagtgccgactgtgaaagagtttgaagaaatcctgggatgcccgctgggaggaaggaagccatatcttttctctaggttctatccttccacgacaagagttgccaagtaccaaggaagtgtttggaggaaagggcaaaggccttggaaaatcatagcaaatgggctttcttctattgacatcttggcgcttttgatctttggagttgtcctcttttcgaacgtggatgggttggtggacctagcagcgatcgacgcttttctcgcctatcataaccacaaagaaagcctggttgtcgctatgctagccgatctatacgacacctttgaccgaagatgtgaaaagaacaatacaaggatcgtttgttgtactccagctctttatgtattgttagtctcgcacctttttcgccaagag

SEQ ID NO: 55553 - DNA, 589 bp, Glycine max
  Peptide Sequence Number=SeqID_147238
cctgcccaccctggaaacggctcagccggaggtagggtccagcggctggaagagcaccgcacgtcgcgtggtgtccggtgcgcccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgccaaatgcctcgtcatctaatagtgacgcgcatgaatggattaacgagattcccactgtccctgtctactatccagcgaaaccacagccaagggaacgggctaggcggaatcagcggggaaagaagaccctgttgagcttgactctagtccgactttgtgaaatgactgagaggtgtaggataagtgggagctggaaacagcgaaagtga

SEQ ID NO: 55554 - DNA, 303 bp, Glycine max
  Peptide Sequence Number=SeqID_147239
atgcacacacaaagtttcacaattccacaatttcctaaaataggcctaactcacaaaaacagtccccagtggagtcgccaactatcgcaacctacccttttgcgggcgagcgaggcgaggctcacgggtgcgtcttccaaaggaggaaaatgcgcagagtcgccaccaacatttatttgtggaaaacgtcggaaaaatcgaaggaaaccggtcatgaagaataatccagatttgggagttgtatttacgtttgaggaaggtattagcacctctcacgtttgtcccaaaggacaacagccttag

SEQ ID NO: 55555 - DNA, 336 bp, Glycine max
  Peptide Sequence Number=SeqID_147240
atgggtgaagtagaagaggcgcaagagcagatgaaggccgacatggaggccatgagagagcaaatggccacaatgatgggggccatgatgagcatgaagaagataatacagttgcagttgccgttaccagtgctgttactaaggcaaagatttgggaagtacgaatggccccatgatgtgcaaattcaaaatgagcacgccttcccgccatatggcttgcctctcaactatacgccacccaatgtggcgtacacttccaatgagaatgtcaataactccactcctatacccattgagagccaacaaccccaaactgatcatgcacatgtctcttaa

SEQ ID NO: 55556 - DNA, 372 bp, Glycine max
  Peptide Sequence Number=SeqID_147241
atgaggacacgtagccctctaaaggtgagggcgtgcagccctctgcaggcgaggatgtgcagtcctctgatggcgaggacatatagtcctctaaagattgactgtccttttgaaaaaggtgataattcatgcaaccttgtcctatcttttgtaaatctctccgggaactccctcagagttgacggtgtcgcaacctacccctcggcgggagggcgacgcgtgactcgcgggatgcgtgttccacgaaaggaatacgcgcggagtcgccaccaacgtttatttgaggaaaacgtcgaaaaaactggaaaagacgcgatctacgaacttgtattagcaccccacacgtccgtcccaagggacggcagcctttaa

SEQ ID NO: 55557 - DNA, 318 bp, Glycine max
  Peptide Sequence Number=SeqID_147242
gaatcgcacccacaaagacacccagtggacccggagaagtccaacagggccctggggtttccagctctggttacgggcctctatagtcctacagggtgcccgttcccctcggcaaggtcacgccatcatgacataggcctctgtcagttctacggagtgcctgtcgcccccagcaagatcatcaggccccctactaatcgagctttcatcaagaagtactgtgtccccaggcaggcgcagggtgaaacaccacagcagcctggggatggccggcagcgggcaacagacgcaccgccatcacctctagagttcacctaa

SEQ ID NO: 55558 - DNA, 489 bp, Glycine max
  Peptide Sequence Number=SeqID_147243
atgggtgatcaagaggagacacaggaacagatgaaagccgacatgtcggctctaaaagaacaaatggcctccatgatggaggccatgttaggtatgaggcagctcaaggaaaagaacgcggccactgctgccactgtcagttcggctgccgaagcagacccaactctcttggcaactgcgcaccatcctccctcaaacatagtaggacggggaagggacacactggggcacgatggcagccctcacctgggatacaaccgagcggtttacccttatggattgccggccaactactcaccacccgtcttgcaagacgatgcgggccatattgcttctcccgtccttgaaagagagcctcctcaacagcccgaagaagtccacaaagaccctcaagactatgctcgaagggatgtcgagttctatcccccgatccccgaagggccggcacccagcacgttgcctcagcctaacatcgcaacacaaccaata

SEQ ID NO: 55559 - DNA, 279 bp, Glycine max
  Peptide Sequence Number=SeqID_147244
atgcctcaaaatgttctttacgatgccattgggatatatcaacggtgctgttccctcctgttcagtactgaacggggtggtgtatccgctcaattcggcacacaagcactacagccggacatagcgctggcaagtgtaaagccggggtgcctaagacgctgcagcgtaactcaccaccccgccgcgcttaattgcttgccgctcagggctgccgctttcccattcgggaccatgtcggctgcgcaactgcttaatgaatcggccaacgccgggcgatga

SEQ ID NO: 55560 - DNA, 564 bp, Glycine max
  Peptide Sequence Number=SeqID_147245
atggtgaaagttggaacctcttacgtgccgatcaacgtctcattttcgccaaaagttggcccatgggcagttttcccgtgctccagtggcgtatcatggtttctatcagctgttccctcctgttcagtactgacgggaattgttatccgctcacaattcggcacacaagcactacgaccggaagcatcagcgggcaagtgtaaagcctgggggctgcccgctttccattcgaaaccatgtcggctgcgcaactgtttgaatcggccaacgcgcgggcgatcgaggcgggctttcgcgtattaccagctggcgctaaagggcggatgtgtgcatactggcgattactatgttgggtacactgagccagggtgttcccagtcagaatgcgttcgtggcagaaaaaaaggctgcaccggtgcgtcagtcagaatatgtgaatacaggactcactatcagggcgaattccgctcactgagctcctaccgctcggtctcgactgcggcgagcgctcagaacagtggctacaacgggcgcggaattcctggatatagcatgttaccgtaa

SEQ ID NO: 55561 - DNA, 800 bp, Glycine max
  Peptide Sequence Number=SeqID_147246
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttttgattgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55562 - DNA, 306 bp, Glycine max
  Peptide Sequence Number=SeqID_147247
atggacttgaaggaaaattgtacttatgtcatgcacaattttaaagtgctaaaaaacaacggtcaatacagagtctgtgatcaccaatttaaattggtgtttattgaagttactgttgtaaggcagtgtgctctagacgacctcccttttagaaaatacaggtttgctgaatttggtgatgttgtggctaggcagtttgaacttggcctattggttgacgttatcggtgttgtggacgaggttgtctttcgtcatgtttcaggaaaaggtagaagggtagtctttaaactaaaggacttgaggtaa

SEQ ID NO: 55563 - DNA, 294 bp, Glycine max
  Peptide Sequence Number=SeqID_147248
atggttacgcgatccgtgaaattccgtaatgtggcggaaaccaaaaggaagaattgttacgcaatccgctcacttgtgccttccagtttcttccaccagaaggtggttgcttctagaggaagcaacctggctcgcctgggcgagctgggtgggaagctcctcccctattttgctataaatagggggagggatgaagaaggaaggggttcagccttcttggcacttcgtattctcttaaaattgctgaggaaaattgtttctgtgaagaaaatccaagccgaggcgcttccgtaa

SEQ ID NO: 55564 - DNA, 273 bp, Glycine max
  Peptide Sequence Number=SeqID_147249
atgacacaacctccaccctgtgagaggactctaagggaaatggctgcacctgatttcacctacgaaagcttgtgcatccaataccctaatgagaatgtcccatatgttcttaaaactggactgatccatttgcttccaaagtttcacggccttgcaggactcagtaacatggagagaagtatgatagatgttgctagtggtggagcccttggagacataacccctgctgaagccagaaatttaattgagaagatggcttccaactcccaatag

SEQ ID NO: 55565 - DNA, 413 bp, Glycine max
  Peptide Sequence Number=SeqID_147250
atggtgaaagttggaacctcttacgtgccgatcaacgtctcattttcgccaaaagttggcccagggcttcccgctgtccctcctgttcagctactgacgggatggtgtgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggaatttcgtatggcaatgaaagacggtgagctggtgatatgggatagtgttcacccttgttacaccgttttccatgagcaaactgaaac

SEQ ID NO: 55566 - DNA, 360 bp, Glycine max
  Peptide Sequence Number=SeqID_147251
atggctcaattgatttctgatgccatccactatttgcaaggatcgcgcccacaagacacccagtggacccggagaagtccaattgggccctggggtttccagctctggttatgggcctctgtcagtcctacagggtgcccgtttcccccagcaagggatcacgcccgcaagacaccagtggacctgaagaagtccaacagggtcctggggtttccagctctaattacgggcctctgtcaattctacggagtgcccgtcgcccccagcaagatcatcatgccccctattaaccggactttcatcgagaagtactacgccccaggcaagcgcagggcgaggcatcatagtagtgggcaatag

SEQ ID NO: 55567 - DNA, 465 bp, Glycine max
  Peptide Sequence Number=SeqID_147252
atgggactcaccctttacttgggaatgaagaggggaaagatagcatgtcacaagagcgaggcgaggtttgtaaccctactgcgagagggacgcctcgcgagccgggcttctagagatgaggccttttggcgaagccaagtcaatttcgggccaccaaaccctgcaactgatgagaaggcctatggagtaaagggaagcgtgtacgttgtcacactccctgccttcaaaagggggacaggagacggccatctcgaggcacatcacgacctacaggcaagaccggcgagacctgggaaggctacccgattgggagtcagaggatccatagtacctgcagccccgcggacttcatcttcatcatttttgaaagcggggggaaaggatctcctttctgcaacggaaaaaaacggagcttatttgactcagcacaaccagactggctacgagagcaatcagagtgggtag

SEQ ID NO: 55568 - DNA, 769 bp, Glycine max
  Peptide Sequence Number=SeqID_147253
ggtggacccttgggtacacgccctcgccttcagaggactacacgtcctcacctttagaggactgcatgtcctcactttcagaggactacgcatcctcaccttcagaggactacacatcctccacttcagaggactacacgtcctcgccttcagagggctacacgctctcgttttcattccttggccaccccctgatattggagggcgaccaactgtgcgagcacagccagagagggaggctatcacgctgctactatacataccggggcaagatttcacccgtgccgctgcaaagagacgagtgcggatcgtgtgcaccaacatgaccactcttacacaaatacagatgacgttgctacttagaaacattctgcccaacgaccacaatgccgatctcccccgggatcgtgcccacaagacacccagcggacccggaggagcccaacaaggccctggggtttccaactctggttacgggcctctgtcagtcatacaggggatcacgcccgcaagacaccctgtggacccggagaagtccaacggggtcttggagttgccagctctaattacgggcctctgtcaattctatggagtgcctgtcacccccagcaaggtcatcaggccccctactaatcgagctttcatcaagaagtactgctcccccaggcaggtgcagggcgaaacaccacaacagcctggggatggccggcagcgggcaacaaacgcaccgccaccacctctagagttcacctcagctcatccacaataa

SEQ ID NO: 55569 - DNA, 201 bp, Glycine max
  Peptide Sequence Number=SeqID_147254
atgttgctaagtaacaacgtcatctatatctgtgtaagagtggttatgctggtgcgcatggtccgcactcgtctctttgcagcggcgcggttggcaatccttgaggatcagagggtgacccaggaactgattaaaggaaactactggccccttaaccaggagtgcaagtctcggttaagcattaggggtagaggaccttaa

SEQ ID NO: 55570 - DNA, 669 bp, Glycine max
  Peptide Sequence Number=SeqID_147255
atgctggaaagtttaaaacaacaacaagaaatgtcagttctagaattgtacatagaaaaggatgtggctggtggttcaatgtttcagtctgcaaattcgcttacatcatgtggaaattatttatctaataatgagacacaaccgccaacaaatatgagcaatttacatcttgacgaagatgatgatcataatgatgatgattatcttgtgtctaaatcaaacgttgaagagtctttagacgaagatgacaatgttgatggtatatctgatacagacaatgaagtccccgacatgattccaccagtaagaattgttcacccagcagaaggtgtacaagaaattcagaatccattttggaatgatgctttgcattataataatatcaactggagtcatcctgatgaggaggacatttgtggtttggagatgccatctagttttaatgttggccaagaattatatgttggcatggaatttgatagtaaagatgcggtcaagaatgcagtcaaacaatatgctatgaaggtgcatcaaagtttcaaagtggttgaaagcaaatgggacaagtatgttgtttgttgcttgaataaaaatgcagattgtccttgccctttctatatgagggcaattctatctaaaaaaactgattcatggaaagtcactcaatag

SEQ ID NO: 55571 - DNA, 279 bp, Glycine max
  Peptide Sequence Number=SeqID_147256
atggctcaggagcggacacggatgtcttgtgtcttgttggaacaagtgcgaaaccaaccaaacacagagggcgggtacttccgtggtaggcccgctatgccgtttcgagtctgttttatgcggtccaaacctcttgctgaatccttgaccacagttgcaattctgctcaaagaggggagacacccggaggaaagatatggttttcttcccccgagaggacatcctagaatttcctcaattcttcaatggttggtactaattggaagtctccgaatgtga

SEQ ID NO: 55572 - DNA, 234 bp, Glycine max
  Peptide Sequence Number=SeqID_147257
tgaagaaatctacccccaagaagaaggacaaccattagtggttaaagacaagtgtaaggagacacttgcaagcattgccacacctcttgggcttgagtttattcctcaagtaaagaagttgttggatgaggggcttcccatggaccctgagagaataaaggtcattcctgagtggcctactccaccatgtgttgaggaaagaatccatgagtttcaagaacctctggatttgag

SEQ ID NO: 55573 - DNA, 282 bp, Glycine max
  Peptide Sequence Number=SeqID_147258
atggggtcctacggtggtcacagttcgatcagagagggtgatacgccaatttgggtatctgcggattacatggagtggtttttccagatatctcacccattcatgataccgacccaggcaggtgaccaacccagacatgcacctgccccaaaccatgaggactacatgcagccggacatcccacaggttccagtggcatttgacccccctcgacatgcagtgatgattacgaaggctatgaggcgatcaaaagcaaaggttggagcatttgctcaaccttag

SEQ ID NO: 55574 - DNA, 537 bp, Glycine max
  Peptide Sequence Number=SeqID_147259
atgccgtcggcatcgatattgcggaagatccgctttgatagcgagtccccaccgcggataggatcatatcagccctgtcgcgtctcgaaggggcgtggcgctccagcagctcgccagtatcgctctactttgtcgccagccgcgctggaaggagaaggtcaggagcgaattcaggcagaagtacgtgcgcagcagttgcgctgcttcagtaaccgcatttcaggcttgcctccaggcggtgaaaaaaccgggttcgttatgaaagccgatttccagtctcagaagcgcgccgaatatctcgagaatctcttccgcctcttcctgttcacaggcgaattgccgcgcgggcaaaggcctgctcaatcctaccgacagctcgcgctccgcgccttcgatgcggccgtgcagcacgaactccggctggtcgtggcgaatgacccgaccggcctgcaggctgcgaaaggcgcggccgtggccgagcgtatacaccgcttccagcacgctggtcttgccgctgccgttggcgccgaccaggaa

SEQ ID NO: 55575 - DNA, 88 bp, Glycine max
  Peptide Sequence Number=SeqID_147260
atgcagagttcgtcgagaccacccggttgtgcacgtaactgcccctccatagatgatcagcctggggccaaaagaagttccctaccag

SEQ ID NO: 55576 - DNA, 369 bp, Glycine max
  Peptide Sequence Number=SeqID_147261
atgttaggatttacacgcgattctcctcaaatttcagccagcccgcatcaattggaccttgcaccttacgctttgaggtcatacagtgctcaatggaatgccccagggattcttcatgacaagcacacgttgcgttcgagtcgtatcctcggaaaaatggaggttgaggaaaccttgcaggggttatggctaccattgcattatcgagtggatatgggagcaagtcagcataggacaccagaattggggtgggttttgtggtttgatgtagggatggtctatgtggataactgggtggtgggtaaggagatgggttgttattggctgagtaatgacattgttgggttgttgggaaactcggccatatag

SEQ ID NO: 55577 - DNA, 57 bp, Glycine max
  Peptide Sequence Number=SeqID_147262
atggacacccgtctccgtgtgattggtgatcccatgaatggagttcaacggtattaa

SEQ ID NO: 55578 - DNA, 353 bp, Glycine max
  Peptide Sequence Number=SeqID_147263
gtcctccagagtccattctatcagtagagcagttcattgagaaggtatcctggcctggaaccttactttctactgtgggagagggtgagggcccccagtgctcaggagtagagatgagacctgagggggctactttttctgagccaattgtgccagctatacatgagactattgaagcagatcctcctacaccagtacatgagagaccaattgatcttcctacacccatcatggagatgccagaagaccctaccacaccagtcctaagacagtcatccactcctccagctaccccagttttacatctgacagataaggaggatatgcaggaccaggacacacaaggcacatag

SEQ ID NO: 55579 - DNA, 627 bp, Glycine max
  Peptide Sequence Number=SeqID_147264
gaattagaccgccaaaggcaagtcgaaaatggggtggtcggaataccaagaaagtatttggagggagtcctctttccaaatgtggatgggttggtggacctggcagcgatcgacgtttttctcgcctatcataaccacaaggaaagtccgctctctatgtggggctggtttcacacctttttctccaagaaggtaggcccgtctatccgctacaaggaaggaagaatcaggattctatcttcatgcgaaggatgtccaaatgttcccttgatgggaacaaggggttgtattaattataatcccgttctcaccataagacagcttggctaccccatgagaggagcgccattagacgaaagcatcacgcctttcatcgcacggggttttagtgaccacaacgcgagggacagagagcttaggggaagcagtaatgggatcatcggcggctatcataaatggctgagagtccgaacacaaggattggattggctcccaaatctaaagactgtgagggacgatgaggttaaagcttcggaagaaagtgatgaggtacaagccctaaaggcagagcttgaaagagcccgagtagtcgaagagaagttcaagtccatagccatcaaagtctaa

SEQ ID NO: 55580 - DNA, 507 bp, Glycine max
  Peptide Sequence Number=SeqID_147265
atggcgcgtgaaggggcggaggtcaccggcctggatatgggcgccgagccgctggagatcgcgcgtctgcacgcgctggagagcggcgtgagcgtcaattacgtgcagcagacggttgaagcccatgcggccagccatgccggtcagtacgacgtggtgacctgtatggagatgctggaacacgtgccggatccgcgctctgtggtgctggcctgcgcgcagttggtaaaaccgggcggcgaggtgtttttctccaccatcaaccgtaaccctaaagcctggctgctggcggtgtttggcgctgaatacgtactgcgcatggtgccgcgcggtacccatgacgtgaaaaaatttattcgtcctgccgagctgctgaactgggtggatgagaccgccctgcgtgaacgcaatatgactggcctgcactacaatccgctgaccaaccagttccgccttggccgcagggtggacgtcaattatatggtgcatacccaccgtcaggcgtaa

SEQ ID NO: 55581 - DNA, 335 bp, Glycine max
  Peptide Sequence Number=SeqID_147266
gtaggttccaaggtaaacatcccgttttgaactctgcatctaactcttcatgtaactttctgattcaaattgcgattgcccagatctctgaatggactgtggctcgaggaatccatacacaccggaatttcccactcgcatacttgtctcagaagcaaaaagcagtccaagaaaatgatgaggatctagagtttgaggatattgaacttgaatctgaagaagaagaaatcatggataattttgaggcgtccgatggagaagagggagagggagatgctccactaccttatgataacaatgaagaggattatgtggggattgaagaagacgattag

SEQ ID NO: 55582 - DNA, 191 bp, Glycine max
  Peptide Sequence Number=SeqID_147267
ccttaaccggaagtggcgtctacccagacttatcttccttaaccggaagtggcgtctacccagacttatcttccttcaccggaagtggcgtctaccttgacttatcttccttcaccggaagtggcgtcatccaaaccttcgtagcctgtatcaaacgatcctccctcctatttgaattctgtttggggtaa

SEQ ID NO: 55583 - DNA, 447 bp, Glycine max
  Peptide Sequence Number=SeqID_147268
atgggtaaggattgcaccccacaaagacaccccagtggacctgaagaagtccaaacagggccctggggtttccagctctggttacgggcctctgtcggccctacagggcgcccgttccccccagcaagttcatgtcgtcgtggcatagggattgtgcccgcaagacacccagtggacccgaagaagtccaacagggtcttggagttgtcaagctctaattacgggtctctgtcatcatgcccccctaccaatcgagctttcatcaagaagtactgcgtctccaggcaggcgcagggcgaaacaccacagcagcctggggatggccggcagcggagaacagacgcaccgccatcacctctagagttcacctctgctcatccacgaaaaggtttgagtattgcctacaccacatggccgaccaataggcgaccaagtccaaagccaaag

SEQ ID NO: 55584 - DNA, 297 bp, Glycine max
  Peptide Sequence Number=SeqID_147269
atggcttacgaacggggcggaaatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggtag

SEQ ID NO: 55585 - DNA, 399 bp, Glycine max
  Peptide Sequence Number=SeqID_147270
atgcaagttattctgcttgataaagtagcaaacctgggcagcctgggtgatcaagttaacgttaaagcgggctacgctcgtaacttcctggtaccacagggcaaagctgttcctgctaccaagaaaaacgttgagttcttcgaagcacgccgtgctgaactggaagccaaactggctgacgttctggctgctgctgaagctcgcgcaaccaagatcaacgaactgggttcagtcaccatcgcttccaaatctggcgacgaaggtaaactgttcggctctatcggcacccgcgacatcgctgacgcagtgactgcggcaggcgttgaagttgccaagagcgaagttcgtctgccgaacggcgttctgcgtaccactggcgagcacgaagtgcacttccag

SEQ ID NO: 55586 - DNA, 426 bp, Glycine max
  Peptide Sequence Number=SeqID_147271
atgcataaggcattatgggccaatgcacctctcccttatccacatttgattactctatttctgcgtcattttcaaattccgcttcatgatgaaccatttgttcaagtcaagcgttcctttgcaattggtgctggtgccatgacttcctttgggtaccgtaaagatcggaatggtcaatggctgaagaaggatgcactccctcctcaagatgagcgtactccttcacctcttcctcagcgcgatgattcagcactcatgaatgaagtcctctccgaattacagggtcttcgttcttatgttggtgaccgttctgactcattagatacacgctttgccggcatggacattctcctcacacagctcgaagaggatgtaggatacattcgtcagagtttcgatcttccaccactacctccaccttcttag

SEQ ID NO: 55587 - DNA, 1107 bp, Glycine max
  Peptide Sequence Number=SeqID_147272
atggctacctcaccaaaagaaacttcagctcctggttcaccctctgcaccatcaaaccaggaacgacctgaattcaatatccagcccatacagatgattcctggtcaagcccctgttcctgaaaaactggttcccaaacgacaacagggagtaaagatttctgaaaaccctagcattgcaacaagtcctagggaagtagacccggagatggataagaagatccgcagtattgtgagtagcattttgaaagacgcctctgttcctgatgctggtgaagatgttccaacatcctccaccccgaatgtttctgtgcctgatgttgataaagatgttccaacatcctccgctccaaatgctgaagccctcccttcacccagtgaagaggaatcaacagaagaagaggatcaagcctcagaggagacccctgcaccacgggcaccagaacctgctccaggtgacctcattgaccttgaagaagtagaatctgatgaggaacccattgccaacaggttggcacctggcattgcacaaaggttacaaagcagaaaagggaaaacccccattaagaggtcaggacgaatcaagactatggcacagaagaagagcactccaatcactcctaccacatctagaaggagcaaagttgcaatcccctccaagaagaggaaagaaatttcctcatctgattctgatgatgatgtcgaactagatgtctcgacatcaaagagggccaagaaatctgggagaaaggtgcctggaaatgttcctgatgcaccactggacaacatctctttccactccattggcaatgttgaaaagtggaaatatgtgtatcaacgcagactcgcggttgaaagagaactgggaagagatgccttggattgcaaggagataatggacctcatcaaggctgctggactactgaaaacagtcaccaagttgggagactgctatgagagtctagtcaaggaattcattgtcaacattccctctgacataacaaacagaaagagtgatgagtatcaaagagtgtttgtcagaggaaaatgtgttagattctcccctgctgtgatcaacaaatacctggacagaccaacagatggagtg

SEQ ID NO: 55588 - DNA, 800 bp, Glycine max
  Peptide Sequence Number=SeqID_147273
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatccacgccttgtctgcgtcgtcatctaacttcgcttaaatggaaccttgctcatgccaaacagtgcattcgtgaaactctggtctggagagaagaggtatatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55589 - DNA, 845 bp, Glycine max
  Peptide Sequence Number=SeqID_147274
gtcatggcatccttcagccggcttcagtcgcaaatgcaatctcagggacttgcagtgcctctgagcctctggttggtccctccggtcctcaagtgagcacaaaggggagttgtgttgatccctcaggaaacgatattgagaccggtgactctgacaggtgtagcttgtacatagaagcagatcctgcccgcctggttgccatagggagagtttatgagggatctactgttgttcataacactcctttgttgcctggccaagtaaaggtgagtgtggaggaggttacagatgcagatgctccagttcctgtacccactgatgaggtttccttagtggggcagacacttcacaccttccttacttggccgacacatctggtcaagtctttatcacagcaggtagttgtgtctccggcaaaaccacctccgaagctcgatccagaggttagatgggatgccaccgtgttcggggtctttaatcttgatttccccctttacataaagcacgaagacctctccgaaatcgcacacggtggtcaatgtctcagcatattagtgttacagttgtggattttgcatttcactgaaacatgtatgcgagtggggaattctgatatctatggattcctcgagccacagtccattcagaggtctgggcaatcgcagtttgagtctgaaagttacataaagagttggatgcagagttcacaatgcgatgtatatcttggagcctacctaaatgggccagacaactaccttaagggaattattaatagtgctatcaagggtcttgatgatgctccacaacctaaatcaaaggcttctgctaggtggattgtcatcaag

SEQ ID NO: 55590 - DNA, 201 bp, Glycine max
  Peptide Sequence Number=SeqID_147275
actcatcttctccttgaagtggcgtctcctctctctcttcctttctccattccgctgtcattcatcttccaagaagcaaaggaatccattgatgaagaagatcctaggcctacaagctccaatggagcttacaccatacgtggtctttttaaggcgttggaccttaaaatgatccatttttacttggtgagaaaaactgag

SEQ ID NO: 55591 - DNA, 336 bp, Glycine max
  Peptide Sequence Number=SeqID_147276
atgtttctgttagtgttttatatgcatagatctaccacaggcaatttagttcctctggacttggagattgaagctacgttaagaaggaacagagccaagaggagaagaaaattacttcaagacaagactgtagcgtccattcttgaggaagaaactcatttttctgattctacatcatctgactcaccatcatcaagggaatccgcgacctatttaccagaagccgtttctatggctgatgaacaccaacaaagagttacccttaagcactattcaagcagtttagtgccgcaattctttaccaacattgcatatcctgaagtgcatgctcacaac

SEQ ID NO: 55592 - DNA, 480 bp, Glycine max
  Peptide Sequence Number=SeqID_147277
atggcccgagttatgttggggaacggttatgaacccgggatggttttaggcaaagacaatggcggcataactagtctgataaaaacccaagggaatcgtgggaagtatggtttaggctataagcccactcaggcggacatgaaaagaagcatcgcgggaaggaagaacagtggtcagagctcgcgttggaaacaagaaagtgaaggaaacctgccctgccacataagtagaagctttataagtgcgggtctgggagacgaaggtcaagtggtcgcgatatgtgaagatgatgttccaagtactttggatttggtccgaccatgccctcctgatttccagctgggaaattggcgggtggaggaacgccccggcatttacgcaacaagcataatattcgatgacgagtcccccgaaggtactaatacctgggacccgtctatcaacttcgagcaagaaatgaaccaaacggaagatgaatga

SEQ ID NO: 55593 - DNA, 321 bp, Glycine max
  Peptide Sequence Number=SeqID_147278
atggtgaaagtgcactggaacctcttacgtgccgatcaacgtctcattttcgccaaaagctttggacccagggcttgcccggtatcaacaggctctggacaaacaggtttttggcgcaaagtgcgtcgggtgatgccaacttatgattccctagtgtatgatggtgttatttcgaggtgctccagtggcgtatctgttgtctatcagctgttccctcctgtcagtactgaatcggggtggtatccgctcacaattccacacaagcatacacgccggaacatcagcgctggcaagtgtaaagcctggggtgccaagacgtga

SEQ ID NO: 55594 - DNA, 327 bp, Glycine max
  Peptide Sequence Number=SeqID_147279
atggataaccacttgggtatctccgcctgccacctgacttctcgggtcaagatagcgaaaggtggggcggtcgacaaacgtgaggcttttgctcctacgtatcctcaatttgtgatgaggaactcagacctacgtgtctccgcctgctaccagactcttgggtcattggatagcaaaaggtgtgtgcgggttaccatcgagtgtctccgcatgccaccggactcttgggtcacggtaacaaaaggtggggtggtcgacaaaagcatggcttttgctcctacgtatcctcaatttgtgatgaggaactcatatctacgtagttcttga

SEQ ID NO: 55595 - DNA, 402 bp, Glycine max
  Peptide Sequence Number=SeqID_147280
atgtacccttccttgttctctttgaacctagtggatcctccactagaactgatccacaagagatgtaccctctcttgttctcagtcaacaacccaagtagatgtaccctctacttgtaccacaaaggatgtaccctccaatgtgttaagacaaagatctcaggcggttaaacctttgatactttgtgaatggggatacaaaagaattatcaagcgggagaagggagacacaaaagaattcaggttgttagtccttgacgaattcattttggcaaagggagaagagaatgaaaagatgaatagcacaagttttcaaggtttagaaaaccagaaaacttcagaaagcttttggtacaaagaagaagaagaagttcaaagagattcaaggctagtaaaagattga

SEQ ID NO: 55596 - DNA, 282 bp, Glycine max
  Peptide Sequence Number=SeqID_147281
atgacaattgaagagtctatacatgattcctttgatgagtctaatgccattcttccaaggaaggattttttagatgatatttcagattccttagaagatacacatattcatggaaatgactctaaagaaaaagatgaaggaagcaatgaggattctcaagataatggggctagaggaaataatgaacttccaagagaatggaaagcctcaagagatcatcccctcgacaacattattggtgatatatcaaaagggaaaaacctgaaaattatcctgtcatag

SEQ ID NO: 55597 - DNA, 156 bp, Glycine max
  Peptide Sequence Number=SeqID_147282
atgggaagatctaggataggcggccaacctcctggagagagcgatgtgcatggaccaggtggtggtatcacacccttctcaaaggaaccgtacgtgagactctcgcgtcatacggctccgtcccggaataaggacctcccctttcctttcctttga

SEQ ID NO: 55598 - DNA, 866 bp, Glycine max
  Peptide Sequence Number=SeqID_147283
ccgcaattgatgcattccttgcatatcaccatagcaaggagagcccggtggtagctatcttggcggacttatttgatacatttgaccgaaggtgcgagaagatcagcgcactgattgtatgctgcttacccgctctttgtgtgtggttggtttcgcacctattccaacaagacataaggcacccatgtccgcttcaaagttatcgctcgtgcgtcgaaaagagaagagtagattgggaccagtacttggctagggtaggaggcagcacaatcaactggtttcctcgatggaaggaaggaaaggagggagttctcttctcatgtggggactacccaaacgttccgttgatagggacaaggggttgtattaactataatcccacacttgccataagacagttagggtaccccatgaggggagcaccgatggaagagagcctctcacctttccttgtgaaagatttcggcgctcaaagtctcaagattgtacaaagagtccacaaggcgtgggaaagcccgttaaggaaagataaagaacttaggggcatccgtaatggcatcatcgatggttatcatgattggctaagagttcatacacgagggttagattggctctccaagttgaaaattatcaatgaggagaacttcgaagctccggaagaggatgaagaaacatctggaaagagtgtgccgaattacgagaggaaaatgtggctaccgcaagagccctcgaacgagaaaccaagagggctcgcaaaaaagagcatggccgagataaattccgaggagctttgtagggcagcaacaatgagctcaagctccggagaaaggaaagagaccagtcacgagtacatggcatggtcttaa

SEQ ID NO: 55599 - DNA, 502 bp, Glycine max
  Peptide Sequence Number=SeqID_147284
atgaaaagagaaaaacatgcctcctatagtagtcataactcttgcaagagcctaagtgaagaacttcatgactattacgaaggaagacataggtcacatcttagacctcactcccatagaagagaaaggaaagaaagcctcaagaggctaacattaacctctcatacttccatgaaagaccaaggtcaaggcatgttaggggtgacaccttctaagcccaaagatgataaggggaagataatagaaaagcaagcccctaaggctagtatgcaagagaaaactagctctataaggtgctttaaatgtcttggaagaggacacattacttctcaatgccccaccacaaaaaccatgattatgaggggccaagacatttatagtagtcaagatgaggctagtacttcaccttcctttagtgaaagtgaagaagcaaaaggggaagaatctagtgaagaaatatacccccaagaagaaggacaaccattagtggttaaagagaagt

SEQ ID NO: 55600 - DNA, 160 bp, Glycine max
  Peptide Sequence Number=SeqID_147285
atgtggtactacgttagtgaaaaacctcgtcgggcacctaggagtacattacaagacaaaccacacactagcaagtcaggcttaaaggagcactcaaaccgggtgacccccaaggcctacactccgaagagtccatcagggcctctcccttccgatacag

SEQ ID NO: 55601 - DNA, 650 bp, Glycine max
  Peptide Sequence Number=SeqID_147286
tcaaccatccggcttctatcaagctttggaccttgcttttcaaggccaagcactgttcgaccgagtggcctggggttcccccatggtatgtgcaggttgcactaggatggcaagagttccccatacgttattgggatcgggccgaaaacctgagcctgcctttgctagaagttcctcgccgtgttggggcttgtcccaaggtgagcattgttggccgggtgaggccgggttggagccggagcctgaagagcccccccccctgtgggggcgtgggcgtccttggttgggcgagtgctgtatcggaagaggctccggcacgagccgaaaaactcggtgacggtatgggcatctccctctttcttttttgccccatctattccggtcctcctactgatggcacctaccggggagaagtaatcaaactttcccctcttcaaacccacctcgatcctttctccggcgaaaaccaagtccgcgaagctggagggcatgtccctctaacactaagcgtattctttaaaggactcatgttcccgttaaatcatgttttgcagttgagtccggtcgggagccatgtcagagttgtactgatactgcctaaggaaggctgtaatcagatccttccaggtgtggatgcgggaagcttctag

SEQ ID NO: 55602 - DNA, 417 bp, Glycine max
  Peptide Sequence Number=SeqID_147287
atgagattttggatgtatagcatttcgcttctaaatgaccatttagaggaaacactgggttcaacgaaaatagaagaaaatcactcgaagtgtatcaatctcacacggtgcgaggcgaacaagtcaccgacgcacaggattttggttggcaatcaaagggagaggaccacttcagggcaaggattgacattctcaccctgggtcaaggtttatggtaagttgggattttggctcaaggcttgtagaacggctggacatgacatgcgtcagggtttggtttggttcagggataaaggggatgtcccacattatttccatgacataaatgcaacaatgatgatttggaaattttatgcaaaactagtcatgcatgcacctatggggacactcaagcatcaagttttcatggtcatgtga

SEQ ID NO: 55603 - DNA, 857 bp, Glycine max
  Peptide Sequence Number=SeqID_147288
atgctagccgacctatatgacaccttcaaccgaagatgtgagaagagcagtacgaggattgtttgttgtactccagctctttatgtatggttggtttcgcacctttttcgccaagaggtgaggcatgcttgcccgctagaaagtcactgttcatgcacagagaaaggaggggaaaattggggccaactcttagcaaacaaagaaggagcgtctgtcaactggttccctcgatggaaagaaggaagaaccagagttcttatttcgtgcggagtatttctgaatgttcccttgatggggacgaggggttgcgtcagttacaatcccattcttgctataaggcaacttggctaccctatgagaggggcaccactagaggaaaagatcgcgcctgtcatttcacgaggtttcaataagaccaacgtggagaaacttcagaaggtccgcaaggcatgggaggtggtgcgaaaaaaggacaaagaactcaggggcagtaacaatgggcccattggtggctaccgtaagtggttgaaagcccatgtgcaaggtttggattggctcccgagtttgagaaccgctaaaagggaggaagttgaggcaccgaaagaagacgaagaggtgcaggcccttaggacagaactcaagcaagctcgaacagtcaaagaaaggttcaaatcagaaactcttaagatccgaaaggagaatgccgaactaagagatataaatataccaccaaggccttggaacaagagaccaagagggctcgtagggaagagcacggccggaacaagttctgaggggctctgtggggcagtaacagcaagcttaagctccagagagaggaaagggaccaatcacga

SEQ ID NO: 55604 - DNA, 99 bp, Glycine max
  Peptide Sequence Number=SeqID_147289
atggctgatggaaaaatgataaagatgaagggtagaattaacctagggttaaaaagactgtgggaaagcttgggttgtgcaaaggaggaaaatgaatga

SEQ ID NO: 55605 - DNA, 192 bp, Glycine max
  Peptide Sequence Number=SeqID_147290
atgaagcaggtgatagcattatcagcttcaaccatggtactacagtcccctttggaaaaagaacatgatcatgtgacagactacctagcttgtgatgaagagcttgatgatccaaaagataactctgttggtcatgtgctccttgcagaagaaagaagaggatcaactggtgcagattctaaaaagccataa

SEQ ID NO: 55606 - DNA, 307 bp, Glycine max
  Peptide Sequence Number=SeqID_147291
atggaaatatacccctcctgctttggagaaagggctgcaaccgaggttgactccttgtcagccaagctgaccaacattaccgaccttagtggcgtaacccgcagtggccaggtgtttgctccccctcacttagcggaattgccctccaaggggaaagcacccatgacccaagagtccttaggcgcggccaccccctcaaaagaagtcgatcccccgatagtaaagggagctgaaaagaaggaagatctccaaggaagggcgatgaccttgcaagaggctcatgagttccttcgtctcatccaacaaa

SEQ ID NO: 55607 - DNA, 432 bp, Glycine max
  Peptide Sequence Number=SeqID_147292
atggcttctaggaagaggaaatccacagcctcccaatcttgggaaccctatgataccacccggttcatttctgaggttgcttgggagcgttattctcaaaacgttcactcccggaacatccttttggagaggaacgtcatcctttatgttaatgattatgatgagttccacagagaactcgagaggcgttgctggcacaaggccttgaccaggcagttggatgggcatattgatgtggccctggtcaaggaattctactctaatctctatgatccgaaggacaaatctctgaagcaggttagagtgaggggcaaattaattaagttcgatgttgagtccctcaacactttcctgaagaccccagtaattctggagcctggggagctgtacaccacctacaccagattttgtcattcgcgcccagacccttaa

SEQ ID NO: 55608 - DNA, 318 bp, Glycine max
  Peptide Sequence Number=SeqID_147293
atgtcaggatttacacgtgattctcctcaaatttcagccagcccgcatcaattagaccttgcaccttacgcttcagagccctacaatgctcaatggaatgccccggggcttctccgtgacagcacacgttgcgttcgagtcttattctcggagaaatggaggctttctcgttgcaaattctttcttggtggtgctcttggttgtgctaaggtgatgtcgtcttggagtgcggagacagactttgtggtgtttaggatggcttgtgatactggcgtggtagagagttgtatgctatatgcatgtggtgtggaactgtga

SEQ ID NO: 55609 - DNA, 716 bp, Glycine max
  Peptide Sequence Number=SeqID_147294
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggcaaaatggttccagctattccatctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55610 - DNA, 657 bp, Glycine max
  Peptide Sequence Number=SeqID_147295
atggctccgaaaaagcttcccgcgaagaggtctaggagagatgccgcagctgaagggaccagtgccgcccccgagtttgatagccaccatttccggagcgccgagcaccatcaacgcttcgaggccatcaaaggatggtcgttccacagagagaggcgcgtccagctcagggaggatgagtacacatattttcaggaggagatagctcgccgacattggacgtcgctggtgactcccatggctaagtttgaccctgaggtagtcctggagttttatgctaatgcttggcccacaaaggagggagtgcgagacatgcgttcatgggtgaggggtcagtggattctttttgatgcagatgccctcagccagttccggggtgacccgcaagtgtcagaggaaggccaggagtgcgagttcagtcagaggaggaacagggccgatgggttcgacaaggaggccattgcccagctgttatgcacaccggggcaggatttctcccggaccgctgcagggaggcgggtgcggatcatgcgcaccagcatgaccaccttgacccagacgtggatgacattgttgcttagcaatgtcttgcctagtgaccacaatgtcgatctccccctgcggatgtatcagttggtctgtgctgtcatgacatag

SEQ ID NO: 55611 - DNA, 195 bp, Glycine max
  Peptide Sequence Number=SeqID_147296
atggctaccattgcgttatcaagtagatatgggagcaagttagtatatgacaccggaatttggggtgaaccctacaggcttttcgctgcaaaattcatttcttggttggaatggcagtcacagcatgggtttctccctcatcctcaccctctttatttgccccagttttctcattcgtctaagcaggatgattaa

SEQ ID NO: 55612 - DNA, 382 bp, Glycine max
  Peptide Sequence Number=SeqID_147297
atgactagaggcaatccatctgacttacaaccctttgatcttgagatagataggacatttcatagattagttaggcatcattttataccttttgatcatcttgagcattccattactggtgaatctgtgcattctgttattggtgattttgaacatcctgatttggagcattataattttgagcattctgattctgagcattctgattttgaacattctgagaacatggcacaacctccaccccgtgagaggactctaagggaaatggttgcacctgatttcacctatgaaagcttgtgcatccaataccctgatgaggatgttccatatgttcttaaaactggactgattcatttgcttccaaagtttcatggccttgcag

SEQ ID NO: 55613 - DNA, 218 bp, Glycine max
  Peptide Sequence Number=SeqID_147298
atggataatgaagagggagtgcaagaacagatgaaggccgacctatcagccttaaaagatcaaatgacttctatcacggaggccatgctaaagcttcagaaaacaatagaagataatgctacagcggccgcttccaatacagctagggaagcggaaccggtgctacagccctcaataaacttgggccgagatagaaacacgacggttttcggtcggag

SEQ ID NO: 55614 - DNA, 490 bp, Glycine max
  Peptide Sequence Number=SeqID_147299
catccctctagattcaatacatatgttttggaggagacttagtttttcagaccaagggttatgtgaggccgaagtcaccatcaaggaagagatcgagaccatatctaaaatatttgaggaacttgatgtttatggtaaagttactctcaagaataaacttcgagaaattgcataccctgatcaaaactctatgtgtcctcctccgtcaaaggtcaacactaaagtgaagcatagtacatcatcttctaaccagccaaagccaacaaggatcatcccgatgttggatcaatttgagccatttatacagggtttcattgacaacattgtggatgtgaaagcggacggtatgggcgaagattcttggtcgttggtgcgcaaccaattggttaaagaacttggcaaatggtcggatgactatatcaacctcttcggtggcacagacagatttgatgaattaaggcggtccctacttgttgatgggttttccaag

SEQ ID NO: 55615 - DNA, 465 bp, Glycine max
  Peptide Sequence Number=SeqID_147300
atgacttcgtcaaaagtgtatgcgagctttatggctcacctatcggcttacatagccgataataagaaacaagcgaatactatggccgtcaaaattgaaaaagcggctattgcggtcgtcgaaaaaggaaaaaacgacaagtgcaattgtcgaaatcagaagaatgactactacgaccgtcgaaaaagaaaaatagttgctacgagtgtagaaaagaaagtgatggctactgatgtcatcaaagaaaaagggaaagtgatggataatgctaccatcaaagaaaaagagaaagtaatggatattgatgccatcaaagaggaaaaagaaataagagatgataaggagaaatcaaaagatgtttttcaacaaaaatgctttgagaaaccaatgcccttaggatttaaaatgatggaatctcaggatcctttagaagagattaacatggggactgagatagaactatga

SEQ ID NO: 55616 - DNA, 130 bp, Glycine max
  Peptide Sequence Number=SeqID_147301
gggcaggatcgccttgggctaccttttggagtgcttaaggatgaacgcaagcggggatggggtcacgaccgaccgatcgttacccttctctgtgcgaaacaagcagggaatgtcgctgcaaggcagcccc

SEQ ID NO: 55617 - DNA, 871 bp, Glycine max
  Peptide Sequence Number=SeqID_147302
atggtagaagaatttgaagagatcctaggatgccttctagggggaaggaaaccctacctcttctcagggttctatccctcattagctagaatttccaagatagtccaaatctcggcgcaggaattagaccacaggaagcaagtcgaaaatggggtggctggaataccgagaaaatatttggaggcaaaagcaagaatcttggcaggtaaaggcgagtgggccccattcatagatattctcgcactgttgatcttcggaggagtcctctttccgaatgtggatgggttggtggacctagcagcgatcgacgcttttcttgcctatcataaccacaaggaaagcccggttgtcactatgctagccgacttatatgacaccttcgtccgaagatgtgaaaagagcaatacaaggattgtttgctgtactccaactctttatgtatggttagttttgcacctttttcgccaagaggtgagtcatgcttgcccgctagaaagccaccgttcatgcacagagaaaggagggccaaattgggaccaactcttagtaagcaaagaaagagcatctgtcaactggttccctcgatggaaggaaggaagaaccggagttcttatttcatatggaggatttccaaatgttcccttgatggggacgaggggttgcatcagctacaatcccgttcttgctataagacaacttggctaccctatgagaggggcgccactagaggatgagctcgcgcctgtcatttcacgaggcttcaataagaccaacgtggagacacttcagaaggtccgcaaggcatgggaggtgttgcaaaagaaggacaaggaactcaggggcagtaacaatgggcccatcggtggctatc

SEQ ID NO: 55618 - DNA, 288 bp, Glycine max
  Peptide Sequence Number=SeqID_147303
atgacggggaatggtgttatccgctccaattcggcacacaagcataccgaccggaacatcagcgcggcaagtgtagcctggggtgcactaaggctgacgctaacactcacacccgccgcgcttaatgctgccgctacagggcgctgcccttcgccttcggtgcgcaacgtcgggaaggacctgtcggtgcgggcctttcgcattaagaacgccaacgcggcgagggggatgtgcgcaagtttgcgtaattgggtaacgctcaggagtgttcccatcacggcttactag

SEQ ID NO: 55619 - DNA, 321 bp, Glycine max
  Peptide Sequence Number=SeqID_147304
tgcgaacgtcaacctggaggaaccgccgttctcattggtatatgggatggagggcggtgtttcccgtttgaggaatcagagtgggctcaaacacgctacgatcagctcaacctcattgagggtaagcgcttaacggcccatgagtcatgggcgcttataccagcaaagaatgaagagtgcattcgacaagaaaggctttttcccggaggagccctggtgcttaccgacatggatggcgaagagctaccttcacccgggcaggatcaccttgggctaccttctggagtgaagacaaaacatgaatggcagaaaccagtcaag

SEQ ID NO: 55620 - DNA, 750 bp, Glycine max
  Peptide Sequence Number=SeqID_147305
atggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaaggtggtgaaaatctcagcacaagagttggaccatgcgaatgggctttcttttattgacatcttggcgcttttgatctttggagttgtcctctttccgaatatggaagggttagtggacctagcagcgattgacgctttcctcgcctttcatcatggcaaggaaagcccggtcgtcgccattttggccatgtatgacacgttcgaccggggatgtgaaaagagcggcacaagaattgaaggaagaatcaggattctatcttcatgcgaaggatgtcccatgagaggagtgccatcagacgaaagcatcacgcctttcatcgcacgaggtttcagtgaccacaacgcgagggacagagagcttaggggaagcagtaatgggatcatcgacggctatcataagtggctgagagtccgaacacaaggactggattggctcccaaatctaaagactgtgagagacgatgaggttaaagctttggaagaaattgatgaggtacaagccctaaaggcagagcttgaaagagcctgggtagtcgaagagaagttcaagtccatagccatcaaagtctga

SEQ ID NO: 55621 - DNA, 842 bp, Glycine max
  Peptide Sequence Number=SeqID_147306
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggggtttcatcatgttggccagactgatcttgaactcctgacctcaggtgatctgcctgccttggccttccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55622 - DNA, 795 bp, Glycine max
  Peptide Sequence Number=SeqID_147307
atgctccccaacaatgaagaactcaaacaattttcacattggctacttgacataggagatggaaaaattggacaatataatgacggattttcagaaatcactattccagacgagtttcttataaaaaattatgatgatcctatccatgctattgttgaagccacctatcccagcttgatagataactacagtgacacaaattacttgcaaaaaagagttgttcttgcctctaaaaaagaaattgttgacaaaataacaaccttctccaagttcctttctcctatcacagacaatggctgcgcaactaccccaaatatgttttattccactatgatggcgagatacatttcattaggaagggcacacaacctcaacgaaagcgtgattctacgtttggtcgctggtgacaaaaacaccactttcaccgttcatattgacggacctgcacaccaccactctagcctaaagcccatcatttatagaaggagatacatcttcatagttgatatcacagatgatatgctacagcagaacctgcctttgacacttcctgcagcggcttccaaatttgtgtatggctccaaaaaaagtattaccatccaccacggactttcaaaatccaccaaatggccactcaccatccagcatgacatcccagccattacacaaccatggttcaacctgattcatgaaaaaaatttaagacccggagatgaggtagtcttttactaccgttttcatgaccatgcatgggagctgctcataaggaaagccatcgaatggacgatcctctag

SEQ ID NO: 55623 - DNA, 315 bp, Glycine max
  Peptide Sequence Number=SeqID_147308
atggggatcgcacccacaaagacacccagtggacctaaagaagtccaacaggccctggggtttccagccctggttacgggtctctgtcggccctacagggcgcccgtccccccatcaagtttatgccatcatgacctagggatcgtgcccacaaaacactctgtggacccgaagaaggccaataggttctacggagtgcccgttgcccccaacaaggtcattaggtcccgcattaaccgggctttcatcaagaagtactgcgcccccaggcaggcgcagggcgaaacaccacatcagcattgggatggccggtag

SEQ ID NO: 55624 - DNA, 234 bp, Glycine max
  Peptide Sequence Number=SeqID_147309
atggatttgagtccagcaccgagtaccaggtctatggaaaactctacctctctctcaggtggtaaacctgatatgttgatgttgctccatgtagagcttatgccacttcaaggagaagatgagtcaagaacaagctcaccaccacaaaaagccatggataagagcttaaagataggagaagatgagtggagggagaaagagagaaggagcacgaaattttatgcctcaaatgag

SEQ ID NO: 55625 - DNA, 782 bp, Glycine max
  Peptide Sequence Number=SeqID_147310
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatacaaagctaggcagcccccagccctccttgagtttggattcaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55626 - DNA, 525 bp, Glycine max
  Peptide Sequence Number=SeqID_147311
atggcacctaccaggcaccctttggatccagataagtccaatagggccctgggatttcccgcactgatcacaggactctgccagtcgttcggagtccccgtggcacctaccaaggtgattcagtcgcccatcacccgggcttttattgagaagtactgcacccagagacaggctcagggggatgctccgcaggccgcagacgcgccgccaccttatcaggctggccaagctggatcgtttgatacggagcggtatttgcggcatttggttcgcgagcaggcagccaaccaccgggcacatgtacagacccatgattgtctttaccagctgagcctcagcatgcagagtcagggcttcgcttctttttcatgccctactccagaccagttcagggcagaggtcgcatggcccgaggcccaagcaggagaggcgcccccagaggctcccggcgatggagaggaggcccacgaggacgaggagatggccgatttgcttgacttcttgggagggagtggagctacatga

SEQ ID NO: 55627 - DNA, 645 bp, Glycine max
  Peptide Sequence Number=SeqID_147312
atggaggggggggcggttaatgccatcaaggtgagtgggtcacacgggcccaagcttttggaggacgtaaagacccccagaaggtttatctacaaggccttgcaagaggtgggcatgattccctccggcgagcgcagagaagactcttgcttaatgcatccgggtgtactgcatgacatggaaacatgttcggcagtaagagatctattgcaatggatgatagaccaaggccggcttgaggttggcagtgagagggaggaggaacaacatgtatgcatgcagtcggcagatgaagaaggacctaaaaagcctaaacccttggtaatacacttcactaggaacacggctacccaaagacctcaacacccctcggcagtgttgggaggaagatctatttcgtttccttacaagaatagtcacgcagttccatggaggtatgcccctccgggcggtaggaaggaagaagctaccgatatcagctcactatcggccaaagtgaccaatatcaccgagctgagcagcataacccgcagcggtcgcgtgtttgcaccccctagcctgccgatacagcccgtgaacactaaagggaaagcaaggatgacagaaggacaaaatgtcaaagagatccccacaccggatgaggat

SEQ ID NO: 55628 - DNA, 698 bp, Glycine max
  Peptide Sequence Number=SeqID_147313
atggcgagccagagaagtgggcccgtttgcggatatactagctttgttatttttggggttgtcctctttccgaacgtggacggtttggtggacttggccgccattgatgctttcctcgcatatcaccatagcaaggagagtccagtggtggctatcttggcagatttgtttgatacctttgaccggagatgtgagaaaaacagtgcatggattgtctattgtttacccgctctctgtgtgtggatagtttcacacctattccaacaagacaccagacacccgtgttcgcttcaaagctatcgctcatgcgccgaaaaaggaagagtcgattgggaccaacatttggctgcaataggaggcaacgcaatcaattggtttcctcgttggaaggaaggcaaggaaggagttctcttctcgtgtggggactaccctaatgttccattgatagggactaggggttgtattaattataatcccgcactagccataagacagctagggtaccccatgaggggagcaccaaccgaagaaagtctctcgcctttccttatgagggatctaggcgcgaaaagtctcaaggtgatacaaagagtccacaaggcgtggagaagtccgttgaagaaagacaaggagcttagaggcatccgaaatggcgtcatcggtggttatcatggatggctaagagttcacacgcgagg

SEQ ID NO: 55629 - DNA, 237 bp, Glycine max
  Peptide Sequence Number=SeqID_147314
atgtgcccttttgcgggcgagcgaaggggaggctcacgggtgcgctttccaaaggaggaaaggtgtgcggagccgccaccaacggttatttgtggaaaacgtcgggaaaaccgaagggaaccggtcaaaatgaaaattctaagttcgggagttgtatttacgtttgaggaaggtcgacaaaagcgaggcttttgctcctacgtaccctccatcgaagaggaaatcagacctacgtag

SEQ ID NO: 55630 - DNA, 162 bp, Glycine max
  Peptide Sequence Number=SeqID_147315
atgactaaagcacgtcaaaaggggtatggaaagggaaaagaggtggtggttgccgcccagctcgcagaggcgagctgggttgcttccaccagaaggcaccgccttctatgggaagatcctggaaggcccaagtgggcctggttgctgattcttttttcgtaa

SEQ ID NO: 55631 - DNA, 851 bp, Glycine max
  Peptide Sequence Number=SeqID_147316
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcacagtgatgacagcgacgaaagtagcgacgatgatgacgaagaggaagaagaagaagaggacgatgccaatccgaactgggaggctctgaaatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55632 - DNA, 432 bp, Glycine max
  Peptide Sequence Number=SeqID_147317
atggcagcacaattcatccatgaccgagtggagatggagtgcctagagggagtttgggagaccctcgaaggcaatgcgaggtgccgattctgtggcacgatccgactcacggctacttcgttggtacatccagaggaaccagcacgcacgcttcaacgcactgtggagtggatattacctacacctacttcatatctactagtggagccagtccaagtgattgaggtgacgtcatctaaggaagaccacgaggaagacctagaggagctacctcctgagccagctgtggatgctcttgactttctagagggtgatgaggacccactccctgaggtggattctcccgaggacgtcatgtcggcatctggggcagactctacggaggagagtggtcccggagggatagcgactagtggaggttcttcatcatag

SEQ ID NO: 55633 - DNA, 504 bp, Glycine max
  Peptide Sequence Number=SeqID_147318
atgggtgatcaagaggagacacaagaacagatgaaagccgacatgtcggctttgaaagagcaaatggcttccatgatggaggccatgttaggaatgagacaacttatggagaataacgtggccaccgttgctgctgatgagaaaggagcacactggggcacaccagcaacccccatttgggatacaaccgggtggcttacccttatggattaccacctaattacacgccaccagtcatgtgtgatgacgcgggtcatgtcccttcccccatccttgaaggggagcctcctcgacagcccgccgaggttcacgaggatcatcgagagtatgcccaaggggatgtcgatttctaccccctggtccccgtcgaggggtggcacccaatgtattgcctcagcacaaccccacagcacaaccaatattcttgtccacagagggaccacccttggcggcggaagaaagaaggaaactcaatctcatcgaggagagattgagagctgttga

SEQ ID NO: 55634 - DNA, 319 bp, Glycine max
  Peptide Sequence Number=SeqID_147319
atgggaggaactaaaaggcttttagtgataattcccaaggtggtcatatctctcttgatggtttctagaggtatcatccccttcgaaaaacatattgcggcagtagggactaccagtaacaatatgttatcaaagagaaaaactcttgatgagggcctaactctctcaaaacagtccccagtggagtcaccaactgtcgcaacctacccttcgacaggagggcaaggcgagactcaagggtgcgtcttccaagaaaggaaaatgcgcggagtcgccaccaacgtttattcgaggaaaacgttggaaaaaccggaaaagg

SEQ ID NO: 55635 - DNA, 132 bp, Glycine max
  Peptide Sequence Number=SeqID_147320
atgtcttactttggagtgattgaaaaaatctgggagctagattatagtcaattcagagtgcctgtttttaaataccttaataaggtggcttacaaggatgaatctttcattatggcagaacaagctagatag

SEQ ID NO: 55636 - DNA, 489 bp, Glycine max
  Peptide Sequence Number=SeqID_147321
atggcgcccactaggcaccctttggacccagataagtccaacagggctctgggattccccgcactgatcacaggactctgccagtcgttcggagtccccgttgcacctaccaagagacaggctcagggtgatgctccacaggccgcaggcgtgccaccaccacctcatcaggctggccaggctggggcatttgacatagagcagtatttacggcatttggttcgccagcaggcggccaaccaccgagcacatgtatggacccatgattgtctgtaccagatgagccttagcatgcagagccagggcttcgctcctttttcatgccctactccagaccagttcagggcagaagttgcatggcccggagattggcccgaggcccaagcaggagaggcacccccagaagctcccggcgatggagaagaagcccacgaggatgaggagatggctgatttgcttgacttcttgggagggagtggagacacgtga

SEQ ID NO: 55637 - DNA, 516 bp, Glycine max
  Peptide Sequence Number=SeqID_147322
atgacttctcttctgcttatctcgatagacctgtctgtaaagcagggtacatatagatcaagcaccttatacaaagcatcgtgcaacgtttcattcacagttgccgaactatggataagtacgacctacatctcctcaactttggcaagagttcaagtcgtttctgaagacgttgctctgctttctgctggcattgttgttgctgcctttgttgctgttgtcatttctatgcgcccacttcggcaacgagctggccaactacgtgctgagcatcaagtatcccaatctgacaatatccaattcgaaaaagatacgcagcatgatcgacactcccaagaatgcaggcatctttcactttctgctgcaggtggagggaccctgctgtttcgaacggatcaagcagcaatatgccgctcagctgacggacctgcgcgacaagacgggcatgctgcgctttcccaagctgcgccagaagctggtcacatgctggggtcaatacgcatgggtgaacgatag

SEQ ID NO: 55638 - DNA, 639 bp, Glycine max
  Peptide Sequence Number=SeqID_147323
atggacctcatcacggctgctggactgctgaagactgtcaccaagttgggagattgctatgagagtctagtcagggaattcattgtcaacattccctctgacataacaaacagaaagagtgatgagtatcaaagagtgtttgtcagaggaaaatgtgttagattctcccctgctgtgatcaacaaatacctgggcagaccaacagatggagtggtggacattactgtttctgagcatcaaattgccaaggaaatcactgccaaacaagtccagcattggccaaagaaagggaagcttttctgcagggaagctgagtgtgaaattatgcaatcttgcaccaggattggagctgcaaactgggtacccaccaatcatacttccactgttgccacagaatcctttgctgtcaaattacccattgccttcccaactgtattgtgtggcattatgttgagtcaacatcccaatattttaaacaacattgactctgtgatgaaaagagaatcggctctgtccctgcattacaaactgtttgaggggacacatgtcccagacattgtctcgacatcagggaaagctgctgcttcaggtgctgtgtacaaggatgccttgattgctgaactcaaggacacatgcaag

SEQ ID NO: 55639 - DNA, 200 bp, Glycine max
  Peptide Sequence Number=SeqID_147324
gatgggatataattcatgaacgttttgatctctataatcaacgtcttgatggagacggttgggtttattttgacaattggttggatgatctgtgcaataacgtgtttgtcgagttgccaatgatcttgtctgagcattggcgcaagacaagtgtgatgacctctggtactcttgataatccatttcttatgcctctctga

SEQ ID NO: 55640 - DNA, 75 bp, Glycine max
  Peptide Sequence Number=SeqID_147325
atgggtgccaagcacctcacaaggaccaaagaaaggtcgcatgttatcaagcaaaggtccccggacgaaataagg

SEQ ID NO: 55641 - DNA, 435 bp, Glycine max
  Peptide Sequence Number=SeqID_147326
atggagtttgttcattactgcacccatgaccggtaccgcggagataccttacggttatccgcacccttttgtcatccagaggcggcgggcccgatgacaagcagagaccaagtttggtcattctgcacccatgatacgcggagataccttatggttatccgcacccctttgccattcagacacagtcgtgtccgatggcacgcagaaaccaagtttggtcattctgcacccatgatacgcggagataccttacggttatccgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaagtttggtcattctgcacccatga

SEQ ID NO: 55642 - DNA, 325 bp, Glycine max
  Peptide Sequence Number=SeqID_147327
atggagttgtctcaggtgcaagttcaggacatatctgaagaggattacaacgaacaaatgaaggttgtgtatcctcaggctgaggaggatttaattgatttcttgaacagatgcaaactcgaaaataagattgtgatgctctgccctcgctgcagtgcagtatgtgatagggaggctactgagggcctcaaaaaataccaaattgttaacaagggggcaaagcagaaccaacgtttcgataaaggcaaaagggttatggtgcagtcgaacactaatcagaagtctggtcgaaagaatactttcgcttcctcctatttcagtgccg

SEQ ID NO: 55643 - DNA, 844 bp, Glycine max
  Peptide Sequence Number=SeqID_147328
atgtggtgattcatttggcaaatagaattgttgcttaccccgcaggtttcatagaggatgtgctagttcgggttggcaggccatttatgaaaacagcccgaaccaagatagatgtttatgctggcacattgtctatggaatttggtgaaattgttgttcattttaacattcttgatgccatgaaacatccatctgaggatcattctattttttgtgctgagataattgatcaaattgttgatgattatatgtttgattttgattttgttcttcatgataggaaatatccatttttatctgatttacatacttgtcactccttatgcattgaatctgaatctgagtttgaatttgacctcacatctgacttttatgctgagagtgaatttgaatttcagtttgatgttgtacctcttgatgtcgattttttagagtcagaatgcactaaccatgttgcaggaagtacatatacttctgacttgctttatgagatccgtgatcggagtggtgcacagaacctcatggctgaccacctgagtaggattgagcatgcatctgaggactcacccatttgggatgattttctggatgaccacttgttattaggagatgcattccagaccacgagattgactcggtccttcaattctgtcattcttccacaccaggtggccatcttggcatacagaggacagctcgcaaggtggttgactgtggtttctattggcccaccatcttcaaggatgcgtggagaatctgtagcacttgtgagccttgtcagagagcaagcgtctctccttcatagagacaacaaatgccttaacaacccatgttattctgtgag

SEQ ID NO: 55644 - DNA, 609 bp, Glycine max
  Peptide Sequence Number=SeqID_147329
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggctagtcgtggaaccctaacggtcacaacagcggtcgtcgagaaagtcgctgctcgcgtggcggctcaaagcgagggtttcggggctcccacctcgtccttcttcggatcaggctcgcgcgccgatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 55645 - DNA, 693 bp, Glycine max
  Peptide Sequence Number=SeqID_147330
atggccccgaggaagcttgcctcaaagcggtccaggaaggataaggcggccgaaggaactagttccactcctgacgcttcgaggccatcaagggatgatcatttctccgggagcgacgcgtccagctcagggacgatgattataccgatttctaggaagaataggtcgccggcggtgggcatcactggttacccccatggccaatggatcccgtttgatgcagatgctatcggccaactcttgggatatccgttagtgctggaagagggccaggagtgcgagtatggccagaggaggaaccggtctgatgggttcgatgaggaggccatcgcccagttgctatgtataccggggcaagattttgcccggactgctgcccggagacgggtgcggatcatgcgcaccaacatgaccaccctgactcagatatggatgactttgctgctcagcaacatcttgcccaccgatcataattccgacctccccctgccgaagtatcagctggtgtacgccatcctgacgcggatgagcatccatgtggctcacttaatcgctgatgccatctatatttttgcaggtatggcgcctaccaggcaccctttggatccagataagtccaacagggccctgggatttcccgcgctaatcacaggactctgccaatcgtttggagtccccgttgcacctaccaag

SEQ ID NO: 55646 - DNA, 363 bp, Glycine max
  Peptide Sequence Number=SeqID_147331
gggaaagggcttttttcagctggtgcgctaacgcgcacttccgttttccctttactagtagggggtcccgtggttcctatgccgccgcgtttcccgtacattggaatcctgaagcaccaccacgaacgctaccgcgcgttcgcctgcggtgcggtaaggcaccaccctgttgtgccagcagccaactccggcgtatcaatgaagaagggagaagtcagtggattcttccgaagaaccggaagcgaagcgctatgccggggcggggggacgggaaaagaaacggctccgaagaaagaaatggaggttcccaatgcttctccacgcccaacgagatgcgccaacctcgggatgctttactcctaa

SEQ ID NO: 55647 - DNA, 136 bp, Glycine max
  Peptide Sequence Number=SeqID_147332
gctcatgagaaccctatggccttctcttgcatctctggcccaatctttttggagtcttctatccaatgcccttacggggtaggattgcatcattccctccctcttgaaaaggatttggcctcaaatctagagaaag

SEQ ID NO: 55648 - DNA, 375 bp, Glycine max
  Peptide Sequence Number=SeqID_147333
atggtggggtacgcaccttcaagctttgcggatttggtcttcgccggggaaagggtcgaagcggatctgaaaagcagaaaatttaatcatcctgcttggacgaatgagaaaactggggcaaatgaagagggtgaggatgagggagaaacccatgatgtgactgccattcctatacggccaagtttcccaccaacccaacaatgtcattactcagccaataacaacccttctccttacccaccacccatttatccgcaaaggtcatccctaaatcaaccacaaagcctatctaccacacttccaatcacgaacaccacctttagcacgaaccaaaacaccaaccaaggaaggaattttgcatcaaaaagcctgtag

SEQ ID NO: 55649 - DNA, 357 bp, Glycine max
  Peptide Sequence Number=SeqID_147334
ggtccagcggctggaagagcaccgcacgtcgcgtggtgtccggtgcgcccccggcggcccttgaaaatccggaggaccgagtgcctcccacgcccggtcgtactcataaccgcatcaggtctccaaggtgaaacagcctctgtccccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaag

SEQ ID NO: 55650 - DNA, 213 bp, Glycine max
  Peptide Sequence Number=SeqID_147335
atgactaggggcaatccagttagacatagtgtgaatcctgatcattctgtgcattttgagcattgtgagcattgtgagcattctgttgagggtgattctgaatattttgattttgagcattcaactactaattttcatactaagaacatggctcaaactccaccttgtgggaggactcttagggagatggctgcacctgatttcacttattga

SEQ ID NO: 55651 - DNA, 282 bp, Glycine max
  Peptide Sequence Number=SeqID_147336
atgtcaggatttacacgcaattctcctcaaatttcagccagcccgcatcaattagaccttgcaccttacgcttcagagccctacaatgctcaatggaacgccccggggcttctccgtgacaagcacacattgcgttcgagtcgtattctcggagaaatggaggttgatgaaccttggctagggttatggctaccattgaattatcatgtagatatgggagcaaggtttgtgctaaaggtggtcttcgtcattggaagtgcggtagacagactttgtggttga

SEQ ID NO: 55652 - DNA, 453 bp, Glycine max
  Peptide Sequence Number=SeqID_147337
atgaccatgattacgccaagctcgaaattaaccctcactaaagggaacaaaagctggtaccgggccccccctcgagaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 55653 - DNA, 324 bp, Glycine max
  Peptide Sequence Number=SeqID_147338
atgtcgcgggggtcaggagaccttggggacgccaggtggggtgctattgcccaaaaccaagtaactgctggtaatcgattaccatttatgtgtaatcgattacacagtgtaaaatttaaattccaatttgtaatggctgttgtaaatcgtgtttggccactgatcgcgatggcagcacagctgatccgtgatcgcgtcgtgatggagtgcctagaaggtatttgggagacccttgagggcaacgagaggtgccaattccgcggcacagttcgactcactactacatcgcttgtacatccggagcaacccgcacgtacactttaa

SEQ ID NO: 55654 - DNA, 725 bp, Glycine max
  Peptide Sequence Number=SeqID_147339
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggagtatgtgtactatgcgaaccagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55655 - DNA, 535 bp, Glycine max
  Peptide Sequence Number=SeqID_147340
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattccctctaggcactccatctccactcgcctggtaatcgattaccagaggcctccacaacatgctaccttcattcctaagcctg

SEQ ID NO: 55656 - DNA, 216 bp, Glycine max
  Peptide Sequence Number=SeqID_147341
atgcatgaacggcaatcaattcatggggctccgaataaaagtggagaatggagaattgcactaggcaatacttcgcatggctccagactcattggtggaggatgcatgaacgacaatcaattcacgggcactccgaataaaagtagagaatggagaattgcactaggcaatcacttcccgcgtggctccagactcattgatggggaggatgcatga

SEQ ID NO: 55657 - DNA, 861 bp, Glycine max
  Peptide Sequence Number=SeqID_147342
atggccaccgatgcctttttcgtggcgttcaaactgcccaatctgctgcgccgtattttcgccgaaggcgccttttcacaggccttcgtgccaattcttgccgaatataaaagcaagcagggcgaagacgccacgcgggtttcgctgctgcgcgtcacctttccttatattctgctgatctcgctggcgtcgctggccggggcgattctcaacacctggaaccgcttctccgtcccggcgttcgcgcccacgctgctgaatatcagcatgattggctttgcgctgtttgccgcaccgcacttccatccgccggtgatggcgctggcgtgggcagtggtggtgggcgggctgctgcagctgttttatcaactgccgcacctgaaaaagattggcatgctggtactgccgcgcgtcaacctgcgcgatgccggcgtgtggcgggtgatgcgccagatgggcccggcgattctcggcgtatcggtgagccagatctcgctgatcatcaataccattttcgcctcgtttctggtctccggctcggtgtcgtggatgtactacgccgatcgtctgatggagtttccctctggcgtgctgggcgtggcgctcggcaccatcctgctgccgtcgctggcgaagagttttgccagcggcaaccacgatgaatattcccgtctgatggactggggcctgcgtctgtgcttcctgctggcgctgccgagcgcggttgcgctgggcattctttccggtccgctcaccgtggcgctgttccagtacggcaaatttaccgcttttgatgcggcgatgacccagcgcgcgctgattgcctattcggttgggctgatggggctgatcgtggtgaaa

SEQ ID NO: 55658 - DNA, 717 bp, Glycine max
  Peptide Sequence Number=SeqID_147343
atgccgaccagcgaacgtgaagccatggtgaaacacaatttcgaatcggtgggaatggggctgattgagaccggcatggcgtggttctggccggactggcgtattcgtaaatgggtcagcaccagcggcctggagcacgttaccgaggcgctggcacaaaagcgcggcatcctgctgattggcatgcatttcctgacgctggagctgggtgcgcgcgtgtttggtatgtataacccgggtattggcgtttatcgccctaacgacaacaagttactggactggctgcaaacctggggacgcatgcgttccaataaaagcatgctggatcgcaaagatctgaaaggcatgatccgcgccatgaagaacaacgacatcatctggtatgcgcccgatcacgactacggcccgcgcagcagtgtattcgccccgttctttgccgttcaggaagccgcgaccaccaccggcacgcatatgctgattcgtctggctaatccgagcgtagtgccgtttctggcacgccgcctgccgcacggccgcggctacgaactgaaaatgatgccggatatccgccacaaattctcactggagagtgaactggatactgctatcgtgatgaataaagtggtggaagagacggtgctgctggcgcctgagcagtatatgtggctgcatcgccgctttaaaacccggcctgaagggcagccttcacgctattaa

SEQ ID NO: 55659 - DNA, 1572 bp, Glycine max
  Peptide Sequence Number=SeqID_147344
atggagctggtgcgggatgtcggtggggcgggcaagatcttctatcgccgtcgtcgccgccgcgtgaagcgtaaaagcggcaacatcgatgacttctgccgtcgctggggcagcaactacagctacatggtggtgctggacgctgacagcgtgatgagcggtgagtgtctcaccggtctggtgcgcatgatggaagcgaacccgaacgccggtattatccagtcgtcgccaaaggcgtcaggcatggatacgctgtatgcgcgctgtcagcagttcgccacccgcgtttacgggccgctgtttaccgctggtctgcacttctggcagctgggcgaatcgcactactgggggcacaacgccatcattcgcgtgcagccatttattgaacactgtgcgctggcgccgctgccaggtgaaggctccttcgccggttcgatcctgtcacatgacttcgtggaagcggcgctgatgcgtcgtgccggctggggcgtgtggatcgcctacgatctgccgggttcttatgaagagctgccgccgaacctgctggacgagctgaagcgtgaccgtcgctggcatgcacccggtgcaccgcgcggtgttcctgaccggcgtgatgtcctacctgtcggcaccgctgtggtttatgttccttgcgttgtcgaccgccctgcaggtggtgcatacgctgatggaaccgacctacttcctgcagccacgtcagctgttcccggtgtggccgcagtggcgtccggatttggccattgcgctgttttccaccacgctggtgctgctgttcctgccaaaactgctcagcgtggggcgaaaccgtacggtggcgcattccgcctgttcctctcgctgctgctggagatgctgttctcggtgctgctggcaccggtgcgcatgctgttccacaccgtgtttgtggtcagcgcgttcctcggctgggaagtggtgtggaactcgccgcagcgtgacgatgacgccacgccgtggagcgaagcgttccgtcgccacggttcacagatgctgctgggcattgtctgggccgtcgggatgggcgtgctcgatctcaacttcctatggtggctggcgccaatcgtcttctcgctgattctgtcgccgtttgtctcggtgatgtcgagtcgcgccacggtcgggctgaagagtaagcgtgcaaagctgttcctgatcccggaagagtatgagccaccgaaagagctggtcgacaccgatcactatctgcagctgaaccgtgaacgtgcgctgaagcatggcttcatgcatgcgctgttcaatccggcgttcaacgcgctggcgacggcgatggcgacatcgcgccataagcagagtgcactgctggatcacgcacgcgatcgccgcgtcgatcaggcattgagcgatgcgccggaaaaactgaatcgcgaacagcgtctgcagctgatcagcgatccggtggtgctggcgcgcgtgcacacgcgcttgtgggaaagtgcggataaatatcatcagtgggttgagagttatcagaaactcacgcttaacccgcaggcgctgcctcagcgcgcctga

SEQ ID NO: 55660 - DNA, 1461 bp, Glycine max
  Peptide Sequence Number=SeqID_147345
atgagcgaagcggcattgcgttcctcacgcgaacggccgggcgacgggttgagagaacatgcgcaacagcaatgtgcccgtcatccgggactgagcggcattcatccgctgaacgatgggctggatgcgtttgcggcacgctatctgttgatgggcatggcgcagcacaccatcgacgtccagtattacatctggcacaacgacatgtccggacgcctgctgttcagcgcgctgctggatgcggcggagcgcggcgtgcaggtgcgcctgctgctggatgataacaatacgcccgggctggatgaaacgctggccgaactcgatcggcatccaaatatcgccgtgcggttgtttaatcccttctcgtttcgaaccctgcgcgcgctgggctatctgaccgacttcgcccgcctgaaccgccggatgcacaacaaaagcctgaccgtggacggcgcggtaacgctggtgggtggccgtaacatcggcgacgaatattttggcaccggcaatgagccgctgtttaccgatctcgacgtgctggcgctgggaccggcggtagatgaagtggcggaagattttgcccgctactggcacagcaaagcggtatcgccattgcgcagcgtcgtggacaccggtgcaccgccgcatgaagcggtgcgtttaccgccggagtggcagcagagcgaggcggtgcagcgctacctggcgcggctggagaaatcctcgtttgtcagccagctggagcagggctcgttgagcatgacctgggcacacacacggctgctaagtgacgatccgcgcaaagggctgggcaaagcgaagcgctcctctttgctgccgcagcgcatgctggaggtgatcggcacgccgcagcagcagttcgatattatttcggcctattttgtcccgacccgggccggggtggcacagctgctggcgctgaagcggcggggcgttaagatcgccatcttaaccaactcgctggccgccaatgatgtcaccgtggttcacgccggctatgcgcgctggcgcaagaagctgctgcgtcacggcattgcgctctacgaactgaagccgcaggccaatgccgcggatgccccgcacgatcgcggcctgaccgggaattccggctccagcctgcacgccaagactttcaccgtcgataaccgcaaagtgtttattggctcgtttaatttcgatccgcgttcggcggtgctgaatacggagatggggctggtgattgagagcgaagcgctggcgcagcagacccatcagcgcttcagcagcggcatgcgcgaccgcgcctgggcactgcgactggataagtggggccgcgttaactgggtggagtacagcggcgaagcgcgggaagtggtacataagcacgagccgcagtgcacgctgttgcagcgtttgctggtgcggctggtatggcgtctgccggtggagtggctgctatag

SEQ ID NO: 55661 - DNA, 378 bp, Glycine max
  Peptide Sequence Number=SeqID_147346
atggaagggttagtggacctagcagcgattgacgctttcctcgcctttcatcatggcaaggaaagcccggtcgtcgccattttggccatgtatgacacattcgaccggggatgtaaaaagagcagcgcaagaattgtttgttgtgcactggctctctatgtgtggctggtttcacacctttttttctccaagaaggtaggcccgtctatccgctacaaggtcaccgctcgtgcgtcgaaaagggaaagggagtcaagaacttccccgattgctagccaaggccaaagcagtggcggacacctactccgcccccgaggagatccatggacttctcagctattgtcagcatatgatagacttaatggaccatatgattag

SEQ ID NO: 55662 - DNA, 318 bp, Glycine max
  Peptide Sequence Number=SeqID_147347
atgctgccgctacagggcgcgtccgctttccagtcagggaaacctgcggcaactgttagggccaacgcgcgggcgatcgagtgcgggcctttcgctattgcggcgctaaagggggatgtgtgcaaggcgattactatgttggcactgataagccagggtgttcccagtgaatgcgttcgtgaaaagcgacggccagtcagaatatgtgaatacgactcatatggtccgcgaattcctcgtcctgagctcgctacgctcggtcgtagcggcgagcgtgaactagtggatcccttacaacggggcaggaattcggattaa

SEQ ID NO: 55663 - DNA, 255 bp, Glycine max
  Peptide Sequence Number=SeqID_147348
atgcctggagtagcgcttagcgcgcttgttgcgctaagcctgaactactctctcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 55664 - DNA, 207 bp, Glycine max
  Peptide Sequence Number=SeqID_147349
atgactgaagcacgtcaaaagggggtacggaaagaagtattagcgcctcgcttcacgtttgtcttcaaaggacaacaactctttttagcaattgtggagaattcgtgttaccttaaagctctttatttcttctattttttgaggttgacaaaagcggggctcttgctcctacgtaccctcgccatcgaagaggaaatcgagacctag

SEQ ID NO: 55665 - DNA, 126 bp, Glycine max
  Peptide Sequence Number=SeqID_147350
aaagaactacataggtctgatttcctcatcacaattggggaatacgtaggagcaaaggtgtcataccctaatttcgtccggggacctttgcttgatgacatgcgacctttctttggtccttgtgag

SEQ ID NO: 55666 - DNA, 137 bp, Glycine max
  Peptide Sequence Number=SeqID_147351
tttctcatgaggaggaatacttgtacctgggggcatgtcactcggtttggaactcccttaagactcaggctgatcaccatgggggagggagggagttgcctgtgcacgacagggtgacctctacacttactgcctag

SEQ ID NO: 55667 - DNA, 438 bp, Glycine max
  Peptide Sequence Number=SeqID_147352
atggatggcctaactaatgagatcaccgtcacccaccttggaacaaagtttgtgttgcatcctcaaacaccttcacgggcaaaggggaaggaaaaagaggaaaaggattcctccaagaagattgttaagaaagaaaaccattttgcaacaaaaggtgatatcaaaagagcactcattcttaaacaatccttttaccttttcctatcaagggaaacatcccttagcactaccatacctcttgagcttaagctaaaatccttgtgctttgttggtgcccaaaataggtattatgagtcaccaaatccctatgatagggtgggacttttaggggttctcacggaccctaagagaataaaggtcattcttgagtggccctctccaccaacaccactcattgagttggtgaggaaccacgatctttcatgggaagatgcctag

SEQ ID NO: 55668 - DNA, 315 bp, Glycine max
  Peptide Sequence Number=SeqID_147353
atgaatatcttgacagcacacgatcaagggtggaatcaggagttaagtccttacaatcaatatgaagaagagagaactcctaatcttgaaagtgtgtttgaggaattcatagcataccatgccaactcaaaagctaatcaaaattcaatgaaaaatcatgaaattcattttggtaagagctatccaatagaaaatgttcacagaggaccaaagttacaaccttactatcaaaatgaagcagaaagaggttccaatctggataaattgctgatgcaattcatggaaacaactaaattaactcaacgagcactctaa

SEQ ID NO: 55669 - DNA, 567 bp, Glycine max
  Peptide Sequence Number=SeqID_147354
atgtccaaatcttgtggatttgggatgaccggccctctcgatgagtcgatctcttgctttctcataagggtggacccttgggtacttgtacctatcacctttagaggactacacgtcctcgccttgagaggactacacgtcctcaccttcgtagggctacacgccctcacctttagaggactacacgtcctcgccaacagaggactgcacgccctcaccttgaagaggactaacacgctacacgccctcacctttagaggaccacacgtcctcacctttagagggctacacgccctcgccatcagaggaccacacgtcctcaccttcagagggctacacgccctcgccatcaaaggactgcatgtcctcaccttcagagggctacacgccctcgccatcaaaggactgcatgtcctcaccttcgtagggctacacgccctcacctttagaggactacacgtcctcgccaacaaagggctgtacgccctcacctttagaggactacacgtcctcgccaacagagggctgcacaccctcacctccagaggactacacatcctcgcttag

SEQ ID NO: 55670 - DNA, 579 bp, Glycine max
  Peptide Sequence Number=SeqID_147355
atgctggcggcgataagcgggctggggttcttcttcccgtccttcaactggctgatgcaggtactgggtacgccacagctggcgcgcatccttcacccgttcgtgggtgtggtgatgtttgcctcgtttatcatcatgtttttccgctactggcaccataacctaatcaatcgggatgatatcttttgggcgaagaatattcgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 55671 - DNA, 62 bp, Glycine max
  Peptide Sequence Number=SeqID_147356
agatgagtgcttctagtcctagtcaagctaaagaacaagatgacgataccaaaccaatgtag

SEQ ID NO: 55672 - DNA, 216 bp, Glycine max
  Peptide Sequence Number=SeqID_147357
atgaagcacttcactgacaccctcatcagtgccaacataatttccggaacccttgaagcatcagatgatccatcagattatagcggagacaacagacactggcttgtatttgacaatattcagaaattatttgtttatggtggtggaaccatcaatggaaacggcaacatttcgtggcaaaattcatgcaaaaggaacaaaaagctaaaatgctaa

SEQ ID NO: 55673 - DNA, 291 bp, Glycine max
  Peptide Sequence Number=SeqID_147358
atgtttgcacattcgattaaagggctgccgtcccttgggatggacgtgtggggtgctaataccttccccgtgcgtaaatacaactcccgaacctttcacttaaaagttcgtagatcgcgtcttttccggtttttcccgacgttttcctcaaataaacgttggtggcgactcccgcgcgtattcctttcgtggaacacgcatcccgcgagtctcgcgtcgccctcccaccgaacggtaggttgcgacaataatattgtggcggtatggaataccagcgacaacacattataa

SEQ ID NO: 55674 - DNA, 353 bp, Glycine max
  Peptide Sequence Number=SeqID_147359
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgaaagcttttggtacaaagaagaagaagaagttcaaagagattcaaggctt

SEQ ID NO: 55675 - DNA, 393 bp, Glycine max
  Peptide Sequence Number=SeqID_147360
atggagagaagtatgatagatgctgccagtggtggagcccttagagacattactcctgctgaagccagaaatttaattgagaagatggcttccaactcccagcaatttagtgccagaattgatgctattgtcattagaggagtgcataaagtagccacgaattcatcaggtgagactaagaagcttgaaggtaaactagatgccttggttaacctgcaacaacaacaaccttattttcaaaatgctgctggcccaagcagaccatactttcctccaccaatccagcagcaacaacaacaacagccccagaaacagcaaatagttgaggcccctccgcaaccttcccttgaagaacttgtgaggaaaatgactatgcaaaacatgcagttttaa

SEQ ID NO: 55676 - DNA, 633 bp, Glycine max
  Peptide Sequence Number=SeqID_147361
atggctccgaaaaagcttcccgcgaagaggtctaggagagatgccgcagctgaagggaccagtgccgcccccgagtttgatagccaccatttccggagcgccgagcaccatcaacgcttcgaggccatcaaaggatggtcgttccacagagagaggcgcgtccagctcagggaggatgagtacacatattttcaggaggagatagctcgccgacattggacgtcgctggtgactcccatggctaagtttgaccctgaggtagtcctggagttttatgctaatgcttggcccacaaaggagggagtgcgagacatgcgttcatgggtgaggggtcagtggattctttttgatgcagatgccctcagccagttccggggtgacccgcaagtgtcagaggaaggccaggagtgcgagttcagtcagaggaggaacagggccgatgggttcgacaaggaggccattgcccagctgttatgcacaccggggcaggatttctcccggaccgctgcagggaggcgggtgcggatcatgcgcaccagcatgaccaccttgacccagacgtggatgacattgttgcttagcaatgtcttgcctagtgatcataactccgatctccctctgcctaagtgctag

SEQ ID NO: 55677 - DNA, 432 bp, Glycine max
  Peptide Sequence Number=SeqID_147362
gatgcacatgccaaagttgagtatgtgaaaagattgtatgaccaagtgaaggtgcaaattgcaaagaagaatgacaactatgccaagcaagccaacaagaaaaggaaggaagtggtacttgaacctggtgatgatcctggacatttgagggcaaatgttttccaagaaggagggaatgatgagaatcctgaaactagccaaatacaggctaaaggcccaagtaatccttggggcgtctaccctgacttatcttctttcaccggaagtggcgtctacctgacttatcttccttcaccgaaagtggcgtcgaccctgatttatctttcttcaccggaagtggcgtcatcaaaaacctctactgcctgtatcaaacgatccgctcctactcaagttcacatcactatgcgcctgaattggacatccgagcgaaaa

SEQ ID NO: 55678 - DNA, 276 bp, Glycine max
  Peptide Sequence Number=SeqID_147363
atgggcaagttagttcgcttgggcgagcaacccctgcaccaaaatataaaaaacgagggaggggaacgtttttctgcacccaaaaactccttccccccccccccctcattcaaaaggagagagcttacgggactcacggtttttgctcccccaagccacctttggtttcacattgctttcatttttcatactcctactcactccaacaaggacagcatagaggattcgaaatgggtgcccaaatgcaattctaagcttaggaacccaagctcttag

SEQ ID NO: 55679 - DNA, 872 bp, Glycine max
  Peptide Sequence Number=SeqID_147364
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatagcaataaaagaaaatatagcggttgttgttgttgttgttgttgttgttgttgttgttggatatgctgaggttgtggaaatggtaccagaattgcttggcgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55680 - DNA, 162 bp, Glycine max
  Peptide Sequence Number=SeqID_147365
atgtttattggctgtgaattgggcttgaaattgcattttacaaaagatgtaatacaaagacaaaaatattttaacgatcctagaccattggagccagagagattaaaggcgttgcggatccagtgggcacagtattatctccgagttagagatcagacctag

SEQ ID NO: 55681 - DNA, 806 bp, Glycine max
  Peptide Sequence Number=SeqID_147366
gaaggcataggtcacatcttagacctcactcccataggagagaaaatgaaagaaagcctcaagaggttaacattaaactcccatacttccatgggaaggacaatgtagaggctaatttagattgggaaataagggtagagcaacaacttaaaaggaagtctacttcaaaatcttatggctctcactcttatccaaagaaagaccaaggtcaaggaatcttaggggtgagaccttctaagcccaaagatgataaggggaagacaatagaaaagcaaccccttaaggctataaaagtgaagaagcaaaaggggaagaatctagtgaagagatctaccccccaagaagaaggacaacctttaatggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagattaaatccttgtgctttgttggtgcccaaaataggtattattaggcaccaaatccctaaaataggtggtgtgatgaatgctttgggtggtgcaacactcgtttgtaaaattactcatgcacccaacatcttcatgatttgtgtacatagggactcattaggtagggttcccatgaaccctaagagaataaaggtcattcctgagtggctcgctccaccaagt

SEQ ID NO: 55682 - DNA, 129 bp, Glycine max
  Peptide Sequence Number=SeqID_147367
atggataagagcttgaaggtaggagaagatgagtggagggagaaggagagaaggagcacgaaatttcaagcctcaaatgagcccactaatccaagatcaagtccaggattctccactaagtgtgcttag

SEQ ID NO: 55683 - DNA, 147 bp, Glycine max
  Peptide Sequence Number=SeqID_147368
atggatctttaccatttcttcactggatctacattggataatggagcagggaaggagataggagagggggtgatggtggtgccgaagggttcatcaatgtcgaaaattgtctccggtggtggcaaatggtggttagtgtcaaagtaa

SEQ ID NO: 55684 - DNA, 423 bp, Glycine max
  Peptide Sequence Number=SeqID_147369
atggcttgtccttctttctacaagatcggtacatgcttgacccaacagcaaaccccagtagcaactctcctcaacgtccttttgtcattgtcagaaatccctgggagatccaccgttcttagtggggcaatagttgaaacatgggctcacaggtggctaatgcatcagccatttgataatctcttcctgaggtataagtggtggcaacctgcccaaaaacccgtctcaaacctgtacttggctaacctcaagatgaattcactgatcatccggggatacaaggactgcccctactccgtggcccaaagcattagatgccccatcgaagcaaacaatccatttgtctatgtcctcgtgcgtccgtttctcttcaaacaggccgtgatatcttcatctgggaactcggggtgcatcggccgataa

SEQ ID NO: 55685 - DNA, 390 bp, Glycine max
  Peptide Sequence Number=SeqID_147370
atggtgttaatttcgaggtgctccagtggcgtatcatggtttctatcagctgttcctcctgttcagctactgacggggatgtgttatccgctcacaattcggcacacaagcataccgagccggaagcatagcgggcaagtggctgccccattcgtccattcgggaaacctgtcgtgccaactgcattatgaatcggccaacgcgcgggcgatcgagtgcgggcctcttgcgtattcgccagcggcgctaaagggcggatgtgtgcatactggcgattactatgttggcactaaagtggcttaccccaacggggcggaattcggaaagcacgatacgacctgcacttacagggacagtgagagggccgcggtcaaagccgtttttccatag

SEQ ID NO: 55686 - DNA, 1029 bp, Glycine max
  Peptide Sequence Number=SeqID_147371
atgtcggagtcttggcttaaaaataggttatatcaagtcaagatcaagagcctaggagtcgccagtctgaaagagttaggacagttgatggttcagctccagcgacaagcctttcgcaaagcttatggtaagatctgggacataactatggcggaggtctccacagaggccattgcctcccttgtccaatattatgaccagcctttgagagatcctgggatgccctctgggaggaaggaagtcgtatcttttctcagggaattggaccgcgggaagcaagtcgaaaatggggtggttggagtaccaaggaaatgtttggaagcaaaggcgagagtcttggctagtcaagacgaatgggccccgttcgtggacatcctggcactcttgatcttcggggtggtcctctttccaaatgtggatgggttggtggaccgggcgacaattgatgcttttctcgctttttacgaccgcaaggaaagcccggttgtcgctatcttagccgatctatatgacacattcgaccgaagatgtgagaagaacaatacaaggatcgtttgctgtacaccgactctctacgtatggttggtttcatacttctttcgccaagagatgagacacgtttgcccactagaaggccaccgctcatgcaccaagaaaaaagaggcaaactgggaccgactcttagtaagcaaagaaggagcgtctgtcaattggttcccccgatggaaggaaagaagaaccgagattcttatttcgtgcgggaaatttccaaatgttcccttgatggggacgaggggttgcatcaattacaatcccgtcctcgccataagacaactcggttaccctatgagaggggcaccatcagaggaaggcctcacaccttttattacacgaggtttcaatagcaccaacgtgggggtgcttcagagggtccacaaggcatgggaaatgtcgcaaaggaaggacaaggaacttaggggaagtggcaatgggcccatcggcggttaccataggtggttgaaagcctaa

SEQ ID NO: 55687 - DNA, 711 bp, Glycine max
  Peptide Sequence Number=SeqID_147372
atgaaactgaccgataacaccatcttcatcacgggcggcacttctggcatcggccgcgcaatggcagaaaaatttcatcaactgggcaaccaggtgattatctccggacgccgcgaggcgttgctgcaggaagtcaccgccgccagtccgggcatggactatgtggtgctggacgtcacgcgcgccgacagcattcaggccgcggcacagagcgtgctggaacgctatccggccctgaacgtggtcatcaataatgctggcatcatgccgtttgacaacgcggcgggcgaactggatgacgcgcaggcggtgacgctactgaataccaacattctgggcccggtgcgcgtcagtgcagctttcatcgaacacctgaagcagcagccggacccggtgctgattaacaacagctcggtgctggccttcctgccgctggcgaccaacgcgctttactcggccaccaaggccgcgattcactcctataccctgtcgcagcgcttcctgctgcgtgataccggcgtgcaggtcatcgaaatctcaccgccgtgggtggataccgatctgatttacaaaagtggcgacccgcgcgccatgccgctggacgccttcatcagcgagacgtttgaaaagctgggcaccgacaccatcgaagcgattgtcgaccgcgtgctgccggtgcgcgataacccgggggcgaacgagcttacgctg

SEQ ID NO: 55688 - DNA, 195 bp, Glycine max
  Peptide Sequence Number=SeqID_147373
atgttgaagaaattggcctacactccatgcaagcacatttttgatcaaaatttagaaaaatttcgtgaactgagtccagccatagcaacatggatagatcgcatctcaaaggaaaaatggacgatggcttacgatagggaaggacgtcgatatggcccgcaacgaacctctcagaatgtatcaataaggttttaa

SEQ ID NO: 55689 - DNA, 597 bp, Glycine max
  Peptide Sequence Number=SeqID_147374
tgtctggaaccttgctatgccgagcagacgctcatactttcatgcaccaagccggcgtggctgcccgcaacaccgggcgacatcaagcttatcgataccgtcgacctcgaggtttttgggcaaggctcgggtgatgctccagcttttgattccctttagtgtgagggttaatttcgaggctccatggcgtaatcatggtttctatcagctgtcctcctgttcagctactgacggggtgaaattgttatccgcgtcacaattcggcacacaagcataccgagccggaagcatcagcgcggcaagtggctgcccgctttcccagttcagggaaactgtcgtgccagctgcattaagaatcggccaacgcgcgggcgatcgagtgcggctcttcgctattacgccagctggcgtaaagggcggatgtgctgcatactggcgattatatgttggtaactgccatgagggtgtcagtgaagtgttcccatctcctaccgcggtggcggccgctctagaactagtggcttacgaacccccgggctgcaggaattcgtctgcagaccttgctatgccgaggaagatcaacttcaaccagcggaa

SEQ ID NO: 55690 - DNA, 498 bp, Glycine max
  Peptide Sequence Number=SeqID_147375
atggcggggcgtggtaccgatattatgctgggcggtagctggcaggctgaggttgctgagctggaaaacccaacgccagaacagattgcacaaatcaaagccgactggcaggtacgtcacgacgcggttctggcttccggtggtttgcacattattggtaccgagcgtcacgaatctcgtcgtatcgacaaccagctgcgtggccgtgcgggccgtcaaggggatgccggttcttctcgcttctacctgtctatggaagatgcgctgatgcgtattttcgcctccgaccgcgtgtccggcatgatgcgtaaacttggcatgaaaccaggcgaagccatcgagcacccgtgggtcactaaagcgattgccaacgcgcagcgtaaagtggaaagccgcaactttgatattcgtaagcagctgctggagtatgatgacgtcgcgaacgatcagcgtcgtgcgatctacacccagcgtaacgaactgctggacgtgtccgac

SEQ ID NO: 55691 - DNA, 565 bp, Glycine max
  Peptide Sequence Number=SeqID_147376
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgattgtcatcatcaaaaagggggagattgtggaagcaaagatttccaagattattttgatgatgccaaagaatcaagagttaagcaagttccaaagaatcaggcttcaagaatcaagtctcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 55692 - DNA, 510 bp, Glycine max
  Peptide Sequence Number=SeqID_147377
atgtttgattttcgcgtttccacacacagccactttgaagaagcctgccgcaagtttgctctggctcataacatcagcgatctggcaccacgttctggcatgaaagtgcagacgcttcgcaataaacttaaccccgaccaggcgcacaaactgacggttgaggaaatgttgcaacttactgacctgaccgaagatgcaacgcttatcgatggcgcactggcgcagttgcaatgcctgccatgcgttcctatgaacgaacatgttgccgagaaattcccggcctatgttcttaatgcttctgctcaggttggaacgctggcagccagcgcagctaatcagggcaacatatcagcctcatgccgtcgcggtattgttgaggcagcaaacaccggcatacgctgcatgatgctggcagcattggcggttcagaaccgcattcattcaaacccgacgctggcttcaaccgtggatgcaatcagcggtttgagcgcatcgatcggtatgagttga

SEQ ID NO: 55693 - DNA, 1110 bp, Glycine max
  Peptide Sequence Number=SeqID_147378
gaaagcccggttgtcgctatgttagccgacctatatgacaccttcgaccgaagatgtgagaagagcagtacgaggattgtttgctgtattccagctctttatgtatggttggtttcgcacttttttcgccaagaggtgaggcaagcttgcccgctagaaagccatcgttcatgcacagagaaaggagggacaaattgggaccgactcttagcaaacaaagaaagagcgtctgtcaactggttccctcgatggaaagaaggaagaaccggggttcttatttcatgcaaaggatttccgaatgttcccttgatggggacaaggggttgcatcagttacaatcctgttcttgctataaggcaacttggctaccctatgagaggggcaccgctagaggaagagctcgcgcctatcatttcacgaggtttcaataagaccaacgtggagacacttcagaaggtccgcaaggcatgggaggtggtgcaaaagaaggacaaagaactcagtggcagtaacaatgggcccatcggtggctaccgaaggtggttgaaagcccacgtgcaaggtttggattggctcccaagtttgagaaccactaaaagggaggaagttgaggcaccggaagaagacgaaaaggtgcagacccttagggcagaactcgagcaagcccaaacagtcaaagaaagaccaagagggctcgtagggaagagcacggccggaacaagttctgaggggttctgtggggcagcaacaacgagcttaagctccggagagaggaaaagagaccaatcacgagtacatggcatggttttaaaggaggagttagctgcttgctcaagatccaagaagagtttggcccaacacttagaagccacggagcaaagcatgctagctataataaggcagtacaaagaagatttaaaccagtctttgacccatgagcaaaagctagtagaggacttcgcacaagcatacgccgagaaggaagcaagaggaagggtgactgatgcattgcatccagaagcgcccatgtggatggataggttcgccttgaccttaaatggaagtcaagacctcccgcgacaactagccaaagcaagggtcatggccgaa

SEQ ID NO: 55694 - DNA, 509 bp, Glycine max
  Peptide Sequence Number=SeqID_147379
agaccaacgtcgtcatctgcaccctttgtcaaccagcggcaagcgagtccgttgacacgcagagactaatgtcgtcttctgcacctttgtcatctagagacggcgagtccgatgacttacggagatacccaagtggttatccgtacaaaatgatttatgttaatcctgacccgagaagtcaggtggcaggcgaagataaccaagtggttatccgggcaagcgagcccgttgacacgcagagactaacgtcgtcttctgcacctttgtcatccaaagatggcgagtccgatgacatgcagagatacccaagtggttatctgtacaaaacgatttctgttaatcctgactcgagaagtcaggtggtaggcggagatacccaagtggttatccatataaacactcttttgctatccgtcagactcagagtccgagacggcgagtccgatgacatgcggagatacccaagtggttatccgtacaaaccaacttctgttaatctcgacccgtga

SEQ ID NO: 55695 - DNA, 516 bp, Glycine max
  Peptide Sequence Number=SeqID_147380
atggtcattctgcgcctttcgtcatctagaggcagcaagcccgatgacatgcggagacaaattatggtcattcggccttttaagcgcacacctttttgccatccagagacgatcgtgtccgatggcacgcagagacaaattatggtcattctgcgccttttgtcatccagaggcggcgagcccgatgacatgcggagacaaattatggtcattccacaccttttcgccattcggagacgatcgtgtctgatggcacgcagagacaaattatggtcattctgcaccttttgtcatccagaggcggcaagcccgatgacatgcggagaaccttatggtcatccgtgccttttgtcaactgagaggaatgaattcggcagttccgctggcggggagattgaccgagtccgaatggtgttccgctcgaacgaaaattatggtcttatctttacttcccttttatctccagacgcgacgtgcccgataagacaagtaaagagggcaactgtcataccctaa

SEQ ID NO: 55696 - DNA, 183 bp, Glycine max
  Peptide Sequence Number=SeqID_147381
atggataaatttgacatctttgtcccttatcctctcgtaattacatctttgcttccactggaatgtgggtgcaagccattgtttcttccttgctacaaggtcatgacaaaagacaaggttgatccctcaaagtcctacactggggcaatgacaggcaccgtgatgagcctcaagcaaacctag

SEQ ID NO: 55697 - DNA, 198 bp, Glycine max
  Peptide Sequence Number=SeqID_147382
atgagattaggtgctgaattcaatgtggaaagcttaacatgtagagattggaacacatcatcgaaagtatcccaaaaggaatgtgttcggttctgtgcaagaaagaaaaggactacctatataagcatgaagtttagccgcttcaagaagctgggacttggctttgatatgcttatgaaggatagggacacaggctag

SEQ ID NO: 55698 - DNA, 522 bp, Glycine max
  Peptide Sequence Number=SeqID_147383
atggtgaaagttggaacctcttacgtgccgatcaaggccggcgtgctcattgggcaagaagtggcccagggcttcccgctgttcctcctgttcagcttgaaattgttatccgtcaattccacacaagcataccgagccggacatagggcaagtgtaaagcctggggtgcctaatgacgtgacgcgtaactcaccacttaacccttgccgttgcgcttcactgcgccgctttccatcagggaacgctgtcgtgccattcgctgcattaatgaatcggcggcaactgttgcgcgaagggcgatcggtgcggctttgcgtattacgccagggcgctaaggcggatgactactattccagggcgaattcctcgctcactgagctcctaccgctcggtcgtcgatgcggcgagcgctcagaactagtggttatccccaacgggcgcggaattcgatctgcgccccagagccggcaagtgcttaacagggaagtgaagcagggccgcggcaaagccgtttttccatag

SEQ ID NO: 55699 - DNA, 860 bp, Glycine max
  Peptide Sequence Number=SeqID_147384
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatatcaacaccagcgtgctctgcttctgaaagcctgggtcccccaacattcccctggccataccccaacccccaactcaggacgccctgtacctggttcttgccacctcagccccccgtcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55700 - DNA, 360 bp, Glycine max
  Peptide Sequence Number=SeqID_147385
atggtttctatcagctgtccttcctgttcagctactgaacggggtggtatccgcgtaatcggcaaaagcatacacgccggaacatcaggcgctggcagagtgagcggtcacttaagcgttgcgcgtaaccaccacacccgccgcgcttatggccgctcagggaaacgcgtcgtgccattcgcgcattcaagagctgcgcaactgttgggaagggcgatcggtgcgggcctttcgctattacgccagcggcgaaagggggatgtgtgcaaggcgattactatgttggctgatacgccagggtgttcccagtcagaatgcgttcatgtggcaggagaaaaaggctgcacggtgcgtcagtga

SEQ ID NO: 55701 - DNA, 153 bp, Glycine max
  Peptide Sequence Number=SeqID_147386
atgtggatgctggtgtttgagagagcatttgaccttattattcgcattgagataaacaaacaaggattgagtcagatggcccggactctgatccccagcgatcatgtgattgtgaggctgaggctgaggctgaggcttctcaatcaagcttga

SEQ ID NO: 55702 - DNA, 246 bp, Glycine max
  Peptide Sequence Number=SeqID_147387
atggataaccgttctaaggagcagttatgtgcatttatttccagcctttcgatttctgttaaacaattttactttctgcaaatttcgaaccatgtaaacaccttgccagcacaatgttacgaagaccaagacgaaggagagctcgcactcacaaagaaaatcatggcggcaatgacgacgacgatgatggagcaagagactccgatgatggctgttcgggaagcacgagggaggaacaaaaaatag

SEQ ID NO: 55703 - DNA, 717 bp, Glycine max
  Peptide Sequence Number=SeqID_147388
atggctctgtctctgttccaaaaccccaccttccttaaacttaaaccccaaccttcaaccgccacgacgccgaggtggggctacgttcgggtgcggtgcggtggaccgcggtcccatcgaacccctctggtgaaaggccgaatcctgagcatcgaagcaatccaagccatccaaaccttaaaacgcctccaccgaaccaaccctccagaactcacctccctcgtctccaacaccctcacgcgcctcattaaatccgacctcctcgccaccctgcgggagctcctacgccagcagcactgcaccatcgccctccgcgtcttctccaccctccgatccgaatacggcgccgacctctccctctacgccgagatggcacaaaccctcgccgccaacgacatgaccgaccacctggaccgtctgatcctcgacctcgcatctgagaatgaaatcaagtgcggcgacgatcacaaggggctagccagtttgatcaaggccgtcgttgctgccaggagcagagaatcaactgtcaggatttacgggctcatgaacaagagtggatatggttccgttactgaacccgatgagtatgtggttgaggttttggttagtgggctcaagagtttcggggaagaggctcttgctaaagaacttcaacatgaatacaaaattgcacttgctaagttctctacgccccaattaaacacattacgcttttag

SEQ ID NO: 55704 - DNA, 663 bp, Glycine max
  Peptide Sequence Number=SeqID_147389
atgtcgtcgcctccgttttcccgcgcagagatgagtgcttctagtcctagtcaagctaaagaacaagatgatgataccaaacctttatggacctatgttacaaagataaaaagtgtaggtggtggtgaaaattatgagataaaatgtaatatttgtgatgttacctttaatgagttttacactagagtgaggacacacttgttgaagattattggaaagagagttagaggttgtcaaaagataacaaatgccaaacttatagatttgaagaagatagacaatgaagctacattgagggtggagaagtcaaaaacaaaatttgtgtcattgcctccggtttctactcaacaccaaatggatacaaacactcttggtgttgatccaaaaaagagaaagacatcaacggtagaaagtacctttaatttgcaagctagagagacacttgatcatgaaattgctaggatgttttactctttggggctgccttttcatttagcaagaaatcctcattataggaagacgtttgcctatgctgccaacaattatatcagtggttaccaacctccaggttataataaattaaggacaacattacttcaaaatgagaagagacatgtggagaacttgttacaaccaattaaaaatgcatggagccagaagggt

SEQ ID NO: 55705 - DNA, 285 bp, Glycine max
  Peptide Sequence Number=SeqID_147390
atgattgtgttcctcattcctcctcctcctctattatatcaacaacctcttccgaaacaacaacttcctcttcttcttcttcttcctcctcctcctccacattttcaccctcgcagcattcgggcccaaaggcccaggccagaaacagagcaagaggcccagggactgcagcaagcacccggtgtaccacggcgtgcggaagcgcaactggggcaaatgggtgtccgaaatccgcgagccacgcaagaagtcccgaatctggctcggaacattcgccactcctga

SEQ ID NO: 55706 - DNA, 120 bp, Glycine max
  Peptide Sequence Number=SeqID_147391
atgttaagctcaaattttgaacttgtggactcagacaagtataaaaacattaaacatattcttagagatagcctggcgaagggagtgaagaatattaaaaaggagtccatcttggattag

SEQ ID NO: 55707 - DNA, 171 bp, Glycine max
  Peptide Sequence Number=SeqID_147392
atgcaggccattgacaaattgccagttttcccaacagtactggaattaattggaatattttactctgtgtggtttacttatcgctatctcatattcaaacctgaccgggaagagctttttcaaatcttgaacaagtcagcatcagatatcttgggccatcaatctctttag

SEQ ID NO: 55708 - DNA, 144 bp, Glycine max
  Peptide Sequence Number=SeqID_147393
atgagtatgtatgttggtcatgggatttccgatgaggtttggatgactggctggtggttactgtggtgggtggattgggggatggattgtgaaggaggaagggaggaaggcgatggtggggacactattggtggcgctaggtag

SEQ ID NO: 55709 - DNA, 573 bp, Glycine max
  Peptide Sequence Number=SeqID_147394
atgctgccacctttcggggctttctcagatcgtgccacgtgtcctttcgtgaaaaggaattggattcgggaattgattggggtaccagcatttttgctggcgcacccaccaaatttcctaaatgtcaaaaatacacttatggacggtatggaagcgtatttgttctccggtagtgtacgtgcattgatgaatgaagaccaatggatgtatgatagtatgatgtctcaagaagttgaaatgaatattgaaaatgaggaagatgctagcgttaaagttgattgctctaatgcctttaatacttctgagttgtttggtagtcgtgatgaagttttacaatggactcaatcgttggctcatgacattggatttgttgtcgttataataaggtcatacatcaataccggtgttcaaggaagaatcttatttttgttgatagcttgtgaaaggagtggggagtataggcctaagaaacataaattgctgaaaaaggatgagaagattgttgttgctgatatgacgaagttccatggtgaagccaagaaatatttcgttgacgttgaaggagcacaatga

SEQ ID NO: 55710 - DNA, 507 bp, Glycine max
  Peptide Sequence Number=SeqID_147395
atggaaaccatatcgaaacgctttgagcagctcaatgtttatggtaaaatacatttgaagtcaaagttgcgagaaattgcttactctgatatgaactccatgtgtcctcctccagaaaaaatgaagaccaagggtggtccaaaaaaaccgtttaccaaacaacaaaagtcaacaaaacgcgatccatcttactgggagtatgttgatgcgttacactctgtgcacctcaagagaactcaaaggaggatcgtgaagtgctgggttaggcattgggaggcagaacaacaagagcaccaaatattacaattgtactcgtgtgtgcctaagaatattcctctaatggaatttgctagcctggacgataattccaaatcaagcaagatttgcactgcactgctggcctttgtcattttccttaaacgtagtcaccaagggatcctgacgggaggagaaaggggatttgtggttgtctttgaaggagcttttgctctgggcagtagagattag

SEQ ID NO: 55711 - DNA, 606 bp, Glycine max
  Peptide Sequence Number=SeqID_147396
atgggggagaagttgatggtctacctggctgtaaatgatgaagtagttagctcaatcttaattaaagaaggaacagaagaccaactcttaatctactttattagcaagccattacaaggcgctgaggtgagataccagaagttggagaaggcagatatggccatggctttggtgagcctcagcaccattctcacaccgccttcttcttcttcttcttcgttttcttctccaaaaccttcttcttcctccatcgttcggtttcgccctctcactccccttcctcgctttcggaggcacctcgttcgtatggctcccgatgaggagaagatgactcgtcgctcccctctcgatttccccatcgtagaatcagttcataatctggtggatctgacagtgagttcagactttggtgatgagtgggaaaggcctaaacctggacgaaggccggatatattccctcaatttagtcctatgaagacacctttgccgcctccgttgcccgcagatcctccagaagaggatgaagaggaggaagaaaagaaagaggaagaggaagaacctgaaaaggaggagccagataagccagacaagccagaaaagcaatag

SEQ ID NO: 55712 - DNA, 411 bp, Glycine max
  Peptide Sequence Number=SeqID_147397
atgttagcggacatcgaccgtttcctctttgaaaatttcaagtccctgttcctcaatgatcttgaagaacccgccaacagagtagaaaagtctccagaactgggccccatgccatcagggtccagctccgccacgtcggaaagcgagatcgcggaggagcagacggtgattccgggaaattgtgtggtggtgctggcgaactcagtgaaccccagcaaggatttccagcgatccatggagagcgttgtggaagcgagtggattgggacttcatgcaggagcttttgttctgtcacatgaacctgaacaacaagaagtagtcgcacaagttaattctcagcgccttcgtcgacgttgtcatcgccatgcgcagcccctcggatattgctccggtgaagcttcgaacggttag

SEQ ID NO: 55713 - DNA, 2043 bp, Glycine max
  Peptide Sequence Number=SeqID_147398
atgcctctcagactcgaaatcaagcgaaagcttgcccaaagatcagagagagtaaagtctgtggatctacatccaacagaaccatggattctagcaagtttgtactctggaactgtctgtatctggaactaccaatctcagaccatggccaagtcttttgaggttactgagttaccagttaggtcagccaagtttattgcacgcaaacagtgggttgttgcaggggcagatgatatgtttattcgtgtatataattacaacacaatggataaagttaaagtatttgaggcacatacagattacattaggtgtgtggcagttcatcctacccttccatatgtgttgtcatcatctgatgatatgctcataaagctttgggattgggaaaagggctggatctgtacccagatatttgagggacattctcattatgtcatgcaagtgacatttaatcctaaagacacaaacacctttgccagtgcatctcttgatcgcaccataaagatttggaatcttggctctcctgaccccaattttacgttggatgcccatcaaaaaggagtgaattgtgttgattactttacaggtggtgacaaaccttacctgataactggttctgatgatcacactgccaaggtatgggactatcaaaccaaaagttgtgtccagactctagaaggtcacacacacaatgtatctgctgtttgctttcatcctgaactacctataatcattactggctctgaggatggaacagtgcgcatttggcattcaacaacttataggcttgagaacacattgaactatagtcttgaaagagtttgggctattggatacctgaagggttcacgtcgggtcgtgataggctatgatgaaggtactattatggtcaaacttggccgagaagaacctgtagccagcatggataacagtgggaaaataatttgggctaagcataatgaaattcaaactgtcaatataaggagtgtaggagcagatgtggagattgctgatggagaaaggttaccattggctgttaaggagttgggcacctgtgatctctatcctcaaagtctaaggcacaatccaaatgggaggttcgttgttgtttgtggagatggggaatatattatatacactgctttggcatggagaaatagatcatttggttcagcactggaatttgtttggtcttcagatggggagtatgctgtaagagaaagtacatcgaaggaaaagaagagtatccgaccaactttttcagctgagcgaatatttggcggcactgtattggcaatgtgctcaaatgatttcatctgcttttacgattgggttgagtgtaggttgattcgtcgtattgatgttaatgttaaaaacctgtactgggctgatagcggtgatttagtgacgattgctagtgatacatcattctatatccttaagtacaatcgtgatgtcgttgcatcatatttagatagtggaagccctgtagatgagcaaggtgttgaagatgcctttgagctccttcatgaaatgaatgaacgtgtcaggacagggatctgggttggggattgttttatctacaacaattcttcttggaggcttaactattgtgttggtggtgaggttactacaatgtttcatttggaccgtcctatgtacttgttgggatatcttgccagccaaagtaaggtctatttgatggacaaagaattcaatgttatgggatacacgctacttttaagtttgattgaatacaagacacttgtcatgcgtggtgatttggaaagggccaatgaaattctaccatcaattcctaaagagcatcataacagtgtggctcatttcctggaatcacgagggatgatagaggatgctcttgaagtagctaccgaccctgactataggtttgatctagccatacagcttggaagattagaggttgctaagggtattgccactgaagtgcatagtgagtccaaatggaagcaattgggagaattagccatgtctactggaaaggtgtttttctctatcaaatga

SEQ ID NO: 55714 - DNA, 801 bp, Glycine max
  Peptide Sequence Number=SeqID_147399
atggagaaggcattgtggaggtcgaagtacgtggtttccggaggggggttgaagtggatggtgtttgtggtggtgtgtgtggcgtgcgtggtgggaatatggccgtggtatccagagctgaagatcgagagaatggaagtgaagcgggtgaaggtgcggccggtgccgccggtgggggcggacgtgtcgatatcgatgtcggttagggtaaggaaccgtgacatatactggatggagatgagggaggtggacgtgggaatgaagtacagaaggaagaagatgggccacgtagagttgaagggctggcaggttaaaggctggagctcaactcacgtggaggcggaagttgtgttcgcagagcttccctcgtctcaagttccctatttgctcgaggacgtcgccaagggtaaggtctactttcgcactgttgttgaactctccggccagttcggcattctctcatttcgcacccctcttcctcttgagttcaagagaattggctacgatccaattgtgtgtgtcaacgaattggtgaccagattgaagatgggaagctggaaagcattgtggaggaagatcaagagggaaaggaggagattctttagaccttcacctgtgtttcatgtccagtatgatcctacctcctacttacagaacttcgacgatggctattccactgacccggataatgtttctcggtccttctcggctcgatttgcagcaccctccaagatctttgggaaaattgaagtgatggatgatggagaattagagataaatcataagagtaacatgttgtaa

SEQ ID NO: 55715 - DNA, 213 bp, Glycine max
  Peptide Sequence Number=SeqID_147400
atggctttgaatatcatgggcagactttgtgatcaaggccacactgcaaggtgcttgagtggggattattgccacacttttacgagtggcaacaacttgtcagagattaataaaagtgatctcccaattgccatatcatgtgctagcctttcccttgcagatgagggaataatgttgtatgatcttgttgccgtagtttctgtggatgcataa

SEQ ID NO: 55716 - DNA, 1704 bp, Glycine max
  Peptide Sequence Number=SeqID_147401
atgaagggtttgacattaaattgcatggaccgtaagtctgaagcatacgaacttgttcggcaaggattaaagaatgaccttaaaagtcatgtttgctggcatgtttatggtctcctttatcggtcagacagagaatacagggaggcgatcaagtgctatcgaaatgcactgagaattgatcccgacaatattgaaattcttcgtgacctatcactcctacaggcacaaatgcgagatttgtcaggctttgtcgagacaagacaacaacttttgactttgaagccaaatcatcgcatgaactggattggattttctgtagcccatcatttgaactctaatgcatccaaagcagttgaaattttggaagcatatgaagggactttggaagaggatcatcctccagaaaatgaacggtgtgagcatggggaaatgcttttatacaaggttgacctctgggtggtattcatgatctcattgttagaggaatgcgggtttcttgagagagctctggaggagttgcacaaaaaagaatctaaaattgttgataaacttgtatacaaagaacaagaggtttcacttttagtaaagcttggtcacctagaagaaggcgaagctttgtaccaggcattactttccatgaatcctgataattatagatattatgaaggtctccaaaagtgtgttggattatatttagaagatggccagtactctcctgatcaaatagatcggttagattcattgtacaaaacacttgtacaacaatataagtggtcttctgctgttaagagaataccactagattttctacaaggtgacaaatttcgagaagcagcagacaattatattaggcctctcctaaccaagggagttccatctctgttctctgatctatcatctttgtacaatcatcctgggaaggcagacattttggaacaacttattcttgagttagagcgttcaattaggatgtctggccaatatcctggaaggatggacaaagaacctccttcaactctcatgtggactttgtttttattggctcagcattatgacaggcgaggccaatatgaagttgctctttctaaaattgatgaagctatagaacatacacctacagtcattgatctatattctgttaagagtcggatactgaagcatgctggtgatttggttgctgctgctgcatttgcagatgaagctaggtgtatggatcttgccgatcgctatgttaatagtgaatgtgtaaagcgcatgttgcaggctgatcaggtggctttggctgaaaaaactgctgtattgttcacaaaagatggggatcaacacaataaccttcatgacatgcagtgcatgtggtatgagcttgcctcaggtgaaagctatttccgtcaaggtgatcttggacgggcactcaagaaatttttagcagtggagaagcattatgctgatattactgaggaccaatttgattttcattcatactgcttacggaaaatgactttgtgtacttatgtggaaatgcttaaatttcaagaccaattgcactcacatgcatattttcataaagcagcagctggtgctatcagttgtcagaactggtccggaccggttcaattgggaacaggactggtgatcggtccggtcactctaaaaaagcaaatgatttcagacccagtgagaactggccaagaaccggtcaaataa

SEQ ID NO: 55717 - DNA, 651 bp, Glycine max
  Peptide Sequence Number=SeqID_147402
atgccctatgtgttcatgggatacatggacaggatctcccaccctgagttagctcttgtagtgatttcggtgattagtgctttagtgtgtttcgagttaggttggagtatgtggagtatcttaaggggtggttgggataatcaaaagcttcatgtttcccttctcaatgatgtttggataaccatttctaccttagtgccacctgtgatatccaatacctctgatatgtctgcttggaagcataaaccggatggaactttttctgtttcctctaccaacatttctatttcaagtcctcctatggcaaatgatccttcattcaatctcatttgtttgactcttcctactccttgccaggttctcaaccccaatctcttcatcttctgggaagcgccactgacatgtttgtataaacttaactgtgatgttgtcgttgctctagtggcaaagctcatgtatggtagggtgttgaaggaccactttggaaccattgtttttgccttttctagcaagattggaacttgctctatcaatattgctgagttgtgggctatagccattaggatcaagattgcttccttaaggcctatgtcactcatcaagagtgttgcgaattcgtctggtatttcctcctggattctcgtttactaa

SEQ ID NO: 55718 - DNA, 1935 bp, Glycine max
  Peptide Sequence Number=SeqID_147403
atggggaatgattctgtcacactggtgaaaaatatagtggccagtggaaatgaagtgtttcagcatgagctacagcagcagttgcagccgaatgcaatgctagggatggttcttgattctgcagaaaaggttctctcagaagctgtgcaagagccggagattgagtctaccatcgacagtttagatatcagtggcaatgtctggaagtggcaattgttcaagtggagaaagaagagagccagcaatttgggcttgcttgatcgttcaagcatgcaaattggaactgatctgcatcaggctgaagaggctagggagatcccgggagggtggtggagggtttgggtagtgttttatagcagcagagggggcttagttagcagcaacattattaatactgatattgttgtactgcctctgagaggttataaacttgacagtgtccgtgaaagcaaaagaatgaggaaggtggtggtgtgtgctacagtgatcggagcgtgcacggtggtggcggtggtggtgcataggtacgcgaggaaatgtcgacggtgggcaaaggcgatagaaatattgaaggagttggaggagaagtgtgcaacgccaacgtggaagctgaagctggttgcggatgccatgaacgtggagatgcatgctggtcttgcttcagaaggtggtagcaagctcaagatgctcatcacttacgttgataagctcccaacagggaatgaggaaggactatattatgcattggaccttggagggactaattttcgcgtgttacgtgtgcaattgggaggcaagtatggtggtattattagtcaagaattcactgaggtttcaattcctcctaatttgatggttggaacatcagatgaactctttgactatattgcagcagaacttgcaaaatttgttgcccaagaaaatcaagatttccaagtgtctcctggtaggcagagagagctaggttttaccttttcctttcctgtcatgcaaacgtcacttgcttctgggaaccttgtcaagtggacaaaaggcttcaacatagacggcacagttggtcaagatgttgtggcagaattaactaaagccattcggagacaaggtcttgatatgcgtgtaaatgctctggtcaatgacacagttgggacattagcaggaggtcgatatacaaacagcaatgttattgctgcgattattttaggtactggtacaaatgcagcctatgtggaacgtgttcaagcaataccaaaatggcacggtcctttgccagattctggagatatggctatcaacatggagtggggaaacttccggtcatcacaccttccattaactgagtatgactgtgcattagatgctgagagtttcagccctggtgatcagatttttgagaagatgacttctggcttgtacttgggagaaattgttcgtcgagtactatgcaaaatagctgaagaagctttcttttttgctgacaatgttcccccgaaacttaaaattccgttcatattaagtacacctgacatgtgtgcaatgcatcatgattcatctactgatctcaatgtggtaggaagcaaactgaagaacattttggagatatctgatacctccctggaagtgaggaaggtggttgtagagatctgcaatatcattgccacccgtggtgctcgtctttctgctgctggaatcttaggtatcctgaagaagttgggaaaagacaccaagagtgaagttgagggtcagaagaatgtgatagccatggatggtggattgtatgagcattacactgagtatagcaagtgcttagagaatacccttaaagagttggttggtgaagatatctcagaaagtatcatcattgagcatttcaatgacggttcaggagttggtgctgcccttcttgcagcctctcactcccagtaccttgatgcttag

SEQ ID NO: 55719 - DNA, 300 bp, Glycine max
  Peptide Sequence Number=SeqID_147404
atggatgaagatcaaaagaattggaatgaaatggctaagacaatgatgaagattagcagaaaatcaaatataatattcaacacagttcatattaaggatcagacagtaatgacaacctgtatctgttacgtgcaacaagatctggtgaacccaactatactggctgctggatggacagaactcaaagatttctatgaactcacaggaaatcatcaagtgatcatgacccattttagacataatgttttcttccttaccatattcaaaagtaactctaaactaaaagcttatcctaaatga

SEQ ID NO: 55720 - DNA, 284 bp, Glycine max
  Peptide Sequence Number=SeqID_147405
atggatagtataggagattattttacttggagtaataaacaaaatgtgggaactatctactctaggattgatagagtgttggggaatgtgcaatggtttcaagaccgtttggattaccacttgaaaattctgcctcctagcatttcagatcatgctctgttatgtgtggaagaaacttatgatatggttgactggggtgccttggagggggttcttactgaatttggtttgcctaagaagtttattgggtgggtcatgaaagtcattactactgtgaattacag

SEQ ID NO: 55721 - DNA, 416 bp, Glycine max
  Peptide Sequence Number=SeqID_147406
atggcgccagctgtggctggcgccgtgctgcgattacccggccaaccggcagtagtagaccaggcttttaatcaacaccagcgcgtgcgggtcgcgctgaaaatcattgacgatgctcatatccagcttgtagccgctaaaacgcgccgtgcgtaccgggaacatcacgctgctgtgcgagaagcagtcgtcgagaaagatgcgaaagccctgctgctgaatattactcatattctccttgctgctgtaaatcgacggtttcagcaaattccagcaccagccggttggcccactgcgggttctgtagctgttgccaggcggtttccatcatacgggcaagattatcgcgtattcggagtgaatatgcgggagaaattcgcccggcggcagtaccacgccatctttgccccaccggg

SEQ ID NO: 55722 - DNA, 402 bp, Glycine max
  Peptide Sequence Number=SeqID_147407
atgaagaaaagagtaggaatgaaaaagaaagagaaaagaggaaagaaaaagcttcagataagggtatggaagtgccatatcccatggaagcacaaatacattcaccaggagaatatcgttgtggaaggcaactatagtgctgtgatacagaagatccttcgaccagaacacaaggaccctggaagtgtgactattccttgttcaataggtgaccagtccacagtgggaagagttgggagagttgcgagaatcatgcccaccagaatagactttacggagcaaatactgctgatcgaaaatccatcacaaggtcttaacgagtgtaagttgatatgctctgataagaagttaggaagcctagatggtctccagctgattgtggatgagatgttgttgctttga

SEQ ID NO: 55723 - DNA, 105 bp, Glycine max
  Peptide Sequence Number=SeqID_147408
atggccgaccagcaggcgaccaagtccaaagccaaagctcaagacgttaaagaagcgctactaggaggcaacctagtaccttttaaatttcttcctgctatttga

SEQ ID NO: 55724 - DNA, 453 bp, Glycine max
  Peptide Sequence Number=SeqID_147409
atggtgatcactcgaacaaaagggaaagattcgcacaagcttggagcgctatccgcagactcagcagaagtcagttgggaaagaaatcagactatgtgcacgaatcttatacccaatggatacctatcgtccaccatcccaccatcatccttgcctatccccttcgacaccaaggaagagtttcatgaacaattaaccaaagaaaggcaagaaaaagaaacttggaagaggagatgccaggagctcgagcaagagaatgagactttgaaagggaagatagcccaacagagccgtgagctttttatccagaaccagaggatgatcgagaaggacgacttgcttcgtcagaaagacgccttgctccaccgagatgctagaaggaagaggaggtttatggacttgttctcccgtgcacattcagattccgaggacccatctactccgggagtttga

SEQ ID NO: 55725 - DNA, 399 bp, Glycine max
  Peptide Sequence Number=SeqID_147410
atgttgaagaatgtcgagaatcttcgcgtaattactcacggaaacgttacggaaacgttacggaagtgcctcggcttggattttcttcacggaaataatttactcagcaatttcgagagaagagaagtgccaagaaggctaaacccttttctcttcactcctccacctatttatagcaaaataggggaggagcttgccacccagctcgcccaagcgagcaaggttgcttcctccagaagcaacagccttctggaggaaggatttggaaggcccaagtgggccagattgctaattctttcgaagaagttacggaaacttacggattgcgaaaaaacacctcttttcgatttccgccacattacggaatttcacggattgcgcaagcctgcttccttttga

SEQ ID NO: 55726 - DNA, 102 bp, Glycine max
  Peptide Sequence Number=SeqID_147411
atggataagagcttgaaggtaggagaagatgagtggagggagagggagagaaggcccactaatccaagatcaagtccaagattctccactaactatgattag

SEQ ID NO: 55727 - DNA, 276 bp, Glycine max
  Peptide Sequence Number=SeqID_147412
tcgaacgaccgagcgtagcgagtcagtgagcgagtggaagcggaatattcctcgggtatccactattctagcggccgccaccgcggtgcagcttttctcctgccactatagtgagcgtattacttcactgacaccgtcgtttacaacgtttcccgaacagttgcgcaccgaaggcgaatgggacgcagctgagcgcaacgcaattaagcgcggcgggtgtgagtggttagctcactcattaggcaccccaggctttacactttatgcttccggctc

SEQ ID NO: 55728 - DNA, 455 bp, Glycine max
  Peptide Sequence Number=SeqID_147413
cttcattgcctaacaggccaacttacaaaagcaatccccaagagactcaacgtaaggatgcacatgccaaagttgagtatgtgaaaagattgtatgaccaagtgaaggtgcaaattgcaaagaagaatgaaagctatgccaagcaagacaacaagaaaaggaaggaagtggtacttgaacccggtgatgatcctggacatttgaggacaaatgttttccaagaaggagggaatgatgagaatcatgaaactggccaaatacaggctaaaggcccaagtggagaaggacgaaggcccaagtggagaaggacaaagcccccgagtaatccttgtggcgtctacttggacttatcttccttcaccggaagtggcgtctaccctgacttatcttccttcaccggaagtggcgtcatccaaacctccgtagcctgtatcaaacgatccgttcctactcag

SEQ ID NO: 55729 - DNA, 97 bp, Glycine max
  Peptide Sequence Number=SeqID_147414
atggagggtacaaactacatgaactggatggaaaagcaattccaagaacacggaggtaccgagctcgaattcgtaatcatggtcatagctgtttcct

SEQ ID NO: 55730 - DNA, 327 bp, Glycine max
  Peptide Sequence Number=SeqID_147415
atgttggataaacatggagttatgggacttgcaaaacctgcagataggtcggatcatgaggtcgatgatcccttatatctgatgacattgatcatcccacagctttttctgaagccattgcaggttatgtgggatgctaccttgtttgacctgtttaatgaagacttacccttgtacataaagtatgaagatctatttgaaatagcacacggtggtcaatgtgtcagcatctctgttatacagttgtggattctgcatatgactgggacaagtatgcgagcgggaaataccgatgtgtatggattcctcgagccacagtctatctag

SEQ ID NO: 55731 - DNA, 234 bp, Glycine max
  Peptide Sequence Number=SeqID_147416
caaccaggcccacttggcccttccagattcttcctccagaagccggttgcttctggaggaagcaacctggctcgcttggccgatctgggtgccaagcttctcccctattttgctataaatgggggaaggagtgaagaagaaaagggttcagccttcttggcacttcgtattcacttgaaattgctgaggaaaattgtttccgtgaagaaaatccaagccgaggcacttccgtaa

SEQ ID NO: 55732 - DNA, 224 bp, Glycine max
  Peptide Sequence Number=SeqID_147417
atgccctcaccatcagaggactacacgtcttcgccttcagaggactacacagcactacacgtcttcgccatcagagggctacacgccctcaccttcagaggactacacgtcctcgccatcagaggactgcacgccctcaccttcagaggactacacgtccttgccatcagaggactagacgtcctcacctatagaggactacacgtcctcgccatcaaagagtt

SEQ ID NO: 55733 - DNA, 78 bp, Glycine max
  Peptide Sequence Number=SeqID_147418
atggacacccgtctccgtgtgattggtgatcccatgaatggagttcaacgggggtgggggtcacaactccctctttga

SEQ ID NO: 55734 - DNA, 381 bp, Glycine max
  Peptide Sequence Number=SeqID_147419
atggttgagaagggtctggtgaggtttggggacttgcagacaatgagaagagtgaagacttggaagagattattgatgaagaagatgcgaatggctgcggcgaaggaggcagagaagtctcttccggtgtctccgggcggtggtgctcagactctacctcactcaatttataacagtctcaagacatttgcaaatccttgtggggatgcatggcatgagggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 55735 - DNA, 406 bp, Glycine max
  Peptide Sequence Number=SeqID_147420
cgccacgcttcccgaagggagaaagccggacaggtatccggtaagcggcaggttcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccctccagagaaggctattattggaagatga

SEQ ID NO: 55736 - DNA, 543 bp, Glycine max
  Peptide Sequence Number=SeqID_147421
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccaagtccatatagcctctggtgtctactttgtagcctgcaaagccaaggagtggaccggcgtgaaggtggacagtgtcaagggagacctcgagcctctagaaagttttctaatatag

SEQ ID NO: 55737 - DNA, 267 bp, Glycine max
  Peptide Sequence Number=SeqID_147422
atggcacgattttcaaacatagagattgctttctttcaaagatacatcctttgtggtacaagtagagggtacatctacttgggttgttatactgagaacaagaaagggtacatctcttgtggatcaattcaagtggagggtacatccacttggttgttcaaagagaataagggagggtacatcccttgtgaatctttggcttgtaaaggattttacaaggttgaaagaaatctcaaggatcgttggttgcttggggactggatgtag

SEQ ID NO: 55738 - DNA, 468 bp, Glycine max
  Peptide Sequence Number=SeqID_147423
atgactagaggcaatccatctaacttacaaccctttgaccctgagatagataggacatttcatagattagttaggcatcattttataccttttgatcatcctgagcattccattactggtgaatctgtgcattctgttattggtgattttgaacatcctgatttggagcattataattttgagcattctgattttgcacattctgagaacatggcacaacctccaccccgtgagaggactctaagggaaatggctgcacctgatttcacctacgaaagcttgtgcatccaataccctgataaggatgtcccatatgttcttaaaactggactgattcatttgcttccaaagtttcatggccttgcaggcttttcctcattctctggagggagtggcaaaggactggctgtattaccttgctccaaaggtccatcacgagctgggatgacctcaagagagtattcttag

SEQ ID NO: 55739 - DNA, 426 bp, Glycine max
  Peptide Sequence Number=SeqID_147424
atggacagaagtatgatagatgcttccaatggtgcagcccttggagacatgacccctgctgaagccagaaatttaattaagaagatggcttccaactcccaacagtttagtgccagaaatgatgctatagtcattagaggagtgcatcaagtagccacgaattcatcttcagcagctgaaaccaagaaacttgaaggcaaactagatgccttacttaacctggtaacccagctagccttgcatcagaaatttgtacctgtcgcaagagtctgtggtttatgctcctcttccgaccatcacacagacctttgcccttccaaggcaatcaatataccatgcttaaaaaaaaaatcgctagtgctggcagcttggacatacaaacttgtaaaaattactgagaattggttacttcgaattttgagctga

SEQ ID NO: 55740 - DNA, 967 bp, Glycine max
  Peptide Sequence Number=SeqID_147425
atggctacctcaccaaaagatacttcatctcctggttcaccctctgtaccatcatctccatcatccaccaaagcaccatcaaaccaggaacaacctgaattccatatccaacccatacaaatgattcctggtcaagcccctgttcctgagaaactggttcccaaaagacaacagggagtgaagatttctgaaaaccctagccttgcaacaagtcctagggaagtagacccggagatggataagaagatccgcagtattgtgagtagcattttgaaaaatgcttctgtccctgatgctgataaagatgtccaacatcttccaccccaaatgctgaagtcctctcttcatccagtaaagaggaatcaacagaggaagaggatcaagccacagaggagacccctgcaccaagggcaccagaacctgctccagttggcacctggcattgcagaaagattacaaagcagaaagggaaaaacccccatcactaggtctggacgaatcaaaactattgcacagaagaagagcacaccaatcactcctaccacatccagatggagcaaagttgcaatcccttccaagaagaggaaagaaatttcctcatctgattctgatgatgatgtcgaactagatgttcccgacatcaagagagtgaagaaatcagggaaaaaggtgcctggaaatgtccctgatgccccattggacaacatttcattccactccattggcaatgttgaaaggtggaaatttgtatatcaacgcagacttgctttagaaagagaactgggaagagatgccttggattgcaaggagatcatggacctcatcaaggctgctggactgctgaaaactgtcaccaagttgggagattgttatgaaagtctagtcagggaattcattgtcaacattccctttgacataacaaacagaaagagtgatgagtatcagacagtgtttgtcagaggaaaag

SEQ ID NO: 55741 - DNA, 462 bp, Glycine max
  Peptide Sequence Number=SeqID_147426
atgaaaagagaaaaacatgcctcctatagtagtcataactcttgcaagagcctaagtgaagaacttcgtgactattatgaaggaaggcataagtcacatcttagacctcagtcccataggagagaagatgaaagaaagcctcaagaggctaacattaacctcccatacttccatgggaaggacaatgtagaggcttacttagattgggaaataaggatagagcaaaaacttaaaagaaagttcactttaaaatcttatggatctcattcttatccaaagaaagaccaagatgacacattacttctcaatgcccccaccaagaaaaccattattatgaggagccaagacatttatagtagccaagatgaggctactacttcaccttcctctagtgaaagtgaagaagcaaaaagggaagaatctagtgaagaaatctaccccaagaagaaggacaacctttaa

SEQ ID NO: 55742 - DNA, 391 bp, Glycine max
  Peptide Sequence Number=SeqID_147427
aggatatgttggtaagctgcccctcctcggcaccatatgtagaggcagcggaggaataattggaaacaactttccaatccttcgaggtggcacggttatgagcccagaatgggtttgggcaaggacagccacgggaatgccgatgtggttaacattaggggtaacccgcacaaatatgggttggggtatgagcccgggaaacctggaagaaggaatgcaccatcaagactccgggcagatagggcatggcccggagaagaagctccacaagatccgccaagtttcgtgtgaccgtgccatcccaattttcaactggggaattggcatatgtgaggatcaatcctttgaggatcctaaccacgagggcttgataatcgattttgatcaagaa

SEQ ID NO: 55743 - DNA, 477 bp, Glycine max
  Peptide Sequence Number=SeqID_147428
atggagaaaaaaatcactggatataccaccgttgatatatcccaatggcatcgtaaagaacattttgaggcatttcagtcagttgctcaattgttcacccttgttacaccgttttccatgagcaaactgaaacgttttcatcgctctggagtgaataccacgacgatttccggcagtttctacacatatattcgcaagatgtgggcgtgttacggtgaaaacctggcctatttccctaaagggtttattgagaatatgtttttcgtctcagccaatccctgggtgagtttcaccagttttgatttaaacgtggccatatggacaacttccttcgcccccgttttcaccatgggcaaatattatacgcaaggcgacaaggtgcttgatgccgctggcgatcaggttcattatgtccgtttgttgatggcttcctttgcgggcgaaatctttatggaattacaacagtactgcgaatga

SEQ ID NO: 55744 - DNA, 114 bp, Glycine max
  Peptide Sequence Number=SeqID_147429
atggagaaaaatgaagaaacaacaatggaagagaagctcttgtgctctgattaccacttgatggaagcttgcttgtggggcttctatggaggctggatctttgagcttaaatga

SEQ ID NO: 55745 - DNA, 135 bp, Glycine max
  Peptide Sequence Number=SeqID_147430
atgttccctcatgggaagatgtccatgaaaggagttttcagaccttaccctactctaacatacccaacaccactaatacaagactccaagaggcttgggctagagctactaaagaaggccctagggttctcatga

SEQ ID NO: 55746 - DNA, 792 bp, Glycine max
  Peptide Sequence Number=SeqID_147431
ccgggcacgacgggggctctcaccctctctgggcgccccgttcccaggggacttgggcccggtccgccactgaggacgcttctccagactacaattcggacgccgagggcgaccgattttcatggtgggcttttcccggttcgctcgccgttactaagggaatccttctatcctgagggaaacttcggagggaaccagctactaagggttcgattagtcttcagaccctataccagtcagacacgattgcacgtcagtatcgctagcgtggcctccaccagtttcctcactggcgaagttcgcctgaaccgctcagatagttcaccatctttcgggtcccgacaggtatgctcgggatcacatcaacccttcagcgcagcaacattgttacatgtttgcgttcggcggaaacgatgtgtgacaacccacaggcgtcccaccctaatcaggcttcctgggcgcaacttacgtttcaaagactcgatgcgttcacgggattctcgcattcacatgtcagtatccttgtcacgttcttcatccgatggggagcccacaggccgagccgagatatccgttgccgagagtcacttgtatgtccaatgttgtgcgcgcgctgccatccatcgcgggacgtctccgggacgggagtcgcactataacagcccatttgagtcttggacgcatcgcaatccgcgtcggtttgtgtttgtcgccgagtcgatcgggaggctctcacggcgttccacatccgaccgggcgcctggtccatccccttccctcccgactagatga

SEQ ID NO: 55747 - DNA, 384 bp, Glycine max
  Peptide Sequence Number=SeqID_147432
atgtcgcatgagtctgtggttttatgctcctctgctgaccaccacacagacctctgtccttccatgcaggaacctggagcaattgagctgcttgaagcttatgctgcaaacatttacaatatacctcctcaacctcagcagcaaaatcaaccacagcagaacaattatgacctctccagcaacatatacaacctggatggaggaatcaccctaatctcagatggtctagccctcaacaacaacaatagcagtctgatccttccttccaaaatgctgttggcccaagcagaccatacattcccccaccaatccaacaacagcaacagccccataaacaacaaacagttgaggctcctccgcaaccttccctcgatgaacttgtga

SEQ ID NO: 55748 - DNA, 534 bp, Glycine max
  Peptide Sequence Number=SeqID_147433
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccctgtccacctcacgtcggtccactcctcaactttgcaggcgagagagtagagaccagaggctacatggacttgatgaccaccttcgatcaaggcaagctctccaagagcttcaccataagatacctattgggggtaccgagctcgaattcgtaa

SEQ ID NO: 55749 - DNA, 159 bp, Glycine max
  Peptide Sequence Number=SeqID_147434
atgaagagtgcattggacaaggaagggcaggatcatcttgagctaccttctggggtggggacaaaacatgaacagcagaaaccaaccaaggtacttaggaacggatgcaactggggatggggtcacgaccgactaatcgtcgccccttctctgcgctaa

SEQ ID NO: 55750 - DNA, 159 bp, Glycine max
  Peptide Sequence Number=SeqID_147435
atgggtgccaagtacctcgaagtggtcaagcaaaggttacatgccatcaaacaatggtccccggacgaaattaggagatttctagagagagaaaggtccaagttccaaagagttttgattgcttttgctgtgcgaagattggcagagaatcgagagtga

SEQ ID NO: 55751 - DNA, 659 bp, Glycine max
  Peptide Sequence Number=SeqID_147436
atggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccgtaaggcgcaaggaagctgattggtgggatccccctgtggcggggcgaagccagaggaaactctggtggaggcccgcagcgatactgacgatagctggagcccgcgggcgagttctatccgggacggtgcggctgctctgtgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccg

SEQ ID NO: 55752 - DNA, 240 bp, Glycine max
  Peptide Sequence Number=SeqID_147437
atgccttcaaggaaaaattctggaaaattattttccacgagatctcaggaagcggaaggcgagggaatttctggatttgaagcagaggaacattattggcctcaataccaagatgctcggaatgaagaagatctatgtgctcagtttgagaatgggcttcgattggagattcaacaggcggttagctacatgcagatcacggattttaatcagctggtgacaaagtgtaggattctttag

SEQ ID NO: 55753 - DNA, 622 bp, Glycine max
  Peptide Sequence Number=SeqID_147438
ggagaaagccgggacaggtatcccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccgcaaaacgtcatttgaactggtgactttgccttggatcttggtaatttgcgctggtcctgtcattgtcattggcgatttggccaagctagatgggaaacgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 55754 - DNA, 192 bp, Glycine max
  Peptide Sequence Number=SeqID_147439
atgaagatgctcttaataccacatgatgtaattagaatgaagaaggaagagagagagaggagatgccacttcaaggagaagatgagtttagaagaagctcaccaccataggaggccatggataagagcttggaggaagaaggagatgaatgaagggagaggaagagaagagcacgaaatttttgtgctctaa

SEQ ID NO: 55755 - DNA, 189 bp, Glycine max
  Peptide Sequence Number=SeqID_147440
atggcatgcaaaccgaggcaggattttagcgtttcaaagccctacattttcagacagctctctctctccctctccctcacgttgcttttctttctccttcattctccattgaagctccaaacaaagctccaacctttggccatcatttctgctccaagtcacgaaaggagggcattttcggagtcgtga

SEQ ID NO: 55756 - DNA, 330 bp, Glycine max
  Peptide Sequence Number=SeqID_147441
atgaagagttggatgcagagttcaaatcgggatgtctaccttgtagcctacctgaatggcgcacactggaaaatggttgtcattttgcctatggaaaatctagttgtctggttttgttccttgcataataggccagacaattaccttaaaggaataattaacagtgctttgaaaggacttgatgatactccacaacctaaatcgaaggctgctgctaggtggattgttgttaagtattttaatgatgctagactattggaagcagagagattgaaggcgcttcgcatccaatgggcacagtattatctcaaagttaaaaatcaaacttag

SEQ ID NO: 55757 - DNA, 87 bp, Glycine max
  Peptide Sequence Number=SeqID_147442
atgaggcatgtagggaggagttggctgcgcaacaccactggatttcgagcatttagccttctggtaattgattacaggctgctgtaa

SEQ ID NO: 55758 - DNA, 513 bp, Glycine max
  Peptide Sequence Number=SeqID_147443
atgcgttcgtgggtgaggggtcagtggattccctttgacgcagatgcccttagccagttcctgggtgacccgctagttttggaggaaggccaacagtgtgagttcagcccagaggaggaacagggccgacgggatttttcccggaccgctgcagggaggcgggtgcggatcatgcgcaccagcatgaccactttgacccagacatggatgacactactgctcaacaatgtcttgcctagtgatcacaactccgatcttcctctgcctaagtgccagttggtgtatgccatcctgacacgaatgagcgtccacgtggcccaggggcagggttccgccccttttgcatgccctactttggagcagtttggggctgaggtcgcatggcttggagactggcccgatgcccaggtaggggaggagcctgcaggatcccccagtgagccagatgagtcccatatggatgaagatatgactgacttactcggtttcttgggagggagcggagccacgtga

SEQ ID NO: 55759 - DNA, 170 bp, Glycine max
  Peptide Sequence Number=SeqID_147444
aggaatggacaaagggagagagagagaggagacgccacttcaaggagaagatgagtctagaagaagctcaccaccataggaggccatggataagagcttggaggaagaaggagatgaatgaagggagagggagagggagagaagagcaagaaattttgtgctctaaatga

SEQ ID NO: 55760 - DNA, 669 bp, Glycine max
  Peptide Sequence Number=SeqID_147445
atgaggtcctgggtgagggtgctggaagagggtcaggagtgcgaatatggccagaggaggaaccggtccgatgggttcgatgaggaggccatcgcccagttgctgtgtataccggggcaggattttgcccggactgctgccgggagacgggtgtggatcatgcgcaccaagatgaccaccctgactcagatatggatgactttgctgctcagcaacatcctgcccagcgatcataattccgaactccccctgccgaagtgtcagctggtgtacgccatcctgacgcggatgagcattcatgtggctcagttaatcgctgatgccatctatatatttgcaggtatggcgcctaccaggcaccctctggacccggataagtccaacagggccctgggatttcccgccttgatcacaggactctaccagtcgttcggcgtccccgtcgcacctagcaaggtgattcggccgcccatcacccgagcttttattgagaagtactgcacgcagagacaggtccaaggtgatgcaccacaagccgcggacgcgccgccacctcatcaggctggtccagtcggatcgtttgatacggagcagtatttgcggcatttggttcaccagcaggcggccaaccaccgagctcatgtacagacccatgattgtctttattag

SEQ ID NO: 55761 - DNA, 279 bp, Glycine max
  Peptide Sequence Number=SeqID_147446
atgggtgccaagcacctcacgaggaccaaagaatggtcgcacgttatcaagcaaaggtccccggacgaaattagggttacaggttgtaccatttggggtggtgctcatgaatccggccattgcattccttttgaagaaaaaacgcagaaagttagttacatgggaaatcaacaaaggcaaggatacaaccaaggaggactctcaggtttccagcaaggtccctacaatcagcaaggacaatggagatcacaccctagtaatcaattcaataaggactag

SEQ ID NO: 55762 - DNA, 483 bp, Glycine max
  Peptide Sequence Number=SeqID_147447
atgaaaacgtttcagtttgctcatggaaaacggtgtaacaagggtgaacactatcccatatcacccagctcaccgtctttcattgcccatacgaaattcccggatgagcattcatcaggcgggcaagaatctgaacggtctggttataggtacattgagcaactgactgaaatgcctcaaaatgttctttacgatgccattgggatatatcaacggtgttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 55763 - DNA, 357 bp, Glycine max
  Peptide Sequence Number=SeqID_147448
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggggttatccaaagaacataatccgaggacgaattcttttcaaggaggaggggatgatagaggactatcctaccgagctcgaattcgtaatcatggtcatagctgtttccttcgggaaacctgtcgtgccagctgcattactgaatcggccaacgcgcggggagaggcggtttgcgtattgggcgctcttccgcttcctcgctcactga

SEQ ID NO: 55764 - DNA, 196 bp, Glycine max
  Peptide Sequence Number=SeqID_147449
ggaggtggtttccgtccagctcgcccaggcgagctgggttgcttccaccagaaggcaccgccttctgttggaaccccatggaaggcccaaaatattgcggatctttacggattgtgcaacaatgcttgttttgatttccggcatgttgcggaacttcacggattgcctaacgatgggtgtcaagtacctcaaggcg

SEQ ID NO: 55765 - DNA, 216 bp, Glycine max
  Peptide Sequence Number=SeqID_147450
atgtcatcaagcaaaggtccccggacgaaattagggtatgacagatccgacgacgagtccctcaaaggtactaatacctgggacccgatcatcgatttcaagcaagaagcgggtcagacggagagtgaagaggacgaggatgtgggacttcccccggagttggaaaagatagtcgcccatgaggaccaagagatgagcctcatcaagaagagatga

SEQ ID NO: 55766 - DNA, 969 bp, Glycine max
  Peptide Sequence Number=SeqID_147451
atgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacaagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacatcggattccccttgtccgtaccagttctgagtttgactgttcgacgcccggggaagaggccccgaagggcccgttcccaatccgtccccgaacggcacgcgacgacccgctctcgccgcggaagcagctcgagcagtcccaccgacagccgacgggttcgggactgggacccccgtgcccagccctcagagccaatccttttcccgaaggttacggatccattttgccgacttcccttgcctacattgttccatcgaccagaggctgttcaccttggagacctgatgcggttatgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaaacagaaaagataa

SEQ ID NO: 55767 - DNA, 630 bp, Glycine max
  Peptide Sequence Number=SeqID_147452
atgagattgctatcaaatgctcccctacagcccaacaatgaagaacttaaacaattttcacattgtctacttgacataggagatggaaaaattggacaatataatgacgggttttcagaaatcactatcccagatgagtttcttataaaaaattatgatgatcctatccatgctattgttgaagccacctatcacagcttgataaataactacagtgacacagattacttgcaaaaaagagttgttcttgcctctaaaaaagaaattgttgacaaaataaattattatgtcctattacttatacccaatcacgaaaaagagtattgcagcgcagatagtattgataaatcagatgaattgctcaatcctgcttttgcattattgccacctgaattcctatattcattgcaaacatcaggtatacctaatcataaattaaaacttaaggttggaactccaatcatgctattacgaaatctcgaccagactgatggcttgtgcaatagaactaggctcattatcaccaaactcggatctaatgtgattgaggctaaagtaattactggacctaattcaggaaataggacatacatacccagaataaatatgtctccttctgaatctccatag

SEQ ID NO: 55768 - DNA, 724 bp, Glycine max
  Peptide Sequence Number=SeqID_147453
cgataacgctgatgcgctgcctgaggtcatggtgttgccgcaagcggaaagccgcgaattaacggtggtgctggcgctgcctcatgagcatgaaaacggcggcaactgcctgcagatggaacaacgcgcagagcggccggtacgttggcgtttggcctggcgagaagtacgcaacagatatggcgaagacagtcgacaaattgcggtgatgcttgcgcaactgacgctgcgcacagcggatgacaataacggcgattatcaaaccgtcgccgtcgccagattacgtcgcgacagtcaggattgctggtcgttggatgaggactttatcccgccgctgctgaaagtgttggccagccgctggctgcacgaacaaacggaacagctgacgaatcaactgggcacgcgcctgcaacgcctgatggccatgcgtcgggaaagcaacgccaggatggcggattttgcggtagcggatgtatcgctgttttggctgctgaacgcgcttaacagcgcggagccggtgttgaaccatttcctgcgccatccgcaggtacatccggaacggctgtatgaagcgctggccagcctggcgggcagcctgttgaccttctcccttgaccataccacggcggatattccgccctatcgccatcaggcgttgacagaagtctttccaccgctgtttcaattactcggcgtactgctcgaagccaggctgccatcccgg

SEQ ID NO: 55769 - DNA, 324 bp, Glycine max
  Peptide Sequence Number=SeqID_147454
atggtttctagaggtatcatcccctttgaaaaacatattgcgatagtagggactaccagcaataatacgttatcaaagagaaaaactctagatgagggttcactgttatcaagcaagtcggagacccaacatgaccacagattcacctccactccttatgttcccatggacccagtccccagtggagtcaccaattgtcgcaacctaccctttggcgggagggcgaagcgggctcacgggtgcgtcttccaagggaggaaaacgtgcggagttgccaccaacgtttattcgaggaaaatgtcagaaaagacaaaaaaggtgtag

SEQ ID NO: 55770 - DNA, 408 bp, Glycine max
  Peptide Sequence Number=SeqID_147455
atggataaccattcatggtgttatccagcttgtgttcaatgtcataggaaaactgacatccaaacaggaccattcacatgcagatgtgacaaggataatgatcagcctgttctgaggtatagagttgaagtcatggttacccaaaacaatgagagtagcaagtttttgctctgggaccatgaatgtgctgaattgattggtgaaatagctgatgatgtgaatagggtcaagattgaaaatggtgatcttgatttgaatgcttcccctcaagcacttgacaaattgttgggtcatgtgcttgcttttaaggcatgttccaaaatagatccttccaatgttgattgcaataatactacacatgctgaatgttttatgctttatgcaacaatctctgtctgtcatagctga

SEQ ID NO: 55771 - DNA, 408 bp, Glycine max
  Peptide Sequence Number=SeqID_147456
atggctcatttactggcgagcaaccccaatgcttcacagaaacttaccttctcaaacttggggtattatggtgttagaagaggatccagaaccaaaggttcgtgttacagagtgggaaggaaaaggcgaggtggtttggtgttgcaatgcagcagcacaactgatcaggatgtgaggttgcagattgagagtggtagcatcggaaagcttaagcagcattttgaatatttggtgtgtgaatatgggtggagagtaagaagactatttgaaaacgcagatgagataaagaaggcatctcatgttcaggccgaagcattccatgttcctgtctctcttttcaacgaattgttcttccaattctttcagaagaggcaagttttcttaagggtaccgagctcgaattcgtaa

SEQ ID NO: 55772 - DNA, 483 bp, Glycine max
  Peptide Sequence Number=SeqID_147457
atggacgaccatgccgcaaaagcccgcgccgtacagattttgcgtcaggatgcggcgcaactggatgccttcgcgcgtgatggcgcgccgctggcgctgggccttgggctctatcgcggcgagcgtctgcgtcagccggtactggcagcgattcgttcctacgtccctccgcctccaccgccgaaagcggtagaaaaaatcgtaccgaaaattgtccgtcttgacagcatgtcgctattcgacaccggcaagtggacgcttaaaccggggtccaccaagctgctggtgaactcgctggtggggatcaaagccaggcccggttggctaatcgtcatcgccggacataccgacagcgtaggcgatgataaatccaaccagacactctccctgaagcgtgccgaatcggtgcgtaactggatgcgcgataccggcgacgtgccggaaagctgttttgcggtgcagggttatggcgaaagccgtccg

SEQ ID NO: 55773 - DNA, 660 bp, Glycine max
  Peptide Sequence Number=SeqID_147458
atgggtgaagtagagaaggtgcaagagcagatgaaggctgacatggaggccatgaaagggcaaatggccacaatgatggaggccataataagcatgaagaagataatggaagccaatgcggttatagttgccgctactagcgttgttgctaaggtgaacccgatgctcccatctggcctcaagcaaatgaatcatccaacctcaaatatggtaggcaaagatttgggaagtacggatgaccccatgatgtgcaaattcaaaacaagcacgccttcccgccatatggcttgcctcccaaactatacaccacccaatgtggcgtacattcccaatgaggatgtcaataactccacttccatactcattaagagccaacaacctcaatctgatcatgcacatgtctctcgacccatggaggagacacatggaatgccccaccacaatctagccgacttcgagccttgcctcggatatgccactgaagggcaagcagttggtggtatacccctgcaaaacactttggagggccctcagtgtcacccacaaccacaaccctcacattccacagcggttaaaaaccctcatgctatggcagaaatgggaaagaggaaaggctcagggccattgaaggaggtaaagattatgcctttgctaacctag

SEQ ID NO: 55774 - DNA, 636 bp, Glycine max
  Peptide Sequence Number=SeqID_147459
atggcgtcatcaggaggtttatcatggagtgctaagaattctacgcgagggtctagattgtgctctcaaggattgaaaggccctctaggggggaggaaaccgtatctcttctccggttttcttccttccttgagcagaaattccgaggctgtgtggggtcagcaacaggatggagctcaagtccgaagcaaactcggaacgacgagtgggcttgcctcgaaaatacttggaaggaaagaagggacctctagagcgagccaaaagaagtggggctcgtttgcagatattttagccttgctgatttttggggttgtcctcttcccgaacgttgacggtttggtagacctagccgccattgatgctttcctcgcatatcaccatagcaaggaaagtccagtggtggctatcttggcagatttgtttgacacctttgaccagaggtgtgagaaaaacagcgtgcggattgtctgttgtttacccactctctgtgtatggttgatttcccacctattccgacagacacgagacacccgtgtccacttcaaagctatcgctcatgcgccaaaaaaggaagatttgattgggaccacatttggctgggatagggggcagcgcgatcaattgtttcctcgttga

SEQ ID NO: 55775 - DNA, 211 bp, Glycine max
  Peptide Sequence Number=SeqID_147460
gggggtacaaatagcaatcatgcccacttgggccttccagattcttcctccagaaggctgttgcttctggaggaagcaaccttgctcgcctgggcgagctggggagaaggggttcaaccttcttggcacttctcattctgtcgaaattgctgaagaaaatcatttccgtgaagaaaatccaagccgaggcgcttccgtaacgtttccgtga

SEQ ID NO: 55776 - DNA, 483 bp, Glycine max
  Peptide Sequence Number=SeqID_147461
atgagtgatggattttgcggtactcatttgcagatcatggttaggaccagaggattaggtcgtgccttaggtcaggtcactggcagaggtgtgggcagaggagatcgtgatgattccgatgatgctccacagcgtcgacgacctactgcatccgcatggaggcagcgagttgctgtgactgcggatcacgtcgatgagccagtcatccctgcaccagatgttcaggatgacccgatggaggcaccagctactgtagaggacattcctacggacacaggcgcagaggctgctgaggatgagcatcagggatttccgggtggtccgagcgacccatccgtgttgaccctgtatgcggatcacgttgcttgcagcgtatggacgggagatgagcgtcctgaattgaagctatcctctcatgggaggaaggttcacagtttaggtaggcctgtccctgccattgagggacttattgttggtacatga

SEQ ID NO: 55777 - DNA, 327 bp, Glycine max
  Peptide Sequence Number=SeqID_147462
gacctagcgatttctgcaaaaagcctgttagattatggatgtttggaatcaatctcgattcctccatctgatagattcgagggattcaacccctcaatcaatgaggctataaacctgataaaggcagaaataatggactacattgccatcaaaataacaacttgcccgagcaactttggtgctcagaattacccatgtcatgttatgaaacttttaccagagaatcatagaaactatccctgtatgttcagtgatgagtacgaaagttgggatgtacagggtaatacacagtaccaatacagcctcatgagggcacaaaatacaagg

SEQ ID NO: 55778 - DNA, 174 bp, Glycine max
  Peptide Sequence Number=SeqID_147463
atggctcgttcggtgcgatcataccagcactactgcacccgatcccatcagaactccgcaattaagcgtgcttgggcgagagtagtgctcggttgggtgacctccttgaaagtcctcgtgttgaatctctttttcgtttttttcccttcttctaagtatttttctttgaagtga

SEQ ID NO: 55779 - DNA, 810 bp, Glycine max
  Peptide Sequence Number=SeqID_147464
atggccaagtttgatccagacatagtcctcgaattttatgccaatgcttggcctacggaggaaggcgtgcgagatatgaggtcttgggtaaggggtcagtggatcacgtttgatgcagatgctatcggccagctcctgggatatcctttagtgctggaagagggtcaggagtgcgaatatggccagaggaggaaccggtccgatgggctcgatgaggaggccatcgcccagttgctatgtataccggggcaagattttgcccgaactgctgccgggagacgggtgcggatcatgcgcaccaacatgaccaccctgactcagatctggatgactttgctgctcagcaacatccagcccaacgatcataattccgacctccccctgccgaagtgtcagttggtgtatgccatcctgacacggatgagcattcacgtggctcagttaatcgctgatgccatctatatatttgcaggtatggcgcctaccaggcaccctctggacccggataagtccaacagggccctgggatttcccgccttgatcacaggactctgccagtcgtttggcgtccccgtcgcacctagcaagatgagtctcagcctgcagagccagggttttacttctttttcgtgccctactctggaccagttcagggtagaggtcgcatggcctggagattggcctgaggcctgggcaggagagacgccagtaagggcaccagcagaggctcccgacgaggcagatgaggcccacgaggacgaggagatgaccgattcacttgatttcctaggagggagcggggccacatga

SEQ ID NO: 55780 - DNA, 472 bp, Glycine max
  Peptide Sequence Number=SeqID_147465
atgagaggactacacgtcctcaccatcagagggctgcacgccctcacctccagaggactacatgtcctcgccttgagaggaggactacacgtcctcgccttgagaggactacacgtcctcaccatcagagggctgcacgcccttacctccagaggactacatgtcctcgccttgagagggctacacgccctcaccttgggtactagttaccctcaccgtcagaggactacacgtcctcgccttgagaggactacacgtcctcaccaccagagggctgcacgccctcacctccagaggactataagtcctcgccttgagagggctacacgccctcaccttggaggactacatgtcctcgccgtcaaagggtcatgtgccttcaccttcgtagggctacacgtcctcacattcagaggactacacgtcctcacctttagaggactaccacgtcctcgccatcagaggactacat

SEQ ID NO: 55781 - DNA, 195 bp, Glycine max
  Peptide Sequence Number=SeqID_147466
atgtctgctggtctacaaatcactggctggcctgcacatgattcttccatcagttcaattctgtttggaccagatgagactagcatttttagcctgggctctgatgggaaggcaagcagtaaacggagctttatctgttgtttgagcagttctgtgactacttccatgcaacatcaaggaattcaatgtatatga

SEQ ID NO: 55782 - DNA, 180 bp, Glycine max
  Peptide Sequence Number=SeqID_147467
atggctttttatggaatcgcgggtctctttagtagtttttattctgggtcgattattttgtgggatataggtggtggttttgatatcttcaataaaaaagggaaaaagatgaggcgttatttgatttcgaaatccgattattatattcctaacccgaagtgctccttggtgtattcataa

SEQ ID NO: 55783 - DNA, 354 bp, Glycine max
  Peptide Sequence Number=SeqID_147468
ttaggtggtaggcggagatacccaagtggttatccgtacaaaacgatttctgttaatcctgacccgagaagtcagctggcaggcggagatacccaagtggttatccagactaacgttgtcatttgcacccttcgtcaaccaagggcaagcgagcccgttgacacgcagagactaacgtcgtcttctacacctttgtcatccagagacggcgagtccgatcacatgcagagatacccaagtggttatccgtacaaaacgatttctgttaatcctaatccgagaagtggcaggcggagatacccaactggttatccggataaacactcttttgctatccgtcagactcagagtcag

SEQ ID NO: 55784 - DNA, 298 bp, Glycine max
  Peptide Sequence Number=SeqID_147469
gagcgtcatgagccgaagttggtgtcgcacgggaggaaggtggctttaattgggaggccagtgcctgagattgaagggctggttgctgccacaggattaagtccattgatcgggtgttcagttgcaaccggacgaagcccaactctctttgaggtttcgtttgtaatgtggtttcctggcagttttcccttcaccggttatcccaaattcgtgaacattaatcagtgcacgcttcgtgttcgattaattgcctctgagcctaacttgcgttcatgcttaatggatgaagggctaactg

SEQ ID NO: 55785 - DNA, 327 bp, Glycine max
  Peptide Sequence Number=SeqID_147470
atgacatccttcagccagatgcaatcccaacttcagtcacaaatgcaatcacaaggacttgcattgcctccggagcctgaggtgaaggttggtgttgaggaggttaaagatgcagaggttcccgttcctatacccactaacgaggttcaactaatggggcaggcactgaacaccttccttgcttggtcgacacatctcgtgaagcgtgtatcagaacaggcagctgtgtctccagcaaagccttcagataaaccaaatcctgaggtcgatgatcccctgtatctgatgacattgatcatcccacaacttttcttgaagcctctctga

SEQ ID NO: 55786 - DNA, 582 bp, Glycine max
  Peptide Sequence Number=SeqID_147471
atggatttcttctcaaatgagagttttgaatgctttcaagcatttgaaaactccattcctattccattcatgtctctgaaattacctgtttattctaatctagtcaaagccttttattctaattttgaaatccatgaaggcaccctaatgtctgaagtttatgggattaagatggtcattgaccaatccctattctatgatttaacccaattgccaagcgaaggtgtaccatttgaaggtgcactaattgacgattggaagtttgatttctctatacatgatgcccgctggttggtttgcaccaaccaagcggatatgaccgaaggatacttgccggttgtcgcaacgtgcccttttgcgggcgagagaaggcgaggctcacgggtgcgctttccaaaggagaaaagatgcgcggagtcgccaccaacgtttatttgtggaaaacgtcggaaaaaccaaaggaaaccggtcaaaataaaaattctaagttcgggagttatatttaagtttgaggaaggtcgacaaaagcggggcttttgctcctacgtaccctccatcaaagaggaaatcagacctacgtag

SEQ ID NO: 55787 - DNA, 412 bp, Glycine max
  Peptide Sequence Number=SeqID_147472
cagagaccaagtttggtcattctgcacccttgtatcatccagaggcggcgggcccgatgatacgcggagataccttatggttatccgcaccctttttgtcatccagaggcggcgggcccgatgatacgcaggagaccaagtttggtcattctgaccttgtatcatccagaggcggcgggcccgatgatacgcggagataccttacggttatccgcacccttttgtcatccagaggcggcgggcccgatgacaagcagagaccaaaggcggcgggcccgatgacaagcagagaccaagtttggtcattctgcacccttgtatcatccagaggcggcgggcccgatgatacgcggagataccttatggttatccgcacccttttgtcatccagaggcggcgggcccgatgacaa

SEQ ID NO: 55788 - DNA, 506 bp, Glycine max
  misc_feature (56)..(56): n is a, c, g, or t
  misc_feature (121)..(121): n is a, c, g, or t
  Peptide Sequence Number=SeqID_147473
ggtcggaacaggagagcgcacgagggagcttccagggggaaacgcctggtatcttnatagtcctgtcgggtttcgccacctctgacttgagcgtcgatttttgtgatgctcgtcagggggncggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtacccctattcttcttgttcatcatgcctggagctgttagggttttggttttgcaagagcgtggtgaagcggtcgaagaagtacttggaagaagcgctttacatgaagctcttcaaagatggaagctcccagctcatcgttcgccagagcctcaacaacttcgtcaagagccgaaagcggggatcctctag

SEQ ID NO: 55789 - DNA, 219 bp, Glycine max
  Peptide Sequence Number=SeqID_147474
atgggagatcacttggaggacatgattcgtgaccttggacaagagtcttttcaggaagcacatgcccctgtgtatgaaggattgcagagtgatggtaccgagctcgaattcgtaatcatggcggtttgcgtattgggcgctcttccgcttcctcgctcactgactcgctgcgctcggtcgttcggctgcggcgagcgggtatcagctcactcaaaggcg

SEQ ID NO: 55790 - DNA, 128 bp, Glycine max
  Peptide Sequence Number=SeqID_147475
ccatgactcacccacctttccatcccccctcaaagatccacccgatcgatgaagacttgaaccgaacagtgatcaaatcgactttggagagtcaatcctcagggcaagccaaaggaaggacgggatag

SEQ ID NO: 55791 - DNA, 251 bp, Glycine max
  Peptide Sequence Number=SeqID_147476
gcccacttgggccctccagaatattcctccagaatgctgttgcttctggaggaagcaacctggctcgcctgggcgagctgggcggcaagcatctcctctattttgctataaataggggaggaagtgagaaggaaaaggccgaggcgcttccgaaacgtttccgtaacgtttttcgtgaagaatttcgcaaaggtttcgaccgttcttcgacgttcttcattcgttcttcatcgttcttcgatcttcaacgg

SEQ ID NO: 55792 - DNA, 212 bp, Glycine max
  Peptide Sequence Number=SeqID_147477
atggctccgagaaagatttccgcaaagagatctaggaaggacatcgtagttgaagggaccagttctgcccccgagttcgacagccatcgtttcaggagcgctgagcaccagcagcgtttcgaggccatcaaaggatggtcattccaccgagagagacgcgtccagctcagggacgatgagtacaccgacttccaggaagagatagctcgccg

SEQ ID NO: 55793 - DNA, 511 bp, Glycine max
  Peptide Sequence Number=SeqID_147478
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggaaccgtaaaaaggccgcgttgctggcgtttttccataggctccgcccccctgacgagcatctcaaaatcgacgctcaagtcagag

SEQ ID NO: 55794 - DNA, 468 bp, Glycine max
  Peptide Sequence Number=SeqID_147479
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccgcaaagacctctttgaagacaacattggttgtagaatttga

SEQ ID NO: 55795 - DNA, 126 bp, Glycine max
  Peptide Sequence Number=SeqID_147480
atgcatcctccaccatcgagtccggagccttcggtgaggggaaaatacgagaaagaagaaggagagacgagagtcacttatttcaaatcgttttgggttggaactattgtgattgagatcaattaa

SEQ ID NO: 55796 - DNA, 696 bp, Glycine max
  Peptide Sequence Number=SeqID_147481
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgccccgttttcaccatgggcaaatatatacgcaaggcgacaaggtgctgatgccgctggcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 55797 - DNA, 135 bp, Glycine max
  Peptide Sequence Number=SeqID_147482
atgaactcgggaaggttccagattagtataccaggtgacggctgccccagaattaatgaagcattgggcttgggcttgaatccagaattgggcttggacttgacgagggcatactattttattatacaaaattag

SEQ ID NO: 55798 - DNA, 366 bp, Glycine max
  Peptide Sequence Number=SeqID_147483
atgatggtggcccgagtgatgttgggtcatggctatgagcccagaatgggtttaggcaaagacaacggttggcaaggtcggcctagctatagacctacacaggctgacgtaaggaaaaacatctcggaacggaagaacaaaggccaaagcccacggtcaggacaacaagccaaagaggttccaccgtgccacatcagtagaagcttcgtgagtgcgggtttaagacgcaaaggacaagtcgtcgcgatatacgatgaggactccccgaggaggtcgaatttggtacagccatgccctcctagcttccaactagggaattggcgggtggaggaacgcccagaggtttacacgacaagcataatgtaa

SEQ ID NO: 55799 - DNA, 339 bp, Glycine max
  Peptide Sequence Number=SeqID_147484
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaatgggtcacgtgtcctcttcgacgggaatggctggttacaaaggggtaccgagctcgaattcgtaa

SEQ ID NO: 55800 - DNA, 365 bp, Glycine max
  Peptide Sequence Number=SeqID_147485
tgagggagatggagtgtttgggttaggtctagtcgattgtgatgttggatcgattgtttgggttcgaagaaggaacggttcatggtggcctagtcaaatacttggccttgatcacctttctacttctaatcttacttctcctcgttcaggaactcccgttaagcttctcagaaaggaagatcccaacatggcggagtccacccagggggagtgtgcttattgcaactttttggctgatgaagagagtgaatatgcttttatggatgttgttgaatatgattctcttgaaattggttctactaatgttgattcggattcctctgaaatggaacttgacatgggtgatgagatgactacactttcaa

SEQ ID NO: 55801 - DNA, 336 bp, Glycine max
  misc_feature (235)..(235): n is a, c, g, or t
  Peptide Sequence Number=SeqID_147486
atgaggaaacaagaagttattttacatggaatttggaaatggaacgtgtattggcttatgtacttagagattaaaggaatttgggcaacaagggtgacggaggttggaaaaggtcagcatttgaatgttgcagccacagtgttatctacaagcttcaatgttaatgtcacatcagataatgtcaaaaatcgtatcaaattatggagatcgtgtcacataaatcggctaaaccatnttcgattcaaggtgcttcaaaatttggatgatatagtggattgtgtgctaaagatagagccaccggtcatggagctgaaactgctatggatgcttgattga

SEQ ID NO: 55802 - DNA, 447 bp, Glycine max
  Peptide Sequence Number=SeqID_147487
ttaggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgaggcgcaacgcaattaat

SEQ ID NO: 55803 - DNA, 231 bp, Glycine max
  Peptide Sequence Number=SeqID_147488
atgggtgaagtagaggagatacaagagaagatgaaggccgacatggaggccatgaaagagcgaatggccacgatgatggccatgatgagcatgaggaagataatggaagccaatgcagttacaattgccgctaccagcactgttgctaaggtgaaacccgatgcccccatctggcctcaaccaaatgaatcatccaaccttagatatggtaggcaaagatttgggaagtag

SEQ ID NO: 55804 - DNA, 237 bp, Glycine max
  Peptide Sequence Number=SeqID_147489
atgagggttcaaatagcaaccaggcccacttgggccttccaggatgttcctccagaaggaggaagcaacctagctcgcctgggcgagctgggtggcaagcatctccttccttttcctataaataggggaaggagggaagaacaaaaatgttcaaccctcctggtatctgagattcacttaaaattagggagaaaaattgtttccgtgaagaaaatccaagccgagacgctttcgtaa

SEQ ID NO: 55805 - DNA, 150 bp, Glycine max
  Peptide Sequence Number=SeqID_147490
gagctggtgacaatggtggttgtcgcaacctacccttcggcgggagggcgacgcggggctcacgggtgcgtgtcccaagaaaggaatacgcgcggagttgccaccaaagtttatttgaggaaaatgtcagaaaaaccggaaaagacgtga

SEQ ID NO: 55806 - DNA, 95 bp, Glycine max
  Peptide Sequence Number=SeqID_147491
atggctccaaactctttgggtggaggacgcatgaacgaaaacgcaattcatgagggctccgaaaaaagggcgaggatggaggattgcactagagg

SEQ ID NO: 55807 - DNA, 165 bp, Glycine max
  Peptide Sequence Number=SeqID_147492
atggataagagcttgaaggtaggagaagatgagtggagggagaaggagagaaggagcaagaaatgttgtgtctcaaatgagctatggttcatcccactaatccaaaatcaggctgaagattctccactaagtgtgcttaagtgtcatgaggcatgtaaagcatga

SEQ ID NO: 55808 - DNA, 704 bp, Glycine max
  Peptide Sequence Number=SeqID_147493
ttggcccagggcttcccggtatcaacagggacaccaggatttattttctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatgccaccaacaaataacattgagaaatacccagctactttcatgttctccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55809 - DNA, 174 bp, Glycine max
  Peptide Sequence Number=SeqID_147494
atgcctcaaaatgttctttacgatgccaattgggatatatcaacggtgctgtccctccctgttcagcctactgacgggggtggtggggtaacggcaaaaagccccccccggacatcagcgctggcaagtgtagcggtcccgctgcgcgtaaccaccacaccccgccgcgcttaa

SEQ ID NO: 55810 - DNA, 306 bp, Glycine max
  Peptide Sequence Number=SeqID_147495
atgtaccctccactagaactgatccacaagagatgtaccctctcttgttctcagtcaaacccaagtagatgtaccacaaaggatgtaccctccaatgtgttaagacaaagatttcagggaaagggaagaatcaaaagaattctcagactgtgtcgttttgaattctttgacaagggagaagggagacacaaaagaattcaagcggttagtccttcgttcttttggaaaagggagaagagagacacaaaaagaattcaggcggttagtccttggcgaattctttttggcaaagggagaagagaatga

SEQ ID NO: 55811 - DNA, 489 bp, Glycine max
  Peptide Sequence Number=SeqID_147496
atgtccaagcaactagagacactaacagaaacactaagatgtacaatttgtggtggagctcatgaatctggatgttgtatccctaatgaaaagaaaattgcacatgaagtcaattatatagggaatcagcctagaggcaatttcaatacaagtggatttccaagatttctgaacaaccagcaatatcaacagcagagacagtggcaaaatcaccctggtaaccaattcaacagagaccagggtggttcatctacaaggccacaacagcagatgccaagtctctatgaccgaaccataaagctggaagagactctagctcaattcatgcaagtgtcaatgtctaaccaaaagagcactgagtctacaattaagaatctggaagtccaagtgggccagcttgcaaagcaattagctgaaagatcatcaaatagctttataggaaacatagagaaaaatcctgaaagaagagtgcaaagttgtgatgactag

SEQ ID NO: 55812 - DNA, 486 bp, Glycine max
  Peptide Sequence Number=SeqID_147497
gaattgcagcagctgacctagcaaatcagagaccagctagaggagttcatcacagaaaaagtgacgaggcagctcatggcatcgttcagccagatgcagtcccagattcagtcccatatgtaatctcagggacttgcactgcctccagagcctctgcagatcctgcctgcctggttgccctggggagagtttatgagggattcactgttgttcataacactcctttgttgcttggccaagtaaaggtgagtgtggaggaggttacagatgcagatggctccttcctgtacccagatgagaccgttcttgggagagccatagagctcctagctgagaagccttaccaagaagaactcgaggaagcgacacagggatccttcgtcccccatggacgccaggatgttctgaccgctgctattggacgtccagagcaccctggacgtgtccatgttgctggagccagtgtcaccatcaggcactactttg

SEQ ID NO: 55813 - DNA, 213 bp, Glycine max
  Peptide Sequence Number=SeqID_147498
atggatttcaaggattacctaatgaagatccctacgcacacttggcaacatatattgagatttgcaacactgttaagattatcggtgtaccagatgaagctatcagactcagccttttctcattttcgctggcaggagaggccaagaggtggctccactcattcaaaggatgcagtcttaaaacctgggaagaagttgtggaaaagtacctaa

SEQ ID NO: 55814 - DNA, 468 bp, Glycine max
  Peptide Sequence Number=SeqID_147499
atgaaggaaagaagtagaagaagaaaacaagaaccgagaatgagcgtggaggaggaagttgccgagcagtctactcaactagtggcattgggaaaagtgtatgacactttggccaccatacacaatgtcccttatgcagatgatgtggttagggctattggcactttcgtggggtggccaacacatcttgtgaaacccatatttgatgaggattcacaaaagcgtctgcgcataccggttaaatctgctgagatggacaatgtagtggctacaattgatctattgggagagttggtaaagaacttgtttgaaatttaccaaaagctaattgagttggcatgggatggggcaaaatttgggatagctaatgtcaaagatggctttttcatcacacacgcatatgttagtgagattattttaggtgacaagtgtttgaacatatccatactacaactttggctgatgtaa

SEQ ID NO: 55815 - DNA, 250 bp, Glycine max
  Peptide Sequence Number=SeqID_147500
agggctacacgccctcgccatcagaggactgcgtgtcctcaccttcagagggctacgcgccctcgccatcagaggactgcatgtcctcaccttcagagggttacacgccctcgccatcagaggactgcatgtcctcaccttcgtagggctacacgccctcacatttagaggacctacacgtcagagggctgcatgccttcaaagggctacacgtcctcgccaacagagggctacatgccctcacctttag

SEQ ID NO: 55816 - DNA, 534 bp, Glycine max
  Peptide Sequence Number=SeqID_147501
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggatgaagaaaaggccatgtggggtatatgcatccctctccgagagtggagagtattattcccaccgaccgccaactcccctactagacaccgtcaactatcctattcatatgaagaatctctctgccaaggagctgaaacaactcgcggatgaactgcgttctgatgttattttcagtgtttctagaactgggggccatttgggctcaagccttggtgtggtggaactcactgttgcacttcactatgtcttcaatgcccctcaggacaagatactgtgggacgttggtcaccagtcttacccgcataagatactcaccggtagaagggaccagatgcataccatgaggcagacaaatggctgggtaccgagctcgaattcgtaa

SEQ ID NO: 55817 - DNA, 532 bp, Glycine max
  Peptide Sequence Number=SeqID_147502
gaaaaatccttttcaagaaggaaagagtgatgaggacacaactaaggacaaggatcatgaagcacttgaagggcccatgaccagaggcagacttaaacaggcccaacacagtgatgaggacataactaagttgaaccaatctcaaacttatcaaggtaatccttatggcgtctaccctgacttatcttccttcactggaagttgcgtcatccaaatctctgtagcctgtatcaagcgatccgctcctagtcaggatcacatcagaggggtgttaggtgtcgcggttgccagtgctgatgaagactttgatgtcggtattgaggttcttgtccttgaaacatgtgatgtattcaggggtaaccttggtgaggttccacgtgagtcgaaagaagctgttggtggggacggtgtcgttgtcatagtcagtgcgaaggaatggagaagaaggaaaggtgattggagacacaacttcaaggagaagatgagtcaagaacaagctcacaaccataggagaccatggataagagcttga

SEQ ID NO: 55818 - DNA, 591 bp, Glycine max
  Peptide Sequence Number=SeqID_147503
atgggtgaagcagaggaggtgcaagagcagatgaaggccgacaaggaggccatgaaaaagaaaatggccacaatgatggaggccatgatgagcatgaagaagataatggaagccaatgcgattgcagttaccgctaccaacgctgttgctaagaagtacgaagggccccatgatgtgaaaattcaaaatgagcacgccttcccgccatatggcttgcctcccaactatacaccacccaatgtggcatacactcccaatgaggatgtcaataactccgctaccatactcattgagagcctacaacctcatcatgtacatgtccctcaacccatgggggagacacatgaaattccccaccacaatctagcggactttgagccttgccttggatatgccactgaagggcaagaagttggtggtatacccctgcaaaacactctggagggccctcagtatctcccacaaccacacccctcacattccacagcggttaaaaacccttatgctatggcagaaatgagaaagttggatcatctagaggaaaggctcagggccattgaaggagcaaagattatgcctttgttaacctag

SEQ ID NO: 55819 - DNA, 673 bp, Glycine max
  Peptide Sequence Number=SeqID_147504
atgttgagaagaaagcatgacattggggattggaataatattctgaatagtgacatttgggaactttctgaaagtgagtgtaaagttattccagcactgagacggagttatcattatctccctccacatttaaaacggtgctttgtttattgttcgttgtatccacaagattacgagtttgaaaaaaatgaattaatcttgttgtggatggccgaagatcttttgaagaaaccaagaaatggtaggactttagaagaggttggtcatgagtattttgatgatttggtttcgagatcatttttccaacgttcaagtacaaatagaagtagttggtctgatcggaaatggtttgtgatgcatgacctcatgcatgatctagcaacgtcactcggtggagatttttattttagatcagaagaacttgggaaagaaacaaagatcaatactaagactcgtcatttgtcatttgccaaattcaattcttcattcttggacaaccctgatgttgttggtagagtaaaatttctgagaactttcttgtccattatcaattttgaagctgctccattcaacaatgaggaggcaccatgtatcataatgtcaaagcttatgtacttgagagttttatcatttcgtgacttcaaaagtctggattctttgcctgattcaatag

SEQ ID NO: 55820 - DNA, 48 bp, Glycine max
  Peptide Sequence Number=SeqID_147505
atggaagggcctactccaatttccgcccttatacatgctgctactatg

SEQ ID NO: 55821 - DNA, 309 bp, Glycine max
  Peptide Sequence Number=SeqID_147506
atggcttccatgatggatgccatgctaggaatgaggcaactaatggagaataatgtggccaccgctgccactgttagttcggctgccgaagcaaacccaactctcctagctactacgcaccatcctatcccaaacgtggtcatgtcccttcccccatccttgaaggggagcctcctcgacagtcggacgaggttcacgaggatcgtagagagcatgcacaaggagacgtcgattcctactccccggtccccgtcgaggggtcgacacccaacacactacctcagcccaatctcatgggagaacctttga

SEQ ID NO: 55822 - DNA, 150 bp, Glycine max
  Peptide Sequence Number=SeqID_147507
atggtaaacaatactagtgagttcaacatacataggaaggttgaaaggaataggaaaggaggattggtgccatcccttgaagaatttgagtcaagaagcaagaggccaaccaccttaagagctattggactaagaagcacttcaaattga

SEQ ID NO: 55823 - DNA, 699 bp, Glycine max
  Peptide Sequence Number=SeqID_147508
atggctgaaatcatcagcgaagagagttttgaagcaccggaagaggacgaagaagtccaagctctcaaaagcgagttaggaaaggcgaaacttgccaaggagaagttcaagttggccgctacacacatccggaaggagtgtgccggattacaggaagagaatgcaactaccgcaagagcccttgaacaagaggccaagaaggctcgcaaggaagagtatggccgtaacaaatttcgcggggctctatggggtagcaacaatgaactcaagctgcgaagggaagagaaggaccagtcgcgagcacatagcatggtcttgaaagaggagttagttgcctgttcaaggtccaaaaggagcttgtctcagcgtttatgcgagacggagatcaacatgctagctatcatcgccaagtaccaagaagagttaggtctagccacggcccacgagcatagggtcgcggacgagtatgcccaagtatacgcggaaaaagaggctagaggaagggtgatcgactctttacaccaagaggcaaccatgtggatggaccgatttgctcttaccttgaacgggagtcaagaacttccccgattgttagccaaggccaaggcaatggcggacacttcactccgtccccgaagaaattcatggacttctcggctattgtcagcatatgatagacttaatggcccatataattag

SEQ ID NO: 55824 - DNA, 1080 bp, Glycine max
  Peptide Sequence Number=SeqID_147509
atgtccgctcctgagccatcgctcggtactgaaaaaaggagaatagattgggaccagcttttggccgggataggaggtagaacaatcaattggttcccccgatggaaggaaggaaaggaaggagtccttttctcatgtggaggatacccgaacattctgctggtaggaatgaggggttgtattaactacaatcccgcgctcgctataagacaactagggtaccccatgaggggagcaccgacggaagaaagcatgtctcctttccttgtgagggatttcggcgcacaaaatttcaaggctatacaaagaatccataaggcatgggaaaccccgttaaggaaagatcaagaacttaggggcattcgtaatggcatcattggtgggtaccatggatggctgaaagttcatatacgagaggacgaagaagtccaagctctcaaaagcgagtcaggaaaggcgaaactcgccaaggagaagttcaagttggctgctacacacgttcggaaggagtgtgccgggttacgggaagagaatacaattaccgcaagagcccttgaacaagagaccaagagggctcgcaaggaagagtatggccggaacaaatttcgcggagctctatggggtagcaatagtgaactcaagttgcgaagggaagaaagggaccagtcgcgagcacatagcatggttctgaaagaggagttgattgcttgttcaaggtccaaaagaagcttgtctcagcgtttatgcgagacagagaccaacatgttagttatcatcgccaagtacgaagaagagttaggtctagccacggcccacgagcatagaatcgcggatgagtacgctcaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctgttgtcagcatatgatagacttaatggcccacataattagaaatcgttag

SEQ ID NO: 55825 - DNA, 483 bp, Glycine max
  misc_feature (30)..(30): n is a, c, g, or t
  Peptide Sequence Number=SeqID_147510
ccaacccagcttaacatattcatagatggnttgaggccacaatctaagcaactgttagatgcttctgtagggggaaaaataaaactggaaacccctgaagaagcaacagagttgattgaaaacaggtctgccagtgatcatgccattctatgtgatagagttcatcaacccactaagaagagtttattggagctatcaacattagacgctgtgttggcacaaaataagttgctctctaggcaacttgagatcttgacagaaaccctgagtaagttgccaactaacttgtctaatggtcaacctttacagccttctgttttgcaggtcacaggttgtaccatacgtggtggtactcatgaatccgatctttgcattccttttgaagagaaaatgcaagaggttagctacatggggaatcaacaaaggcagggaggtggattcttaggtttccaccagggtccttacaaccaacaaggacaatag

SEQ ID NO: 55826 - DNA, 252 bp, Glycine max
  Peptide Sequence Number=SeqID_147511
atggaagctaaaaatgaatcactatttttggacgatggagacctcagctggcctacagcagcatgggtggtcgctaaaatccgtcgctatatgatttctactactactctgttttgccgcatgcaaaagtggtcgctaagtccgtcgcaaaacactattcacaacaaaacaccaaaaactgaaacaggggaagcgcttaataggaaaactgaaacaggggaagcgcttaataggaaacagaacacacactaa

SEQ ID NO: 55827 - DNA, 156 bp, Glycine max
  Peptide Sequence Number=SeqID_147512
atggaccctaagagaataaaggtcattcttgagtggcctactccaccaagtgttgaagaaagaatacatgagtttcaagaacctctggatttgaggtcaaatccttttcaaaggggagggaatgatgcaatcctaccccccaagggcattggatag

SEQ ID NO: 55828 - DNA, 210 bp, Glycine max
  Peptide Sequence Number=SeqID_147513
atgggattaaaatcaagaacccacatgagcaatcaatttaattttaagatatgcacaaattcaaaaacaaagggggagaatttatatgatgacaaaggtgatgacaaaaagctcaaagatcaatcaaagaacaactcaagtgaatcaagaacaattcaagagttcaagataagaatcaagaagaattcaagactcaagaagaaagtctag

SEQ ID NO: 55829 - DNA, 423 bp, Glycine max
  Peptide Sequence Number=SeqID_147514
atgaccggacgtcttcttgccgggtcattggcttttgaaagccgcatccttcactatttaattgtgcgtattttgcttccacggtcttccaaccttgcccagagatcttttttaattggtgctgctgtgattgcttcttttggttaccgcaaagagcgtgatggctcttgggtcaaaaagggcgctcaacccgttgatgaagaaggcaacctaccagttgaagataattccactcttcttcgaaggcttatggacaagtttgatggacttcagacttttgttggtgacaagtttgatgccatggaattgcaagtcgacatggggttcgatgccatggaatcaaggatcaccaaagttgaagaagatgtctccttcatccgtacttgctttgatccaccaccaccgcctccatcatcgtcttag

SEQ ID NO: 55830 - DNA, 223 bp, Glycine max
  Peptide Sequence Number=SeqID_147515
atggatcaggtttggggatggctttcatgtctgcaaggtaagaatctcttggagcatgaggaggctgggcatcttttcttccactgcaaaatgactaaggggctgtggtgggaatccatgagatggatccggggtataggagctcttccagctgatccggctagccattttattcaattctgtcattactactgtggcgtccttggagaattgcttacatcag

SEQ ID NO: 55831 - DNA, 561 bp, Glycine max
  Peptide Sequence Number=SeqID_147516
atgggggaatacgcaaaagatgaggaattgctgatacattccttccaagaaagtcttactaggacaactgtcgcctggatgcaactacagaacatttgcaaaaagggggacggatctttcaaagaacacgcccaaaaggtggagggatctggcggcccaggtgctacccccaatgatggaaagggagacgatgatcgtgatggtagacacattattcgatactctactatgaaaagatggtgggctacgcaccctcaaagctttgcggatttggtcttcgccagtgaaaggatcgatgtgggtccgaaaagaggcaaatttgatcatcctactaggacgactgagaaaactggggcaaatgaagagggtgagaaagagggagaaacccatgctgtgactgccattcctatacggccaagtttcccaccaacccaacaatgtcattactcagtcaataacaaacctcctccttacccaccacccagttatccacaaaggccatccctaaatctaaccacaaagtctgtctaccgcacttccaatgacgaacaccacctttag

SEQ ID NO: 55832 - DNA, 429 bp, Glycine max
  Peptide Sequence Number=SeqID_147517
gttgtaggatgtaccatctgtggaagagctcatgaatctggatgttgtattcctattgaagaacaccccactcatgaagtcaattacatgggaaatcagcccaagaacaatttcaatgtaggaagattttctggattccaacatggccaacaatataatcaacaacagggacaatggaggaaccaccctagaaatcagttcaacagagatcaaggtggaccatccataaggccacaacaacaagggcctagtctttatgatcgcacaacaaagttggaagagactctaactcagtttatgcaggaacataaacaactgctggaacctaagccaacacttgaacctgtttctgattttgtagaacttgaagagattaatgaggagactgaagatgacaaggaagaaaagagaaagaaaaagaaagaataa

SEQ ID NO: 55833 - DNA, 444 bp, Glycine max
  Peptide Sequence Number=SeqID_147518
atgcatactatagaattccaaaagcgaggacttcctcgtgtccatttattgttatttctacacccaggcaataaatatccatcttcaactgacattgaccagataatatcagtagaaataccttcccatgaagatgacccaaaactatacagattggtgcaaaaccatatgatacatggcccatgtggaattttacaacctaactctccatgctatgacagagtgactgttgttatggtttctaatagcaatgacacaactcaaaatgttaacattcaaaatgacgaacttaaagaatatctagattgcagatacatttctccctgtgaagctgcttggagaatatttgcttttccaatccatgacaaaaagcctgctattgagagattgtgtcatgagcaaacctggagaagtttggaaccaatgttggcattggctggctga

SEQ ID NO: 55834 - DNA, 144 bp, Glycine max
  Peptide Sequence Number=SeqID_147519
atgttatcacgtcagcttggtggctccaagaaaagacctccctccaagacacctactgctgctcatctgctctcacgaacgaaagttcgagatcatcacaggcaccaaccacatggtacaaaaattgcaagggaaatagcctaa

SEQ ID NO: 55835 - DNA, 391 bp, Glycine max
  misc_feature (361)..(361): n is a, c, g, or t
  Peptide Sequence Number=SeqID_147520
atgattatgaggggccaagacatttatagtagccaagatgaggctacttcttcaccttcctctagtgaaagtgaagaagcaaaaagggaagaatctagtgaagaaatttacccccaagaagaagaacaacctttaatggttaaggagtgtaaggagttaagtgtctcctccaagaggttacctaagaaggaaaggtattttgaaataaagacaaatatcaaagttatttcccctcttagacaacctccacattttctcctctgtgaaaagacacttgttagcattgccacatctcttaggcttgagtttattcctcaagtacaggagttgttggatgagggtttggttcgcaagagcttanatccttgtgctttgttggtacctaaaatag

SEQ ID NO: 55836 - DNA, 1059 bp, Glycine max
  Peptide Sequence Number=SeqID_147521
atgtcttcaaggaaaagaaagagtgtcagttcaaggcccactgctcaatacgatacacgaagattccattcctttgaggcctggaccagatatactgacaatgtgttgggaagacacatattagctgagaggaaagtggaaatctatcacacagagctggatgaattcaagggcgagctagagaggcgtaactttcacaagcgcctcaccaacttagctgatagtagcattgacctcgcgttggtgaaggagttcaacgccaacctttacagtcccgagggaccttcacctgaacaagtcagaatccagggccacataataaggattgatgcaggtaggctcaatgcctttctagaaacacctgtggtgcttgctaagggtgaatctttgctcgcctactcaagatattgcaggatgcctactgacattagagaaattgaggctgcactgtgcatacccggccaagggtttattctaaatgctgaaggtcactcggggaatatcctcagaaaagatctaaccacccttgctcaggtctggagtgttctatcctactccaacctggctctgacctcccacacatcagatctgattatggatcgagctaggttaatctttggcctagttactcagctggacatgaatgtcggagccctcatttttgggcagattacttctatggcccagtctaactcctcaagactcagatttcctactcttatcgcaactttatccaggaccaaaggagtttcctctaacagtcttgtctttgaacgtctgagcccggtcattaatttggcctacataaggaagaattgttggaaccctaataagccaacaattattattaggggggccagaagaccaagggcaaggccagctaaggctccttatacatcagcagttcctcatctagcttctacatcagcagctccttcttcaacttgtattgcagcagctccttctaccccacctcctgcagatttcaacgtttcgaagccatgcttcgaagcatacatcaggggaagattattttgctgcaaagtcttcagttggtag

SEQ ID NO: 55837 - DNA, 207 bp, Glycine max
  Peptide Sequence Number=SeqID_147522
atgggtgttaagtacctcaaagtggtcaagcgagggtcgcatcccaacaaacagatggcgccgaatgaccctaatttgtctctgcgtgccatcggacacgattgtccccgaatggcgaaagacacgattgtctccgaatggcaaaaaggtgtgcggaatgaccataatttgtctccgcatgtcatcgggctcgctgcttctggataa

SEQ ID NO: 55838 - DNA, 612 bp, Glycine max
  Peptide Sequence Number=SeqID_147523
atggagcttacatcacctgtggtattggcagagggtgagactttgcccacatactccagatactgcaggctgcccacagattatagagagattgaggttgccttatgcataccaggccgagggttcatcttgaacgctgggggccatcctgagaggattctcaagaaagatttgactactttagcccaggtgtggagtgttctgtcatactccaacctggcccctacatcacatacctctaatctgatagtggacagagctaggctgatctttggtctagtctctcgcatggacatgaatgtaggagctcttatttcttgccagataacttctatagcccagtctaacttttctagacttgggtttcctgctctaatcaccgccctatgtagagccagaggggttgtctctgacagccttacttttgagcacctgagcccagtcattaacttggcctacatcaggaggaactattggaatcctaatgatctgacagtttctatccgagagcagctccttcagtcccagctcagacaaattctcaacgctttgaagccatgcttcagagcattcattagggacagatcattttattgcagagtttacaagtag

SEQ ID NO: 55839 - DNA, 444 bp, Glycine max
  Peptide Sequence Number=SeqID_147524
atgcgagcagggaattttgatatctatggattcctcgagccacagtccattcagaggtctgggcaatcgcagtttgagtctgaaagttacataaagacttggatgcagagttcaaaacgcgatgtctatcttggagcctacctaaatgggccagacaactaccttaaggggattattaatagtgctttaaaaggtcttgatgatgctccacagcctaaatcaaagactcctgctaggtggattgtcgtcaagtgtaatagacaaaaagaaagtactgagtgcggctactatgtgatgcactggatgtccaccatcattttaggaacttttaggaataattgggaagcgtattttaacgatcctagaccattggagccagagagattaaaggcattgcggatccagtgggcacagttttatctccgagttagagatcaggcctag

SEQ ID NO: 55840 - DNA, 257 bp, Glycine max
  Peptide Sequence Number=SeqID_147525
ccagcccgtatcaattagacttcacactttatgcttcggggtcatacaatgctcaatggaatgccccagggctcctccacgataagcatacgttgcgttcgagtcgtatcctcagaaaagtggaggttgatgaaccttggctagggttatggctaccattgaattatcaagtagatatgggagcaaatcagcataggacactggaattggggtggtgttttgtcattggaagtgcggtagacaggcttggtggttga

SEQ ID NO: 55841 - DNA, 642 bp, Glycine max
  Peptide Sequence Number=SeqID_147526
atgtccggctttccggataatgctgtcgatttcattctcaccgacccgccatatctcgtcggttttcgtgaccgtcaggggcgtaccatcgccggcgataaaaccgatgaatggctgcaacccgcttgccatgagatgtatcgcgtgctgaaaaaagacacgctgatggtgagcttctacggctggaaccgcgtcgatcgctttatggctgcctggaaaaatgcgggattcagcgttgtcggccacctggtgtttaccaaaacctacacatcgaaggccgcatacgtgggctatcgccacgaatgcgcctacatccttgcaaaaggccgtccacgtctgccacaaaacccgctgccggacgtgctgggctggaaatacagcggcaaccggcaccaccctaccgaaaaacccgtaaccagcctgcaaccgctgattgagtccttcacacatcccggcgcgattgtgctcgacccctttgccggcagtggctccacctgcgtggccgccctccaggctggccgtcgttacatcggtattgaactgctggagcagtatcaccgggccggacagcaacgtctggccgccgtccggcgcgccatgcagtacccggccgctaacgacgagttcccggaggccgcgtaa

SEQ ID NO: 55842 - DNA, 50 bp, Glycine max
  Peptide Sequence Number=SeqID_147527
gaatcttcttaaggaagcttctcaaggaggtgagcttagttatgagaagg

SEQ ID NO: 55843 - DNA, 324 bp, Glycine max
  Peptide Sequence Number=SeqID_147528
atgggttctccacctgcctctactcctcctcctcctcctcctcctccttctcctcctcctcctccttcggacgcatcggcttcgccgtctgccgtgaagcggacacgcaaagcctcacgtctacgatcgttgtccactagaccacctggtgctgagagacaagtggtgcatgttgatcctgctaccgggaaggccgacggtccccacatgaagaaattaagaacatatttggggattgtggcgcgtgataaggtggacatcacctacgagaactggaagaaggtccctactgctcagaaggacctgatttgggaggatattcag

SEQ ID NO: 55844 - DNA, 528 bp, Glycine max
  Peptide Sequence Number=SeqID_147529
cgtcagaggactacacgtcctcgccttgagaggactacacgtcctcaccatcagagggctgcacgcccttacctccagaggactacatgtcctcgccttgagagggctacacgccctcaccttggaggactacacgtcctcgccttcaaagggtcatgtaccttcaacttcagaggactacacgtcctcgccgtcaaagggtcatgtgccttcacctttgtagggctacacgccctcaccttcagaggactacacgtcctcaccatcagagggctgcacgccctcaccattagaggactacatgtcctcgccttcagagggctgcacgccctcaccttgggtactagttaccctcaccgtcagaggactacacgtcctcgccttgagaggactacacgtcctcaccatcagagggctgcacgcccttacctccagaggactacatgtcctcgccttgagagggctacacgccctcaccttgggtactacttaccctcaccgtcagaggactacacgtcctcgccttga

SEQ ID NO: 55845 - DNA, 249 bp, Glycine max
  Peptide Sequence Number=SeqID_147530
atgggaagagatctcaagaaggttccccaacacttaaatgctataagtgtaatcgacccggtcacatacataaaggcacactgccccacaaatgaatcatggccagagaagaaaagtcatgaagaaagaagatccaagaaggcatatattgcttgggatgacaatgactcatccgatggttcggagaaggagatcaaccttctatccaaggactatgagattgatgagaacatctctcaagaagattaa

SEQ ID NO: 55846 - DNA, 612 bp, Glycine max
  Peptide Sequence Number=SeqID_147531
atgacattgaccatcctaaagcttttcttgaggccttaccaggttacatgggatgccactgtgttcggggtctttaatccagacttcccgctctacataaagcacgaagacttctccgaaatcgcacacggtggtcaatgtcttagcatatcagtgttagagctgtggattctgcatctgactgaaacaagtatgcgagcggggaattccaatatctatggattcctcgagccacagtccattcagaggttttggcaattgcagtttgagactgaaagttacataaagagttggatgcatagttcaaaatgcgatgtctaccttggagcctacctgaatggcagacactggcagatggtggtcatcatgcccaaggaacacctaattgtctggttttgttcattgcataacaggccagacaactaccttaaggggatacttaacagtgctttaaaaggtcttgatgatgctccacagcctaaatcaaaggctcatgctaggtggattgtcgtcaagtgtaatagacaaaaaggaagtactgagtgtggctattatatcatgcactggatgtccaccatcattttaggaagtttcaggaataattgggaagcg

SEQ ID NO: 55847 - DNA, 333 bp, Glycine max
  Peptide Sequence Number=SeqID_147532
tttgggaagaggttttgattgatcaaaaagaagaatctacttcaaccgatatgcccttaggcacggcaatacataacatagaaatcacactcggaaagggtggacaattagctagagcagcaggtccgtttgatatccaaaaactgctcggcacagtcggacaagtgggaaatgttggagtaaaccagaaaaatttaggtagagccggatctaaatgttggctaggtaagcgtcctgtagtaagaggagtagttatgaaccccgtagaccatccgcatgggggtggtgaagggagggccccaattggtagaaaaaaacccgcaactccttggg

SEQ ID NO: 55848 - DNA, 177 bp, Glycine max
  Peptide Sequence Number=SeqID_147533
gaagaaagacatggaaaacatgagaaagccttaagtatcattccttccttgatcaccaacacttctcttgctacaatatggaaggtgtatccggcatacatgagtttcatggcgtctctagctaagaggcgaaaatgcaaggaagatgtgttctacgtgaccttcatgccaccttga

SEQ ID NO: 55849 - DNA, 363 bp, Glycine max
  Peptide Sequence Number=SeqID_147534
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgggatactaccgatgcagcagttcaaaggggtgtcccgcaaggaagcaagttgagcgaagccgtgtggaccccacaaagctcatagtcacctacgcttatgaacacaaccactcccttccttttccaaaatcaaattcttccgccgcttccgccgccgtaagcgacggcggggtaccgagctcgaattcgtaa

SEQ ID NO: 55850 - DNA, 522 bp, Glycine max
  Peptide Sequence Number=SeqID_147535
agaccaagtttggtcatctgcacccattgtatcatccagaggcggcgggcccgatgatacgcggagataccttacggttatccgcacccgtttgtcatccagaggcggcgggcccgatgacaagcagagaccaagtttggtcattcggcacccttgtatcatccagaggcggcgggcccgatgatacgcggagataccttacggttattcgcacccttttgtcatccagaggcggcgggcccgatgacaagcagagaccaaaggcggcgggcccgatgacaagcagagaccaagtttggtcattctgcacccttgtatcatccagaggcggcgggcccgatgatacgcggagataccttacggttattccgcacccgttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaa

SEQ ID NO: 55851 - DNA, 65 bp, Glycine max
  Peptide Sequence Number=SeqID_147536
actttgtaaaggaatttacaaagatagtggaaatctcaagtgggttgcttgagtactggacctag

SEQ ID NO: 55852 - DNA, 285 bp, Glycine max
  Peptide Sequence Number=SeqID_147537
atgggagaactaaagtacttcctgggattacaaatcaagcaaactcaagaagaacaagcagcctgtaatcgattacaactgcctgtaatcgattaccagaaggctcttactcctgtaatcgattaccaagccttgtatgtgcaattacaactagtcctcgtctataaagaactcacgaaatcagaattggtctgcgcagccacggcctcacctcacgcctcctccatacctagaacttcaaatcttcgtatctcactcaattcttcaccaaatcacgtcccgtaa

SEQ ID NO: 55853 - DNA, 233 bp, Glycine max
  Peptide Sequence Number=SeqID_147538
caccactcattgagttggtgagaaaccatgttccttcatgggaagatgcccaggaaatgggttttcagaccttaccttactccaacataccaaacaccactaatacatatgtttttgttctttttacacgtgttgaggaaaaaagcctagagtttcaaaaacctcgggatttaaggtcaaatacttttcaaggggtagggaatgatgcaatcctacccccacaagggcattga

SEQ ID NO: 55854 - DNA, 582 bp, Glycine max
  Peptide Sequence Number=SeqID_147539
atgtcatctattgtttacagggatcacgcccacgagacacctagtggacccggagaattccaacagggccctggggtttccagctgtggttacgggcctctgtccatcctacagggggtagcgcccccaagacacccagtggactcggaggagcccaacagggccctggggtttccagctctggttacgggcctctgtcagtcctacagggcgcccatccccccagcaagttcatgccatcgtgacatagggatcacgcccgcaagacactcagtggacccggagaaatccaacagggtcctggggtttccagctctaattatgggcctctgccagttctacggagtgccagtcacccccagcaaggtcatcaagccctctactaaccgagctttcatcaagaagtattgcgcccccaggcaagcgcagggcgagacaccacaacagcctggggttggccggcagcaggcaacagacacaccgccgccacctccaaagccccttagctcatctacaaaaactggagcgttgcctacgacctgtggtcgaccagcaggtgaccaagtccaaagccaaagataa

SEQ ID NO: 55855 - DNA, 258 bp, Glycine max
  Peptide Sequence Number=SeqID_147540
attatggaaatctatccactattgctttaagtctgaaggaccctgttagtgtgaaggagaggagggaacgttttctgcaggcgaaaatacataatatttgtgcgagagccaaagggcaggaagatgaagacaatctctggacattgtgttttgtgggaaattctgttgaaagtgttgatattaagaaggagctcagccttgggcatgtgaaatttgatcagttcaaaaggcaacaaagtggcagtgggaatgctgatg

SEQ ID NO: 55856 - DNA, 153 bp, Glycine max
  Peptide Sequence Number=SeqID_147541
atggaacagaagaaagaattacctaagggagagttctcaggctttagatgtgtattagagtgctttgagactaagttaattaggcaaattggcaaaagtgtcgttttcaccttctcgctaagccaatatgctggcttagcgagcaatcgctaa

SEQ ID NO: 55857 - DNA, 417 bp, Glycine max
  Peptide Sequence Number=SeqID_147542
atggacccgaagaagtcccatagggccctggggtttccaactctggttacgggcctctgtcagtcctacagggtgcccgttcccccagcgaggtcatgccatcgtgacataggaatcgcacccacaaagacacccagtggacccagagaagtccaacagggctttgggggatcgtgcccgacaagacacccggtggacccgaagaagtccaacagggtcttggagttgtcaagctctaattacgggtctatcaagggcatcaggccccttactaatcgagctttcatcaagaagtactgcgtctccaggcaggtgcagggcgacacaccacaacagcctggggatggccgacagcgggcaacagacgcaccgccatcacctctagagttcatctcagctcatccacaaaaaggttag

SEQ ID NO: 55858 - DNA, 129 bp, Glycine max
  Peptide Sequence Number=SeqID_147543
atggaggagatacatggagaagacgatgaagaacaaagaaggaggaaaggtgattggagacatcacttcaaggagaagatgagtcaagaacaagctcaccactataggaagccatggataagagcttaa

SEQ ID NO: 55859 - DNA, 474 bp, Glycine max
  Peptide Sequence Number=SeqID_147544
atggctacacagtcaaactctcctccgcctcctcctccttctactggtgtaacatcgcattcgtcgtcaccaccattgaagcggactagaaaggcctcacgcctaagattattggcgactagaccagttggggcagagagacccccttacggtccccacagcaagaaatataaaacatatttagggattgttgctcatgataaggtggatgtcacatacgaaaattggaagcatgtccctattactcagaaggatttgatatgggaggatattcaggctgaatttgatatccctgaagcatctgatttaaggacaaaaaagaaaatacttcagactgtgggggagcggtggagacagtttaagtctgatttgacgttgaaatgggcacttgtagctgacaaggatagtgtcgatgacactaatgtgcgaaaaaaagcacaagccgtccaaaaacaaaacactgccctcacgtga

SEQ ID NO: 55860 - DNA, 369 bp, Glycine max
  Peptide Sequence Number=SeqID_147545
atggagtttgcggatcacttactacttgcgggtcagctttgtctagtgcctgggcaggtatctgcggattacatggagtggtttttccgcatatctcaccctttcatgacaccgacccaggcaggtgaccagcagagggatgcaccagctgcagaccctgaggactacatacagccgcccagcccccaggatgattacgagggatatgaggcgattgcacagaggttggagcgtgtgctcaaccttaggatagtcactgcaggcacagagttatatgacattatgcaggactgcctgacaatcgcgagagggggacccagtgctgatgggacggccagggctcgtcagagacgccgcacggaccattga

SEQ ID NO: 55861 - DNA, 376 bp, Glycine max
  Peptide Sequence Number=SeqID_147546
atgacggaagggtgtggtgaagggttttgccttgcaaaccttcccggtgatgcttttagtctatgggggaacttctctgaggcaaagaaacaaatgatggctgatgccaagtttgcggggctgcttggcttggctagggtcggcggtgctgagttatggccccgtgctaagtttcggattggttggccccctcctcccccccgggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagg

SEQ ID NO: 55862 - DNA, 399 bp, Glycine max
  Peptide Sequence Number=SeqID_147547
atgtctcaccatcagagggctgcacgccctcacctccagaggactacacgtcctcgccttgagagggctacccgccctcgccttggaggactacatgtcctcacctttgtagggctacacgccctcacctttagaggaccacacgtcctcaccttcagagggctacacgccctcgccatcagaggactgcatgtcctcaccttcgtagggctacacgccctcacctttagaggactacacgtcctcgccaacagagggcgacacgccttcacctttagaggactacacgtcctcgtcaacagagggctgcacgccctcaccttgagaggactacacgccctcacctccagaggactatacatcctcgcctttgagagggttgcacgccctcacctttag

SEQ ID NO: 55863 - DNA, 303 bp, Glycine max
  Peptide Sequence Number=SeqID_147548
atgactcatcaagattttcaagtgcaagccattggtcagtttgctcaagcaacctgcactcctgagtttggacttccaagaccgttcaatcagagattactcgtcttgcacgttggtggggtttccgtaaaacaacaaggacaacccttcccttgtgttcaagaatcctctacaataagagactctcagtctcttaatcccttttcagaagtaagaagaagagaagaagaaatctttcttaaaagggatagattgtacaatgaagaccaatcaaaattccttattgaatatgcaagtggttga

SEQ ID NO: 55864 - DNA, 615 bp, Glycine max
  Peptide Sequence Number=SeqID_147549
atgacgttgctacttagcaacattctgcccagcgaccgcaatgccgatctccctctgcgaaagtatcgattggggtcgcacccacaagacacacagtggacccggaggagcccaacagggccctggggtttccagctcgggttacgggcctctgtcagtcctacatgtcctcactttcagagactacatgtcctcacttttagaggactacacacgtcctcaccttcagaggactacatgtcctctcttttagaggactacgcgtcctcacattcagaggactacacgtcctcactttcagaggactacatgtcctcaccttcggaggactacacgtcctcacctttagaggactgcatgtcctcactttcagaggactacacgtcctcacctttcagaggactacacgtcctcaacttcagagggtttcacgccctcgccttcagaggactagacgtcctcgccgtcagaggactagacgtcctcgccttcagaggactacacgtcctccacttcagaggactacatgtcctcgccttcagagggctacgcgctctcgccttcagtgggctccacattcgcaccttaagagaatttaaggtcctctacccttaa

SEQ ID NO: 55865 - DNA, 363 bp, Glycine max
  Peptide Sequence Number=SeqID_147550
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtagagaatggagaattgcacaaagcaatcactacgcatagctccaaactcgaaggtggaggaaacatgaacgaaaacgcaattcatggggatccgaaaaag

SEQ ID NO: 55866 - DNA, 756 bp, Glycine max
  Peptide Sequence Number=SeqID_147551
atggctacctcaccaaaagaaacttccgctccaggttcacccgctgtacgatcatctccgcaccaggaacaaccagaattcaacatccaacccatacaaataattcctggtcaagcttcagtccctgagaaactgattcccagaagacaacagggagtgaagattgctgaaaaccctagccctgcaacaagtcctagggaagtagacacggagatggacaagaaaatccgcggtattgtgagtagcattctgaaagatgcttctgtgcctgatgctgagaaagatgttccaacatcttccaccccagatgtttctgtgcctgatgtcaatcaagatgttccaacatcctccgctccaaatgctgaagccctcccttcacccagtgaagaggaatcaacagaagaagaggatcaagcctcagaggagacccctgcaccaagggcaccagaacctgctccaggtaacctcattgacttggaagaagtcgaatctgatgaagaacccattgccaacaggttggcacctggcattgcagaaaggttacaaagccgaaagggaaaaacccccatcaagaggtctggacgaatcaagactatggcccagaagaagagcactccagccactcctgccacatccagaagaagcaaggttgctatcccctccaagaagaggaaagaaatttcctcatccgattctgatgatgatgtcgaactagatgtctcgacatctaagagggccaagaaatctggaagaaag

SEQ ID NO: 55867 - DNA, 225 bp, Glycine max
  Peptide Sequence Number=SeqID_147552
gaccgtcgtagaaaggtccacaattcaaacacggctgtcaacagccctgtcgtagaagtaacaatagactacgacgggcatggggacaccaccgtcgtagaagtaacaacagactatgacggttgtctacccaaaaccgtcgtagaatggtcctatcactacaacggtgttttgttgcggacgaccgtcgtaagagacggtgttaatactactacggtcacgtaa

SEQ ID NO: 55868 - DNA, 339 bp, Glycine max
  Peptide Sequence Number=SeqID_147553
atggcttcgaaaaaaatttccacgaagaggtctaggagagacaccgcggcggaagggtccagtgccgcactcgaatttgataaccaccgtttccggagcaccgagcaccagcagcgctttaagaccatcaaaggatggtcattccacagagagaggcgcgtccagctcagggaggatgagtatacagattttcaggaggagatagctcgcaggcattggacgtcactggtgactcccatggctaagtttgaccctgaggtagtcctagagttttatgctaatgcttggcccacaaaggagggagtgcgagacatgcgttcatgggtaaggggtcagtga

SEQ ID NO: 55869 - DNA, 324 bp, Glycine max
  Peptide Sequence Number=SeqID_147554
atgcacacacgaagctttacaaatccacaattccttaaaagtaggcctaactcacaaaaagtccccagtggagtcgccaactgtcgcaacgtgcccttcgcgggcgagcgagggcgaggctcacggatgcgctttccaaaggaggaaaggtgcgcggagtcgccaccaatgtttatttgtggaaaacgtcgggaaaaccgaaggaaaccggtcaaaatgagaattctaagttcggaagttgtatttacgcttgaggaaggtcgacaaaagcggggcttttgctcctacgtaccctcctttggagagaaaatcagacctacgtag

SEQ ID NO: 55870 - DNA, 711 bp, Glycine max
  Peptide Sequence Number=SeqID_147555
atggctacaaagaagcttttctctaagagggcaaggaaagatgccgctggagagggatccagtgcggccccacaagcggatatggaatttgatgggcaccggttccgaaaaatagtcatggagttctacgccaatgcttgggccacagaggagggagtcagggataagcactcctgggtgcggggccaatggatcccctttgatgaggatgccattaatcagttcttggagcatccgttggtcctggaaaaagggcaacgttgtgagttcagtcagaggaggagccagacctcgagatttgatgaagaggccataggccagttgttgtgcgttccaagacaggacttcacacgaagtgtgacgaggagacgggtgcagattatgcgcactagcatgaccaccctgacacagatctggatgactctgcttctcagcaacatcctccccagcaatcataattctgatcttcccttgccgaagttccagttggtctacaccatctttacccaggcggccaatcatagggatcaggtgcagctgaatgagagcttttaccagtacaccctgcatcagcaatcccaagatcccaaccctttcccgtggcctacccccgagcagttcggggccacagttgcatggcctaaagacaggcccagttttcaggcaggggcaggacccacagggacccctgaagatgaagatggagcttag

SEQ ID NO: 55871 - DNA, 309 bp, Glycine max
  Peptide Sequence Number=SeqID_147556
atgactttaaatctttgtgtactgacccccaatcgaattgtttgggattcggaagtgaaggaaatcattttatctactaatagcggacaaattggagtattaccaaatcatgcgcctattgccacagccgtagatatagtaaatgatgcggaaaagggtagtgacattgatccacaagaagcacagcaaactcttgaaatagcagaagctaatttgaataaggcggaaggcaagagacaaacaattgaggcaaatctagctcttagacgagctaggacacgagtagaggctatcaatgtgatttcataa

SEQ ID NO: 55872 - DNA, 547 bp, Glycine max
  Peptide Sequence Number=SeqID_147557
atgacaagaaaaagaaaggaattgcacttaaagcctcatcttctattcaagaagaaagtgacagaagacttaaatgaaataaaagaagatgatgattttagtttctttgtaaagagattcaataagttgctaaggaacaaagtaaatcaaagaagaacaaatttcaatccaaagaaaaaaggagaagactctccttctattccaaagtgctatgaatgtaataaacctggacatctaagagttgattgccccagtttcaagaaaagaatggagaagtctgacaagaaaaatttcaaagacaagaaaacaaagaaagcttacattacttgggaagatagcgatatagattcatcaggagattcaaaaaatgaagtcgtgaatctgagtctcatggccaaaaactatgatagtgaagaagagggtttcttgaagaaaagttggtacattgatagcagatgctctaaacacatgacgagagatgcatcaaaatttactcatataccttccaagaaaagtggacatgtgacttatggagacaacaacaaag

SEQ ID NO: 55873 - DNA, 219 bp, Glycine max
  Peptide Sequence Number=SeqID_147558
atgacacccagtggacccggagaagtccaacagggccctggggtttccaagctctggttatgggcctctgtcagtcctatcgggtgcctcgtccccccagcaagggatcgctgcccacaagacacccagtggacccggaaagaagtccaacagggccttggggtttccaagctctggttgtgggcctctgtcagtcctatcgggtgcccgtccccctag

SEQ ID NO: 55874 - DNA, 222 bp, Glycine max
  Peptide Sequence Number=SeqID_147559
atgaagggtggaggttgcacagtagctcacccaagcgagctgcttgctttctccagaagtaacctagctcgcccaggcaagctggttacttcaaccctaagcttcctagtgggcccaggggctggaaaatgccccaaaagtgacccttttgtcctccttttgaatattttgctcatttccttccgaaatgtcacaaaaccttatagattgcatggcaattag

SEQ ID NO: 55875 - DNA, 851 bp, Glycine max
  Peptide Sequence Number=SeqID_147560
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatatcacttgtcttgacagtttattcatttctggcttgtaaatacacagttttaggttcagggaatgctgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 55876 - DNA, 471 bp, Glycine max
  Peptide Sequence Number=SeqID_147561
atggaacattggaaagctgcaaagaaagttctgagatacttacagggaacaaaagaccacatgcttacatataagaggctaattggctgcggaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 55877 - DNA, 509 bp, Glycine max
  Peptide Sequence Number=SeqID_147562
cggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccggctccctcgcccaacaaagacatcacaaaaaccgtagtgtacatgtctccttccgatcaagaggacatgactatactctacaagtttcctaggactcttcactatatacctaggaagacatgcccttctccaaaactttgtccatag

SEQ ID NO: 55878 - DNA, 207 bp, Glycine max
  Peptide Sequence Number=SeqID_147563
caagcattcgctaagcgcgacactcagtggctaagcgcgaggaagaatccagaagaagatgagctgttaggtttccaggtcatcaagcgcactgcttcagctcatcctctaagtgagagaagcgcactaagccaaaaattactaacgtgcactaagcagtccatatgtgcgctaagtgcacaagcacgaacaaggccacttatttaa

SEQ ID NO: 55879 - DNA, 501 bp, Glycine max
  Peptide Sequence Number=SeqID_147564
acccctggtccattggatcctgcacccgggaaagaggacggtccccacagaaagaagttaagaacatatttggggatcgtcgctcatgataaggtggatgtcacatacgagaattggaaggaagtccctactgctcaaaaggatttgatatgggaggatattcagactgaatttgatatccctgatgcatctgattctgatttgacgtccaaatgggcacttgtagtcgacaaggatagtgtcgatgacactatatgtgaaaagtacgacattagcaaggagaaatgggcccaattttgtcagatccacaaagacccatcgtgggaggccatccagaagcaaaacactgtccctcacgtgttgtctcgtgggggttatgaatatttagaaaacaagttgatggatgagaagagaaagaaaaaactagaggaagctgctcaattcggaagcaccgacaccgtgattgatccttcatctcccatcagacgacacgtgaagtga

SEQ ID NO: 55880 - DNA, 387 bp, Glycine max
  Peptide Sequence Number=SeqID_147565
atggcatccttcagccagatgcagtccctgattcagtcccaaatgcaatctcagggacttgcactgcctcccgagcctctggttggtccctccggtactcgagtaagcacaaaggggagttgtgttgatccctcaggaaacgattctgagacgggtgactcagataggtgcggcttgtacatcgaagtagatcctgcccgcctggttgccctggggagagtttgtgagggatccactattgttcataacactcctttgttgcctggccaagtaaaggtgagtgtggaggaggttacacatgtagatgctccagttcctgtacctactgatgaggtttccatagtggggcaggcacttcacaccttccttgcttggccgacacatctg

SEQ ID NO: 55881 - DNA, 318 bp, Glycine max
  Peptide Sequence Number=SeqID_147566
atgactatgcaaaacatgcagtttcaacaagagaccggagcctccattcatagcttaactaatcaaatgggacaattggctacacagttaaatcaacaacagtcccaaaattctgacaaattaccttctcaatctatccagaatccaaaaaatgtgagtgtcattacattgaggtcgggaaagcagtgtgaatcttccactggtaattctgatttacagaagtatcatatccatcttccattccctccaagagcaatttccaacaaaaaaatggaagaggcagagaaggagatcttggaaacatttagaaaagtagag

SEQ ID NO: 55882 - DNA, 804 bp, Glycine max
  Peptide Sequence Number=SeqID_147567
atggtgctgggtgaaacgctggatcgccagcagcagggcgatcgctggcgctacgtagtgaaaaccggcaaccgcgattttgccgcgccggatttccgcgtcatcgtcagtcagggcgaagcgcaaacccgacgcccggcagaagtgctggtgctacagcgacgcagtggcggcaatgcctacggctggctggtggagctgcgtgaagacaacgaggtgctgaccgcgcgcgaccgcgatgcactgctgcagcagcggctgaagcaggtgcatgagcagctgcgccaggcgagcaacatccggcgtatcgaaatggcgcgccttaacgcccagctggagagtctgcaacagcaggctgacgagcagcggcgcggtggtcacttcagcctgcaggatcagtcagaactggatgccaacagcgcagcgctgcataaacgcttcggcgcgctggcgcagcagctggcgcatctgcagcatgaaagccagcgcgatacgctggtgctgcgcgacgtgcagggcgacgatcatctgattccgctggcgcaggtggtggccgcctggtatccaaacagcctgagcctcgggcagaaaatcgggcatttcctcagtcagatctggcagtttgtcagtgactcgcccacctcgggcggcagtgaaaatggcgcgctgccggcgattttcggcaccgttttgatggtgctgctgatgtcggtgattgtcatgccgctgggcgtggtggccgccgtctggctgcatgaatacgccgggcgtaacgcgctcacccggctggtgcgcattgcggtg

SEQ ID NO: 55883 - DNA, 210 bp, Glycine max
  Peptide Sequence Number=SeqID_147568
atggctctggaatggtggtctcagatgaagcatcctgtacctgttgggaagaatggcagtggaatggagaaggaagagagagaggagatgccactcaaggagaagatgagtctagaagaagctcaccaccataggaggccatggataagagcttggaggaagaaggagatgaatgaagggagaggaagagaagagcacaaaattttgtga

SEQ ID NO: 55884 - DNA, 270 bp, Glycine max
  Peptide Sequence Number=SeqID_147569
atgtcttactttggtgtcattcaagaaatttgggaggttgattatacatcatttagagtgcctgtttttaagtgtcagcgggtgaacgggacaacgggaagaccaagtggaatgacttaccataatgatgagtcaacccttgacattggtcaaatgtctagtttttcaaaacaattgccttcaatgaatgaagctgatgaagtggatgatggacatgcaaatcgtgtagatcatgatgaaggtctatgggaaaacatccctacaggctga

SEQ ID NO: 55885 - DNA, 168 bp, Glycine max
  Peptide Sequence Number=SeqID_147570
gcacttaaggatgaacgcaagcggggatggggtcacgaccgaccgatcgttactcttctctgtgcgaaacaagcagggaatgtcgctgcaaggcagcccccgcctaattctgacctaagtaagttcaagttaggcaaaatgctaatccctgaggagggaggggacatg

SEQ ID NO: 55886 - DNA, 712 bp, Glycine max
  Peptide Sequence Number=SeqID_147571
gatgtgcgcaaaaaggcacaggccatccagaaacagaacactagcccccacgttttgtctcgtgcgggttatgaatatttagagcagaagctcttggctgagaagacgaagaagaagctggaggaaactgcacagtcaggaagtagcgttgatggcatcatcgaccctccatccctggtcagatgccacgattcctttgaggagcaggcgacacagggatccttcgtcttccatggacgtcaggatgttctcaccgctactattggacgtccagagcaccctgaacgtgtcaccatcaagcaatactttggatcagctccacgaacgtcccacagctcttcctccctgtgtcctgaagaattgcaacaactgacccgacaaattagggaccagctagaggagtccatctcaaaaaaagtgacgcgacagctcatggcatcgttcagccagatgcagtcccagatgcaatctcagggacttgcactgcctcctgagcccctggttggtccctcaggtcctcgagtaagcacaaaagggagttgtgttgatccctcaggaaacgatcctgagacaggtgactcagataggtgcggcttgtacatcgaagcagatcctgcccgcctggttgccctggggagagtttatgagggatccactgttgttcataacactctctttgttgcttggccatgtaaaggtgggtgtggaggag

SEQ ID NO: 55887 - DNA, 225 bp, Glycine max
  Peptide Sequence Number=SeqID_147572
atgggaaactcgccaccccggcttgattccatacaaagattatgcaaggcgtttgctaaccttcttcaacgaagtggagttgaagcagcatccctcgtgatgagaaccaaatgtgacgttagcaatcctttatcctccatgtacgaatggcccttctctatgtggggcatcgatgtgattggtagaatcgaaccgaaagcttcaaacgggcatcgtttcatctag

SEQ ID NO: 55888 - DNA, 267 bp, Glycine max
  Peptide Sequence Number=SeqID_147573
atggagaattggcgaaaagcgctacgcaataacttcgcggggctccagactcgaaggggagaatggagaattggcgaacagcgctacgcaataactttgcggggctccagactcgaaggtggaggatgcatgaacagcgctaggcaatcacattcatgggactccgaaaaaaagtggagaatggagaattggcgaacagtgctacccaataactttgcggggctccagactcgaagtggaggacacatgaatagtgctagggaatga

SEQ ID NO: 55889 - DNA, 695 bp, Glycine max
  Peptide Sequence Number=SeqID_147574
atgaaggccgacatggaggccataaaagagaaaatgaccacactgatggaagccatgatgagtatgagaaaaatgatggaggtcaatacggctacagttgttgccgcaagtaccgccgcaaaggtggactcgactcacccacctggctacaatcaagtaaatcatctagcctcggatatggtaggtcagggaggcgaagagttggaaagtgcgggcgacccctattttgtgccgattcagaacaaccattccttcccaccatgtggattgcctcctaactatacaccacccaatgttgtacacactcccgatgagaatgttgacaactccacacccatacccgttaagagccaacaaccccaatctaatcatgcacatatctctcaacccataggggagacacatgaagtaccccgaggccacactctagtcgacttcaagcctcacctcggatatgccactgagggggagacattttttagtgcacccttgccaaacgctttgggggggcctcaatatcgcccacaaccccaacccttacattttgcgatgggagaagggcctcctgctatggtggaaagggagaaatttgatcatatagaggaaaggttgagggtcattgaaggaggtagacattacgcttttgctgatatggcagagttgtgcctagtgccagacgtcgtcatacccctgaa

SEQ ID NO: 55890 - DNA, 330 bp, Glycine max
  Peptide Sequence Number=SeqID_147575
atgaagcatagctccaaactcgaaggtggaggacacatgaagcaagcgctcaatcaaaggttgtatatcatcgaaaaaaaaatccccggacgaatagggatgacagttgcccctctttacttacctctcatcggagataagaggaaagcaaagatagacattgatttcgtccgtcctgccctctccgtgatgacgattctcgcaatcatgaagcatagctccaaactcgaaggtggaggacacatgaacagcgctaggcggggctccgaaaaaagtggagaatggaggattgcacttgagggtccacacttaggcaatcatgaagcatag

SEQ ID NO: 55891 - DNA, 594 bp, Glycine max
  Peptide Sequence Number=SeqID_147576
atgaggagaaactttgaagctccggaggaagatgaagaagtccgagctctaaaattagagctagggaaggcaagactcgccaaggagaagctcaaatcagctgctacacacatccggaaagagtgcaccgagttacaagaggaaaacgcagccactgcaagagcccttgaacaagaaactaaaagggcccatttgtttgacacctttgaccggaggtgtgagaaaaacagtgcacggattgtctgttgtttacccgctctctgtgtgtggttggtttcacacctattccaacaagacacaagacacccgtgtccgcttcaaagttatcgctcatgcgccgaaaaaggaagagtcgattgggaccaacatttggctggatacggaggcaacgcaatcaattggtttcctcattggaagggcaaggcaaggaaggagttcttttctcgtgtggggactaccctaatgttcacattaatagggactaggggttgtattaattataatcccgcactcgccataagacagctagggtaccccattgagcattgcaagagcgccaacatgaagaatagtctctcgccttaccttgaatga

SEQ ID NO: 55892 - DNA, 552 bp, Glycine max
  Peptide Sequence Number=SeqID_147577
atgtacgaccatctaaatgacgcgtcgcaggcctctacacggcagttggccggttatattacacttctccactgctggatatacgagcactttcttacagtgcatacatccgtcgttgatgatgcttatgatgaggggagcccacgagcctgcaggtggcttacaggtaaggctcatattacggggatcaagggagccccgtatcggagacgtttggatgccctgagtgtgactgacgtgtgttggatgccctatgatgagcaccagcgagtcagggcctttgacttgatatcgtcgtacaccggccagctcagatggggtcagattgtggtgtacgttcgacctgagcaggttcttcgacagtttggctaccttcagacggtcccttcgccgccggtttgtgattctttgacgggtgatgatatagatgaccggtggctgaattttccagaccatttggtatattcaagggagctctgtgtagttcctggacaggtggcggcagactacatggagtggttttttcggatatcgcacccattcgtcacgtag

SEQ ID NO: 55893 - DNA, 357 bp, Glycine max
  Peptide Sequence Number=SeqID_147578
atgaagaagaagattgagatgatgaagaagacttttccttctttgttaagaaatttcagaaattcatcaagaaaagaagaattgacaggcgtcagaatttcaataatggaagaaaatcacaagatgattctcaagtccttaggtgttaccacatgcaaccaaattggtcacatcaaggccaactgtccttcaaatgaagaatggtcggagaaaagtgaaaagaaaagatttgacgaaagaagaactaagaaagcatacattgcatgggatgacaatgattcatccgatggttcagaaaaggagattaatcttctaaccaaagattatgaaagtgacgagaacatctctcaaggatga

SEQ ID NO: 55894 - DNA, 1060 bp, Glycine max
  Peptide Sequence Number=SeqID_147579
ctggaaaaagacggcaccgtgctgaccgactccgaaaaagtaggccagtggggcgcgccaaccctcgacgtgtgggtcgtgcgcaaagacttcgccgagaaacatcctgaggtggtgaaagccttcgcgaaaagtgcgattgacgcccagcagccgtacatcagtaacccggatgaatggctgaagcagcccgccaacctggagaaactctcccgcctgagcggcgtgccggaagcggacgtgccggggctggtgaagggcaatacctatctgacccccgcgcagcaggtgcagcagctgaccgggccggttaacaaagcgattgtggataccgccaccttcctgaaggagcagggcaaagtgcccgcagtagcggcggattacagccagtacgacatcaacctgacgctggacagcggtgagctgctggtggtgctgggcccgtccgggtgcggaaaaaccaccctgctgaatctcatcgccgggtttgtcccttatcagcatggcaccattcaactggaaggcaaaaagcttgcgggcatcaatcgtgaacagcggctggaaacggcgcgggcgatgctgaaaaaagtggggctggaaggcgcggaaaaacgctatatctggcagctttccggcggccagcgacagcgtgtcgggattgcccgcgcgctggcagcgaatccgcagctgttgctgctggacgagccgttcggggcgctcgacgccttcacccgcgagcagatgcaaaccctgctgttgcgcctttggcatgagacgggcaagcaggtgctgttgattacccacgatatcgaagaggcggtatttatggctaccgagctggtgctgctctcgccgggaccggggcgtgtgctggagcgcttgccgctggatttcgcccgccgctacgtcgcgggggaacccgtgcgcagcatcaaatccgatccgctgtttatcgaacagcgtgagtaccgtcggcacgctgctggtactgctggcggtgtggtgggcagttgctgccctgcagtgggtcagcccgctgtttctgccgccgccgggacag

SEQ ID NO: 55895 - DNA, 210 bp, Glycine max
  Peptide Sequence Number=SeqID_147580
atgagggtgactgggtttggctccgtcttaggaaggatagattccctacttaaaggaaatccaagcttagcactagaggggatagaccttttcaggttttggagaggatcaataacaatgcctataggttggacctcccacaagagtggagttgatattgaggaggaggaactaacagatttgaggtcaaatcttctagacttggagtga

SEQ ID NO: 55896 - DNA, 942 bp, Glycine max
  Peptide Sequence Number=SeqID_147581
atgacatctaagaaaaggaaaactccttctacacctacccaggccagatttgatagatccaggttcacatcccaagaggcttgggagagatatacagacattgtggtgcctcgaaagctactactgaagaggaatgtggtagtttattgcaccgagtttgacgagttcaagaaggaacttgagataagacattgggatgagaagttgactgattttgctgacagtagtatagacattgccattatgaaggaattttacaccaacctctatgaccccgaggataaatcacctaagcaagtgagggtgagaggttacttagtgaaatttgatgaagatactctgaatacatttctgaagaccctggtaattttgaaggagggggagaatttgtgtacttattccaggtttgcactcctgaggtctgatcctcaggagttggctgctaagctttgtatcccagggaggggattcacacttaatgttgatgggcagcctttgaagatactgaggaagaacatgaccactctagctcaaacatggagtgttatttccttttctaagctgattcctacctcccacacatctgatgtgaccttggacagagccaagttcatttgtggtatcattgtgaagatggatatgaatttggggtaccttatctcccaccagatctctcttattgcacaacatgatacatccagacttggattacttgcctttatcataactctatgtaaggccagagaagtccaatcagattctagatccctagagaacttgagccctgccattaacttggcatatattaagaagaactgtttgaatcttgatgatccaacagtgacatttagaaggccaaggaaggccaggggtaagagatcagaggtccccactacttcagcagcaccagagacaccaactccttcttcttccatagctcca

SEQ ID NO: 55897 - DNA, 309 bp, Glycine max
  Peptide Sequence Number=SeqID_147582
atggcttttaatagagctctttttatgaagtggaaatggttgatgttccagcaacaagatcatctatggagcagaatactcacctcaaagtacaggggttggagaggcttggaagagggccctcctaagcagattttttcctcttggtggtctgacttaagatctattattattcatcacagcagcatggttgctgtcaataagcaatttcgctggaaactgggcagtggtgatcaaatcctattttgggaagacttttgggtgggagatggaattactcttaaagacaaatacccagaattatattaa

SEQ ID NO: 55898 - DNA, 192 bp, Glycine max
  Peptide Sequence Number=SeqID_147583
atggaatgtcccgggacacccccatggtacttgcaagttgcattagggtcataccactttgggaaaggggggaagttccttgtcgtgttggaattaccggccgggcgagtcgtgttcggagttggaacttggggagcttccctctgggtgggtgccttaggctgcacgggtgttgaactagaggcgttcccg

SEQ ID NO: 55899 - DNA, 363 bp, Glycine max
  Peptide Sequence Number=SeqID_147584
atggtgaaagttggaacctctttacgtgccgatcaacgtctcattttcgccaaaaagttggcccagggcttcccggtgctccaagtggcttctgttttctattcagctgtccctcctgttcagctactgacgggggtgcgctggcaaagtgtagcggtccccgctgcgcgtaacccaccacaccccgccgcgcttaaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 55900 - DNA, 328 bp, Glycine max
  Peptide Sequence Number=SeqID_147585
atggggacaaatcaaaacggaaaaagattttatcaagtcaagattaagagtctagatgtcaccagccttaaggaattgggacggttgatgggacccctccaaaggcaagccttccgcaaagtgtacggaaagatcttggatttgactacagtggaggtatttacggaagttgttgtatccctcgcccaatactatgaccagccgttacggtgctttatgtttggggacttccaaatggtaccgactgttgaagagtttgaggaaatattaggatgccctcttgggggaaggaaaacgtatcttttccccgggtttcttccctccttaa

SEQ ID NO: 55901 - DNA, 567 bp, Glycine max
  Peptide Sequence Number=SeqID_147586
atggcatctgggttgaagattaatttttcaaaaagcaatgtggggatatttggagatgatattaattgggtacatgatgcagctcattttctcaagtgtaggcagatggagactccttttcattatttggggattcctataggggctaagccttctagctgcttggtaattctgcctcacagcaacaattcgaatataaagaagaaaagcagggtcaatgttccctttggtcaatatgacttaaaggtagcaagtgaggaagtgggtcagcggataagtggcccaactcattctgccacaaaggtttatgtgagaagaaaggaggtgttgagaagtaatggaaaggcccaacagtttaaggaaccagctgtggactcaaactcagtttctaaaactgattccatgccttcaatacaacaggacccaatagagctacaatgtgctcttttaaacgaaatgggcttgacttatggggaagatgccaataaggttaaggggcttatattggatatggaaaatagagatgatatgatggcagctgagaggggaattaaaaaacatcaatag

SEQ ID NO: 55902 - DNA, 606 bp, Glycine max
  Peptide Sequence Number=SeqID_147587
atgacaaacttggagaaactacgcattgaaacaactgcaggtggagtcattgatttacctattatttcacctctgccgatgcttcagaagcttcgcctggatgggaagttaaaaaagtttccagagtgggttccacaactccaaagtcttgtaaaattatctttgagatcctcccagttaaccattgatccattgaaatcactacaaaatatgccacatttgttattcctcgaaatgttggatgcttatgaaggtgaaagtttgtattttgaaaatggaggatttcatcaattaaaggaactatctctcggattcttccctaacttgaaatccatcattatagataaaggagcactgtattctttggaaaagctcaaaatttggaaaataatggaaatcaagacagtacctcctggcattcaacacttggaaaaacttcaagttctcgttatagaccatatgtccgatgaattgatcaatgagtgcattactcccaatgaaggaccacagcacccaatcatccagcatgtaccccttgtaaaagttactgtcggagactacgaacaaggaataaaaactcacattattcatcactcaagacattag

SEQ ID NO: 55903 - DNA, 1281 bp, Glycine max
  Peptide Sequence Number=SeqID_147588
atgagtggtttgacatcatggcacaaagcactgaagattccagatactgatgtcttaatggaagatggatgtgctaaggtcactgatcaagatgatcgagataaagcttttgttgtctggaatactggttcaatgttgagcatttgtaattgtagttgggcacaagatggcaacctttgtgagcatatcctgaaagttctaagtatctgccgaaagagggggtccattttaccatctgttgctttatttcagtatcaccaggcactaaataacatgctgcattgccctcctttggattctttaatttgtgatcacgccatgtcattggcagtttcagttcagaagcagttaaatactctacttgataaagaaagtgtccagactgttgtggattcttacgggaaatggatcgttattgatattccactggaaaacttcagggtaggctcagctaacagggatcaggacacggttagtaagaagcgtgtcatcaatggtgttttatctgaggacagtgatggctgtgaggacagaaatgattcaagtgatgcccttggatgtgcaaatgcaatgactgatatcgctgatcaagttgtggaccgcggcattgcaagaaatggcaaaccgttgagtgctggagaagacagtttgcctgctgacatggatgttgatccatcatcaacttgtgttaaccctcctaggttgcaccgtgttgatgatattgtttcaagcgatgcattcccagagaacaaagagaggggcttagctaccacaagatacgagatttcaacttctgaaaatggtgctttgtctaatgataagattaaagaaactattttagatgaaggcggcagagattgtgctgtggatgtggatcccccaactttagataccctttcatcaacatcagaggatgtgaagcattgtgaaacagaaacacatcaaaatggtgtcaatgaggttcccagagtcatttcttgcactaaagatgctgatagccacttgagccccccatcaacagttaaacctgctaagccacttgcacttgatatgggtaaaaattcaggtgtacacccgcaaacagcgagcaagagaagcaataaccatggaccaccagcagcaaggcgcacaacacccaaggggtgcaaactacccaacagttatgatccacccaagggtgtaaaccacccaatagttacgattcacccaaagggtgcaaggtcagaagatgtgaatcaaggggacatgacccttgggaacagtcacaaccaaccattatga

SEQ ID NO: 55904 - DNA, 618 bp, Glycine max
  misc_feature (31)..(31): n is a, c, g, or t
  Peptide Sequence Number=SeqID_147589
atgctgcaggtcgatctagaggatccccggnaagtttatttacggtgcttaactagaacaaagcctaagaaatgggtctcttgtcttccatgggcagaattctgtaaaattcatccggtctttcatgtctctctcctaaagaaagccattggtgactcgttccagtcccaacctttaccacctatgttatctgaggatcaggaattacaagcttatccagattctgttttagatattcgtgaattacaacctggaaacgtggaagttgttccgacttatcatcttgaggacaaggtgagtcttttaggcaggggtattgataagcataagcataagccacacatcaccaaggtgtacacctgcaaacaacaagcaagagaagcagtaatcatggaccaccagcagcatggcacacaacacccaaggggtgcaaaccacccaatagttacaacccacccaaaggatgtaaaccacccaatagttatgattcacccaaagggtgcaaagtcagaagatgtgaatcaaggaaacatgatccttgggaacagtcgcaaccaactgaaagatgtgaatcaaggggacatgacccttggaaatagtcacaaccaaccattatga

SEQ ID NO: 55905 - DNA, 219 bp, Glycine max
  Peptide Sequence Number=SeqID_147590
atggcactcattacaccattaagtgccaaattcgatcactttcaacgtgcttttggatcaatacaaaattacctgccacagcttgacctaaaagtcctttatagaattaagggtgttacatcatatggtgtcggtggtaatgaaggtgaccttttttacatggcggtcgtcaaggtcttgactgggaaaagggtgtcacatggccaagggaagcattga

SEQ ID NO: 55906 - DNA, 84 bp, Glycine max
  Peptide Sequence Number=SeqID_147591
atggagatgcatcagaagataaaggagaaaagcctaggtagcttccttgagaaacttccttgtgaagcttccttgagaagctag

SEQ ID NO: 55907 - DNA, 120 bp, Glycine max
  Peptide Sequence Number=SeqID_147592
atggagggtttatcgttggtgggggaggaagaagatggtttctcgttgaaaatccaggaggacactggacataactatgatattgaggattctaacggattttggcattatatgccttag

SEQ ID NO: 55908 - DNA, 300 bp, Glycine max
  Peptide Sequence Number=SeqID_147593
atgatgataacaaaagatgatgacaaaggtgatgacaaaaagctcaaaggtcaatcaaagaatgagttcaaaatgttcaagatggaatcaagaacaattcaagactcgagaggaaaagttgaagaacacttcaagattcaagaggaaaggtacatctacttgggtttgactgagaagaagagagggtacatctcttgtggatcagttctagtggagggtacatccactaggttcaaagagaacaagggagggtacatcccttgtggatctttgcttgtaaaaggatttttacaaggttga

SEQ ID NO: 55909 - DNA, 648 bp, Glycine max
  Peptide Sequence Number=SeqID_147594
atggagtggtttgtgggtcgagacggaggtagtgttatcggtgtctggaatagtgaggcgaattgggtggtcaaggctagtatttctgggagggttgtgtcagatggagacccagatgcttcactaagcgtttttgcacaaattatgagtgctgcctccatcgatcaaaatcacgacattctgtttggatacctggcccaggttcacatcctctgcttcctattccttatcttcgatgagaaggaagaatcgagaggcacacttatggcctctagtgaacttctcgtcgcagttgaaacaaaggcctctttctctcccactagtcatctcctccagtgtgagacttttcaaggtcgtgctaaccccaccacctggaccaaggtgaaggtccaacctagatacgaagcaactgaggaggaatggtggcagaaacactacaatgcgattggcaagcgcctcaaattttttcagggaattggtgtgggaatgtctgatgaagatgagggtgaaggaaatggttggaagttgttttcgagattggtaaccctgttgattctgtcatggttgtctctcaatgaaagcaccaatgttatgatcagggagctttctactcaaggaaatgaacaattcctagcgttcgaggcctag

SEQ ID NO: 55910 - DNA, 423 bp, Glycine max
  Peptide Sequence Number=SeqID_147595
atggatttcagaaacaaagctaataacaatgctctgggtcaaacacccatgtcactacatgaaagggctgagagcatttcgggttttacaaagggacatcattttgaaattccggtcacgccaatgaagcgcaaaacatacaatggtggttccaaagtcagaatgacgcaaagggttcctcttggtgtggggtttcaacggagaacaatggcggttttgtggtggctactggtggttttgggtgatggagaaagtgcttgggacgttggaaatggttttggaagaaagaaggagaagaaatggcgttttcccaaagctaattggactacaaggctcaaaacgcacaactctggaccaaatttcgagaagatccaacggttaccaaaggttgagaagcgtttttaccgagacagcttcatgtag

SEQ ID NO: 55911 - DNA, 576 bp, Glycine max
  Peptide Sequence Number=SeqID_147596
atgttgtcaagtagacgtgctactcatgctaaccttgaaaacatgattcaatggatcgagatcacatggttgcaattgcagcacttgacacaatacctggcttttcttcaagcgcaacctcaacaccatgttcttgtagtcgtggacacgatcatccaaccagggataatgattgttctaacattgatgactacccctttaacgtcttccttcaaccagatcattattgggaagcaggatttgaagtcaatatgccttgttttgatgtcgacaatgaacctatttatgaaactgatgatgagtttgatgattttaatgaaaaccttgatgatcattgctagaaagtgggattcaaggttgatatatatgattgattttggtgttgacattggacctattattgcaactaatgatgacattgttatggatgttaatgaagaacccatccatgttgagagtttggcattaatgctttgttgtacctctcttagctctcattttccagaagatggtttgcatcatactgattcgaggatgaatcttttcgatgaaggagggaatgatgtagaaatctag

SEQ ID NO: 55912 - DNA, 525 bp, Glycine max
  Peptide Sequence Number=SeqID_147597
atggccagcttagatcacttattccttctcaaagaaattgctatgtccattttgatcttcttaatcacccacctcaccattcgttcacacttcacaaaccgtcacaacaagcttccacccgggcctagaggctggccaataataggcgccctatcactcttggggagcatgcctcatgtcaccctctctagaatggccaaaaactcgtgcatttctcaaaaccctattcaaaacttctccaacaagcctccaaatgctggtgcaactcacttagcttatgattcacaggaggtagccacctatgccgcatccaaagtcgcagaccctgctctatggaagcgtctcgatgccgcggtgcttcaatggatatacgggactatatccaccgatctccttcatgctatcttgctcaaagacgacacggctcaaggggcgtgggctcgtctcgaatctatgtttcaggacaacaaggcttcttgggctactcatcttgaagaggaacttgcggaatttttcgtctattga

SEQ ID NO: 55913 - DNA, 159 bp, Glycine max
  Peptide Sequence Number=SeqID_147598
atggacactattgagtttgtagctcaagtcggggatgaccaggaccgtggagatcaaatttgggaaagttccttgttggattccaaccctcttgatgatgacaaaaagctcaagagaatgatttcaagattgagtcaacaagttcaagatccagattaa

SEQ ID NO: 55914 - DNA, 353 bp, Glycine max
  Peptide Sequence Number=SeqID_147599
atggagcgagttatgatgggtcaccttggtgactgtgccaaaggtgctaaggatagtgagcttgatgtgaccttggcaagcaacgccaagaatgaactccttgatgttcatacccgagtccacattgatgatgacgatcctcacaaatggctcactaggttgggccacaaggaaggaaatggtcttttgcttgttcttggagcctggtggcctgccatgtcacttcttaggaggtggggttgggagaaggagattctcttggggctggaggagttttgggtgtgggaaattgcaaaggaattgtttgttattgtgacacagaggtgtatggaattagagaaggacaaagatat

SEQ ID NO: 55915 - DNA, 348 bp, Glycine max
  Peptide Sequence Number=SeqID_147600
atggatgaatcattgaaaaagaaaaagggttcatccacttcctccgccgctgccgcccatcgacaccacagaccatctgaagcacccacagcaccacttcccccttccttgtcatctccattatcatctactatattttcttcagatgatcaacgtctacggtacacttctcaattttcttctaggatcatcttagaccctaagtacctagacatagacttctttaacgatgagacatttgactgttatcaagtgtttcaaaactttggattagttgattttatgtccttaaaattgccttattatcctgaactagttagagtcttttacagtaatttaaaaatttag

SEQ ID NO: 55916 - DNA, 402 bp, Glycine max
  Peptide Sequence Number=SeqID_147601
atggcaaagttggtggtgatggaggtggtattaatggtagtgacggcggtggtagcaatctcagtgtttggtggtgttgacaatgacgatggtagtgacattgatggtggtgatgatagcaatactagtggtgatggtgatgtcgacaacaccgatggtggcaatcacggcagtgttgaagccagatatgctagtaacaacgatggtgatgatgattgtggtgcagtggtggcaatgatggaggttgttgtaacaatagtttatggcaaaccgaaaaaattactggctgagtcgcggacaatgtcgctttctttaagacgtttcgtggcactaccaaaaattgtgcaagcagactatcaaccacgaagtccccaggataaaacagcccagatcactgtataa

SEQ ID NO: 55917 - DNA, 341 bp, Glycine max
  Peptide Sequence Number=SeqID_147602
aagcttctaacaatggattccctggaaacttggtcaaagtttctccaagtagtagaaaagtgacagatgcaagtgttccatgggcttcactcccatcatctattgcaaatcttgggaggtcatcaccgttgtgttctcatcaccatcgtgctaccgtcaacatcaaagctgtgaacccctccagcaatgtgctctcatcattagaaggtatgaacccttttcttgcattttccttgggacttcatatgaatttcgttggggctagagtgggcatggccattgatgacattggggtttggggtgtagtgaaaggagcattggggtttagagttgttgtctag

SEQ ID NO: 55918 - DNA, 528 bp, Glycine max
  Peptide Sequence Number=SeqID_147603
atgcaacaatcagaccgtaagttgccttttattgctaaccgtggcataatatgggtatcaggtatcaaaagtcgatacaaccatatatacaccatgttgccatggagacgtgctagtcatgcttgcctagagaatgtgattcgatggatcaagatcacacagttgcaattgcaagtgtcccacttgacagaacaattggcttctcttcatctgcaaccacaacaccatgttcatgaagtgggatttaaggtcaatatgcttgattttgatgttgacattggacctattattgtagctgatgatgaaattgttatggatgctaatgaagaacctgatggctcttattcgccagaagatgatcatattggtaatttaaccttccagtgcacgattatagatttgaggatgaacctctacgaggaagtagggaatgatgtagaaatttggtgcaaccatgggctaagaagggatcaaagaggatgtcagggctttagtatagaaatccaacgtcccaagagatctgtatag

SEQ ID NO: 55919 - DNA, 426 bp, Glycine max
  Peptide Sequence Number=SeqID_147604
atggctttggtaaaaaccgtcatagatggggcaactttaaagacggttgtacctaaaattgttgttgtaatgcattcatcaccatcctgttctcatcaccatcatgctgccatcaacatcaaagctgtgaacccaactagcaacgtgctctcatcattagaagtatactttgtattcacaccggctcttgtttgtagcatcctggctaaaactattgcattcaagagcctgaggcatcttaagtcaattttcagactcacgatactcgctacgcctcctcttcctctcaaatgtttgggaaccctatcagagcagtcagagaaaaaacttgaggaatctcaggaaaccgctagatatgctgctatttctgtcacaatgagttattcacatttggggaatagtgagaacatgtgtagggatccttag

SEQ ID NO: 55920 - DNA, 348 bp, Glycine max
  Peptide Sequence Number=SeqID_147605
atggcatatcatgctagctcaaaagccaatcaaaattcaatgaaaaatcatgaaattcattttggcaagagctactcaatagaaaactttcaatgggaaccagagctacaaccttactatcaaaatgaagcagaaagaggttccaatatggataaattgttgatgcaattcaaggaaacaattaaatcaactcaaggagcactccaaagtgtagaaatccaggttggtgtgctggcagaagaagtgactcaatttatgatgagacgagaaaaatactttgtaaaggttgaagctcaagaggaaaaccctgtaaaagagcatgagtcaagagaaaaagatgaggaataa

SEQ ID NO: 55921 - DNA, 321 bp, Glycine max
  Peptide Sequence Number=SeqID_147606
atgtacctctcttgtctcagtgacaacaagccaagtagatgtacctctacttgtaccacaaaggatgtaccctccaatgtgttaagacaaagttctcaggcggttagtcctttgaaactttgtgaagcggaaacaaaagatatctcaggcgaacaaggtttggaaaccataaaacttagaaggcttttggcaaaggaaaaagaagaagaagaagatattcaaaaagtatttttgaatgcaagtcaaggtcttgcttttatagactcttcatgtctggtcaagaaaaccactagaggagttataaccttgagaaaaacctga

SEQ ID NO: 55922 - DNA, 814 bp, Glycine max
  Peptide Sequence Number=SeqID_147607
atgacacaagagtgtgagttgagactagatgacacacaacacggcgacgcggtgcggtggttggctgctcgagagaagcttggaagccgtgagtaccatgagccactacccacgaggtccacaacgagattgagagaagccgcgagtccaggctctgtgttccattttagtatgtatgggagtgggaatggatcaaattcatcaaatgccaatacagacacatccacaggttcagcaagcagaagcaaaaatgctccaggaaataggactgatattgggtggaagcatgggacagatgttttagggaatggtaaaaaagttaagtgcaactactgctcaaagatcaataatgggggaattttcagattcaagcatcttcttgctgggactagatgggattctaaaccttgtgcttcagtgcctgaagaagttaagatgcttatgatgaacgtttgttacagaggtactgagggagtggagtcaaatactagtcaaagtggaatagaacagaaagggatgcttgctttcaaaggaagagcaaaagccaaatttgttaaagctagtgacatctcaaaaatagctgacatagtgttgaagatgttggatgatgtagtgaattttgttggagaggagaatgtagtccaggtgataactgataatgctgcaaattacaaagcagattttgagaaacatttgaaggctcatcagactactataaagaagggaagaaggattaccacctacatttatggtagaacaatgttgattagcatcatgaagaagttcacaaatggaagagacttgattaggcctg

SEQ ID NO: 55923 - DNA, 207 bp, Glycine max
  Peptide Sequence Number=SeqID_147608
atggccaaattccatttctcacccaatgcaccaccatattggtcactccgactccacccagctagcaggcctatgatcaatttttggcacttattcctgggactcaaaagcctaagtaacagtggaaacttggctccttttgctttcaacttcagtcgatcttttgagcattcgattgaaaggggatgcacaatgcataacttttaa

SEQ ID NO: 55924 - DNA, 87 bp, Glycine max
  Peptide Sequence Number=SeqID_147609
atgatatgtccatcacgacgctatgaagagatgcatcatgcgatcaaggaacaagccagaggactatcagtgacaatgcatcactaa

SEQ ID NO: 55925 - DNA, 525 bp, Glycine max
  Peptide Sequence Number=SeqID_147610
atggccatgcccggtgagccatttgtgaggatcgtcatcattaatgtcgacccaagtaaggacatcatggagtccattcttgatgctgttcacctaggtcgtgcctacctcactatccttaacacctttggcacagtcaccatggtgatccttcataactcgctccatgtcgttgccaccctaacactccatgagcccttcaccttgctttgcctcaacggctcatacttattgaacaacaatttcaaccttaactttagagccattattccccctcctttatcttttgggatccacctctccacctctcgaggccaagccattggtggtgccattggcagccaagtcattgtcgatggcaacgttaagatcacgctctggaccttttggcatcctaagatttacaagtacattcctgaaggaaacaaaggtgaaaatgacgacaataacaataaaaaaaagaattacaacaataaccctattgattgcaataggggtggaaaccaaatcgggttcaacatttag

SEQ ID NO: 55926 - DNA, 393 bp, Glycine max
  Peptide Sequence Number=SeqID_147611
atggttgacgccgtagtctctgtcgtcgtcgtcgccggctatgagaccgtgccgattattctgaccgaaactggctggccgagctccaacgctgccgctaacgagttcgacgcgaatttaggatatgttgagatatacctcaaggggctcgtgaagcatcttaaatctggaatgggaacgtcgttgctcaaagacggtgtgacagaggttttcatttacgagatgttcgataaggaggaaggagcaacaaggaggagctggggggttctctaccctaacggaactgcaaagttccaccgcgttgatttctcgtgctcctcggttgcttttgggagtcttcatatcgcggtgatgatcatcagcttcttcttatcgcttttggttattgtgtga

SEQ ID NO: 55927 - DNA, 186 bp, Glycine max
  Peptide Sequence Number=SeqID_147612
atggcagaacacggcataagaggaagaagtagctggaactcgccttctaatagatggaaggacttgcttgcttcagatatttgttcctcacatgatatcattgaggcttacttgttgctggctgctgagtcacttaggccctgggataggggatatgtaccgtgcattcttacacaaactgaatag

SEQ ID NO: 55928 - DNA, 861 bp, Glycine max
  Peptide Sequence Number=SeqID_147613
atggaatacacttcaaagttggaagatcttttaaaggggtatcttgaaagcacacaatcaggggtcagtcacccaccaccagtaaattgtgatttttggggagaagaacatttcaatgacaactgtcatctctactccatgaaaaattcttggtggggacaagagttacatccttacaatcaatatgacgaagaaagaacttctaatttggatgatgtgtttagggaattcatggcatatcatgctagctataaagccagtgaaaacccaatgcaaaaccaagaaattcagattggcaagagctactccatggaaaattgtcagtgggatcaagagttacatccctacaatcaatatgaagaagaaataatttctaatctggaaaatttgttgatgcaagtcaaggaaacatatgaatatactcaacacacatttaaaaatctagaaattcaagttggtaagtcagcaaaagaagtggctaaatttatggtcacaagggaagaaaactttgtaaaggttgaagttcatgaggaaagtcttgtagaagagcacgattcaagagaaaaagatgaagaaaaaagtgcggagatgacacaacaacaatgggaggagtcctcacatgtagatagtcaacaagaaagcattctccaagtcaatatccctcctcatcaactgattgtcaagaaagaaagacatgaagaacatgataaatctttaagtgtctttctctccttgaccaccagcacttctcttgcaatgatatggaaggtgtttccgggatacatgagtttcaaagagtctctagctaagaggcgaaaatgcaaagaagatgtgttctatgtgaccttcatgccaccttga

SEQ ID NO: 55929 - DNA, 234 bp, Glycine max
  Peptide Sequence Number=SeqID_147614
atggaatgtcaacctacgacacaggcccaaaagaatgataataagacggtgtgggctgggtccaccaaacataaacttcaacaagatagggtcaaaactctggttcttcaaccgacactagacgatagtagaggtagccatagaaatgatcaacatgatgtgaatcattgtgctccctttacgagtcatctcctcaatcaaaagctagagagtcggcctcacatgtggaattag

SEQ ID NO: 55930 - DNA, 228 bp, Glycine max
  Peptide Sequence Number=SeqID_147615
atgaatcaccggcgaggagtgtgtgaatcaccatcaggaggtgctctaaggcctcgtaggttgggtccaactcacgggtcacgcaggctcaggagcttgatcatggtgtatagccaccgctttgcctccggtcaattcccgtcgtccatgatggttggaactcttgaaaacggattagggatttcacattttggggaacgagggcagtttcatcatatcaatttctaa

SEQ ID NO: 55931 - DNA, 204 bp, Glycine max
  Peptide Sequence Number=SeqID_147616
atgactgaagcacgtcaaaaggggcaatttcgagagaataagaagtgctacgaaggccgaacccctttcttcttcactcctcctcctatttatagcaaaataggggaggagcttgccacccagctcgcccaggcgaacaaggttgcttcctccaaaagcaacagccttctggaggaagaatctggaaggcccaagtggacctga

SEQ ID NO: 55932 - DNA, 294 bp, Glycine max
  Peptide Sequence Number=SeqID_147617
atggcgtcagcaatcacctgggccacatggacgctcatccgtgtcaggatggcatacaacaactggcacttaggtagagggagcagtgtcatccacgtctgggtcaaagtggtcatgctggtgcgcatgatccgcactcgcatccctgcagcggtccgggcaaaatcctgccccggtgtgcataacagttgggcaacggcctcctcgtcgaacccgttggccctgttcctcctctggataaactcacattgttggccttcctccagaactagcgagtcacccagaactggctga

SEQ ID NO: 55933 - DNA, 234 bp, Glycine max
  Peptide Sequence Number=SeqID_147618
atgaaaaagataccaaaagggaggggcaaaagggtcattttagggaactttgatgttaagcatgaagggaggctgatcaaagtgttccaaggttcagcattgaaggatattgagaaaattgagagagaagaagaagaaagaagagaaaaggaagccgaggcactaccgaatcgtgacgatcatcgaagcctacatcgttccttgttcggtgttctttgggtgactatcgattag

SEQ ID NO: 55934 - DNA, 246 bp, Glycine max
  Peptide Sequence Number=SeqID_147619
atgttggttcctaagttgcggttctttgttgttgggggtttgaaaacaaaaggaaatgtggaagcaatgccttccaaggttattttgatgatggcaaagaatcaagagttaagcaaattccaaagattcaagaatcaagattcaagattcaagattcaagaatcaagtttcattcaagaatcaagtttcaagaatcaagattcaagaatcaagaatcaagtttcaagaatcaagattcaagaataa

SEQ ID NO: 55935 - DNA, 788 bp, Glycine max
  Peptide Sequence Number=SeqID_147620
gcgctcttgctcgtcgatttcctcgaaatgtcggcgccagcaatcctaatcccaatcctcgtcgccaccgccaacgtggacgcgatcgtcagcggcagcgttcccgagggacttccagtaggaatcgactcggttggcgacctcggagaactggtgcagcatggagtcctagccgctgcgtttggcgccggcactgcggtcgtcggaggaggaagaggcgaggcagcgttaggggggttacgatgggaacgagaggagcaagggcgtccgttgtgcggggaacggaacggcaagcttctgcgtcagaaagggttcaaggcaagaagccttcaaattgctctagcgaaagcttcaacgagcccaagagttaatgaagaaggtaaacccataatccagcccatgactattttggatcgaaagtgggataattctaccccaccaaagcctctggtacttgtacaatggctaaggctaagtcctaaagactctacttgggaaaactgggctgaattgcaagacacataccaccttgaggacaagggggtactttcgtacgtaaatagtgtgccatgcaggacccaaaccgccattgccaatggcgagtttggtgtcactgagcaagttgcaaatggcactggcgatacggttgcaggaggtgacaggagctttaaaggggagttgcaactgccattggcgagttgcctggaagttgcaactcccattggcgatttagggcacaaaatagccatcaccagtggcgattttatgcctatatatacgtttcagct

SEQ ID NO: 55936 - DNA, 264 bp, Glycine max
  Peptide Sequence Number=SeqID_147621
atgtggcctctcccaagacatttgaagcatttaatgttgctagtccttgctttggaactagtcttaagggtgaatttctctatggtcttacccttatcttccttggattttgaagaatcgaaggctgaaggaagcatgggcgctaagcgaggcgttcagcacaaaagcgcagaatccattactcgtgctaagcgcgaagcatgcgctaagcgtgcgatccaacagaagcacatgctaagcctgcaacacgcgctaagtgcatga

SEQ ID NO: 55937 - DNA, 516 bp, Glycine max
  Peptide Sequence Number=SeqID_147622
atggggtgttgggccaatctaaataatggaaattgcagaattcctaacaaggtagtggaaaaactgacccaaatccagaggaggttcctatggggtggtggccttgatcagaagaaaattgcacgggttaaatgggactgctggctcatggaacatgaacctttaagggcaaaatatcccagattgtgtaacatatcctgtcaacagcagaagcttattcaggatatgggatgtcactctgcaaatgtttgggaatggaagcttgaatggagaagacacctttttgacaatgaggtgcaagcggcaaccagtttcttggatgatatctcgcggggtcatattgatcgttggacatcagactgctgggtttggaaaccagaacctaatggcaagttttctacaaggagtgcatactgtatgctactagaaggagcagcatatcagactatggatgaggctttagaggacctatggcagctcaaaatccctttaaaaccaacaacatttgcttggtga

SEQ ID NO: 55938 - DNA, 261 bp, Glycine max
  Peptide Sequence Number=SeqID_147623
atggcttatggacatgattttactgtaaaaacaaaagttgaaaggaaagatattgagctggtagacgaggaagaagcacagattggtgctgatcattctagtgcaacctctaataaagctgagatttataacgaggaagcacgaaatgcaacacagaagcataagccaaagagggtggagagtgtcaatgctgatgcagaagcctttggtgatcactggaaaattctgattgctttatgcattctgaagctgaagcactag

SEQ ID NO: 55939 - DNA, 1329 bp, Glycine max
  Peptide Sequence Number=SeqID_147624
atgacaaagtggtggaattacgagaattacgtgcaagcacttgtcgcctctgcgggaaggtgcatcctttcgctgcttccccggtcggggaaccgtcccagttattatgacccttctgctttagggggagcaaggaggagtattggcagggatgttagggcatctcctcattgtgtggctatagtgatgggtcgccattgtccctacctgtcgttgttggctatgaatggcatcactgctttgcaacacaaagtcaaattgactagctctaaggactcctgcaagatagtcattcaggcttgtgggagtgatgacttccctttttttagggcagcgtcaagcagtcagcctttctttttcatgtacaggtgtcggtttgaggtcttgggtctgatgaaattgactggcaagaatggttgggtatccttaaacagcatgtccaagaagttgttcgtgttcgactcaaacaacttttgtcgtttcttcaaggtcctgactattaaagtcatggctaatggtttgccattgatgttcaactgggatgggagcactgctaactattttactagtattctaagcccacaaggtattatgggcgactttattaaagaagggagtcaacctattgttgaggatagccttattgctggtgttgttgaggtctccccgagcacttcttcctctattttgggtaagaggaagcgagataactgcactcgggtgttagaccataagaattcgagggcccctttaagcctttgtgcactaaggcaagctgcaaggttaacacctggtttgggtcgcccttcgattatgcaagatctacctctgactccattggttgtcgaagcttttgctcatgttgctgtttgttactcctattcctccacctcttcctgttgtgcttgttcaggataccacagctaccgctgctccttcgttcactacacccttgttgagtcctggtgtggcgaccacgagtgctcctatgatgtcacctcctccttctttagctccactagttcctccctctattgcgttggtgtcggggtcgacttccacttcttttcacccacctttcccatgtttccttggaccatatctacacctccaacgatgttgattccctatggggtatggggtacaagcctgaatagaagaccccgattagctttgtgttggcctttgacaaaaatctcatcgatcaattggggtctaacatgttacaaattatgccaaggtctttcttcagcgaagtctggcaattttggaagaaaatgggcaaaggcaccaagaggtgttaaacaaggtggcatctttggagggtaa

SEQ ID NO: 55940 - DNA, 372 bp, Glycine max
  Peptide Sequence Number=SeqID_147625
atggagtgtgaaggcgacaatgccatggagcgagttatgcagggtcaccttggtgactgtgctagaaatgctaagacctatgaggttgacgtgacctcgatgagcaatttcaagaatagactttgtaatgtccctatccgagtccacattgatgatcacaaggctcacaaatggctcgctgagctgggccatggggaaggaaatggtcttgcgcttgttcttggagcttcatggcctgccacgtggattcttaggaggtgggggtgggagaaggagattctcttggggctgatttgttgcgtcaaatggtggtggtggatggtgggagcattgagaggtggagccagtgtgtttttccaaaaaggatgttga

SEQ ID NO: 55941 - DNA, 213 bp, Glycine max
  Peptide Sequence Number=SeqID_147626
atggatgattttagtgaggatgaggatcaaaagttctttgatcacatcaatcaccaaagcgatgaccaaagtgatgaccaaagcgatgacgagggtgttggcagaccaatgacacctccgtcacctccattgcaatatcaccaaactaggtgtccaatagacttgaactttgatcacctaccacactgcattgatcgacatcattttgtttaa

SEQ ID NO: 55942 - DNA, 342 bp, Glycine max
  Peptide Sequence Number=SeqID_147627
atggcaccactagtgacttggcctcgagagttggagagattgatcctgaaggataaaggaaggggaaggggtcaccttggtcattgtgccagaagtgctaaggactgtgaggttgacgtgacctcggaaatgatcttgcgcttgttcttggagcctgatggcctgccacgtggcttcttaggaggtggggatcgagaaggagatcctcttgggactgatttgttgcatcacgtggtggtggtggatggtgggagcattgagaggtggagccaatgtgaggtgtatggtatgggagatggacaaagaaatgttagggtgtatgaagtctctagagatgcttag

SEQ ID NO: 55943 - DNA, 489 bp, Glycine max
  Peptide Sequence Number=SeqID_147628
atgaacttgcccaattctctccaagtatgctcagcatcttcgagggtgatgcaatcctatctcgcaagggcattggatagtaaactccaagaagattgggtcagagatgcaagagaagatcttagggctataaataaaggccatgtgtgtgcattttttcaactttggtcatttgaaaattacacttcaaagttcagacctcaattgaggtacaaaatttcgggctccttctcttcgtctccctccactcatcatctttttccttcaagctcttatccatggcttcctatggtggtgaacttcttcttgactcatcttctccttgaagtggtgtctccaaccatatttcttccttctgcattccgctgctatgatcttcaagaagcaaaggactccattgatgaagaagatccaaggcctacaagctccacatggagctacatcagaagggtcatgggagaagccagattcttcaaccgcaccatctaa

SEQ ID NO: 55944 - DNA, 384 bp, Glycine max
  Peptide Sequence Number=SeqID_147629
atgaaggctgacatggaggccatgaaagagcaaatgaccataatgatggaagccatgatgagtatgagaaaaatgatagaggtcaacacggctacagtcgttgcagcaagtatcgctactaaggtggacctgactcacccatctagcctcaatcaaggagctgaagcgttaggaagtacaggcggcccccattttatgcaagttcaaaacaagcattccttcccaccatatgggttgcctcccaactatacatcacccaatgttgcacacgctcccgatgagaatgtcaataactctactcccatactcattgagagccaacaacctcaatctggtcatgcacaggtccctcaacccatggaaaagacacataaagcaccctga

SEQ ID NO: 55945 - DNA, 396 bp, Glycine max
  Peptide Sequence Number=SeqID_147630
atgacatactttgtacattgggatagctacagtccaaatcaaaaccatccccttcatggtcatcatcatgcccatcatcatcgtcatcgaaggactctacacttgcttcataattgggtggttgttgttgttgaaaaagagccttatgcttactggaaaggtaatccagctgttgctgaaaccagacaagatctcattaaatgcaatgtttatgaaaatcaagattggaatgctcgtttatttgcccaggttcctgcaaataccgacccttgcaccatgcctgccccttttgaccctccaactttgtatgcaacattagagagaaaggaaagctcaattcaacaagttgaatcatgggagaaaagttattgggataatcaaaccataacatcttaa

SEQ ID NO: 55946 - DNA, 715 bp, Glycine max
  Peptide Sequence Number=SeqID_147631
gctacacgccctcactttgggtactagttaccctcaacgtcagaggactacacgtcctcgccttgagaggactacacgtcctcaccatcagagggctgcacgccctcacctccagaggactacatgtcctcgccttgagagggctacacgccctcaccttggaggactacacgtcctcgccttgagaggactacacgtcctcaccatcagagggctgcacgcccttacctccagaggactacatgtcctcgccttgagagggctacacgccctcaccttgggtactagttaccctcaccgtcagaggactacacgtcctcgccttgagaggactacacgtcctcaccaccagagggctgcacgccctcacctccagaggactataagtcctcgccttgagagggctacacgccctcaccttggaggactacacgtcctcgccgtcaaagggtcatgtgccttcacctttgtagggctacacgccctcaccttcagaggactacacgtcctcacctttagaggactacaagtcctcgccatcagaggactacattttccttttaacggttcctgggccccccctgatattggaggagggccaactgtgcaagcacaaccagaaagggaggctatcacacagctactatgcataccggggcaagatttcacccgtgccgctgcaaaagacgagtgcggatcatgcgcactaacatga

SEQ ID NO: 55947 - DNA, 114 bp, Glycine max
  Peptide Sequence Number=SeqID_147632
atggcacatggacgaccaataggcgaccaagtccaaagccaatgtaggacacgcctagttgttcatgatcctaggaatttaaataaaacaagcacaagctcggaaggtagatag

SEQ ID NO: 55948 - DNA, 942 bp, Glycine max
  Peptide Sequence Number=SeqID_147633
atgacaggggcttttgctcatggagctatattttttattagagattataatccagaacagaatgaagataatgtcttagcaagaatgttagaccataaagaagctatcatatcccacttaagttgggctagcctctttctggggttccatactctgggactttatgtccataatgatgtcatgcttgcttttggtactccggagaaacaaatcttgattgaacctatatttgcccaatggatacaatctgctcatggtaaaacttcctatgggttcgatatacttttatcttcaacgaacagtccggcgttcaatgcaggacgaagcatatggttgcctggttggttaaacgctgttaatgagaatagtaattctctattcttaacaatagggcctggagacttcttggttcatcatgctattgctcttggtttacatacaactacattgatcttagtaaagggtgctttggatgcgcgtggttctaagttaatgccagataaaaaagattttggttatagttttccttgcgatggcccgggacgagcgggtaatgtttcacagttaatgatcttctacctatttgatgggatggttaagagattatctatggttgactcttcacaacttatcaacggatataacccttttggtatgaatagtttatcagtctgggcatggatgttcttgtttggacatcttgtttgggctactggatttatgttcttaatttcctggcgcggatattggcaggaattgattgaaactttagcatgggctcatgaacgcacacctttggctaatttgattcgatggagagataaaccagtggctctttccattgtgcaagcaagattggttggactagcccacttttccgtaggttatatatttacttatgcagccttcttaattgcctcgacttcgggcaaatttggttaa

SEQ ID NO: 55949 - DNA, 801 bp, Glycine max
  Peptide Sequence Number=SeqID_147634
atgggtcaacttcaacggcaagcattccgcaaagcctatggtaagatttgggacctagctagggtagaagtctccatggaaccgattgcatccctttcccagtattatgaccagcccataaggtgcttcacatttgaggacttccagctagtgccgactgtgaaagagtttgaagaaatcctgggatgcccactgggaggaaggaagccatatcttttctctgggttctatccctccacgacaagagttgccaaggtagtgaaaatctcggcgcaggaattagaccgccaaaggcaagtcgaaaatggggtgttcggaataccgagaaaatatttggaggtaaaagcaagaatcttggcagataaaggcgagtggaccccattcatagatattctcacactgttgattttcgagggggtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaaggattgtttgctgtactccagctctcttggtggggctggtttcacacctttttctccaagaaggcaggcccgtctatccgctacaaggttaccactcgtgcttcgaaaaaggaaaggcgaattgggaccaactcttggctagcatgggggggcgtctgttaattggttccctcgctagaaggaaggaagaatcaagattctatcttcatgcgaaggatgtccaaatgttcccttga

SEQ ID NO: 55950 - DNA, 555 bp, Glycine max
  Peptide Sequence Number=SeqID_147635
atggccataatgatggaggccatgatgagcatgaagaagataatggaagctaatgcggttgcaattgccgctactagtgttgttgctaagcacgccttcctgccatatggcttgcctcccaactatacaccacccaatgtggcgtacactcccagtgagaatgtcaataactccactgccatactcattgagagccggcaaccccaaactgatcgtgcacatgtctctcaaaccatgggggagacacatgaaattccccaccacaatctagccgacttcgagccttgcctcggatatgccactgaagggcaagtagttggtggtatacccctgcaaaacactttggagggccctcaatttcgcccccaaccacaacccttgcattccacagcgggtaaaatccctcttgttatggaagaaatgggaaaagttggatcatctagaggaaaggctagggccattgaaggaggtagagattatgcctttactgacatagaagagttgttcctagtacccaaacgtggtcattcccaagttcaaggtgcaggactttga

SEQ ID NO: 55951 - DNA, 786 bp, Glycine max
  Peptide Sequence Number=SeqID_147636
atgtcttcaaggaaaagaaagagtgtcagttcaaggcccactgctcaatacgatacacgaagattccattcctttgaggcctggaccagatatactgacaatgtgttgggaagacacatattagctgagaggaaagtggaaatctatcacacagagctggatgaattcaagggcgagctagagaggcgtaactttcacaagcgcctcaccaacttagctgatagtagcattgacctcgcgttggtgaaggagttcaacgccaacctttacagtcccgagggaccttcacctgaacaagtcagaatccagggccacataataaggattgatgcaggtaggctcaatgcctttctagaaacacctgtggtgcttgctaagggtgaatctttgctcgcctactcaagatattgcaggatgcctactgacattagagaaattgaggctgcactgtgcatacccggccaagggtttattctaaatgctgaaggtcactcggggaatatcctcagaaaagatctaaccacccttgctcaggtctggagtgttctatcctactccaacctggctctgacctcccacacatcagatctgattatggatcgagctaggttaatctttggcctagttactcagctggacatgaatgtcggagccctcatttttgggcagattacttctatggcccagtctaactcctcaagactcagatttcctactcttatcgcaactttatccaggaccaaaggagtttcctctaacagtcttgtctttgaacgtctgagcccg

SEQ ID NO: 55952 - DNA, 759 bp, Glycine max
  Peptide Sequence Number=SeqID_147637
atggtcattgaccaatccctattctatgacttgacccaattatctagtgaaggtgtaccatttgaaggtacactgaatgatgattggaaatttgatttctctgtgcatgatgcccgccggttggtttgcaccaaccaagcggatatgaccggaaggcttcttgccggttcattggcttttgaaagcgacatccttcattatctcattgtgcgtattttgcttccaagatcttcaaaccttgcacaggtttctgaggaagatcttattgtcatgtgggcttttcttacaggccgacaaattgattggtcacacttagtccgatatcgcttgcataaggcattgcaattaaatgctccattgccatatccacacctagtcactctcttccttcaacactttaacatccctcttgattctgaaccctatgttccaatcaagagatccttcttaatcggtgccgctgtgattgcattctctggttaccgtaaagagcatgatggctcttgggtaaaaaagggtgctcaacccattgatgaagaaggaaacttaccagttggagaagattcctctcttcttcaaaggattttggacaggttcgatggtcttcaaacctttgttggtgaaaggtttgatgctttggagttacaagtggacatgcgatttgatgagatggattcaaggatcaccaaggttgaaggagatgtctcttacatccgcacatgctttgatctaccaccaccaccaccaccatcatcttag

SEQ ID NO: 55953 - DNA, 249 bp, Glycine max
  Peptide Sequence Number=SeqID_147638
atgagtgatggattttgcggtactcatttgcagatcatggttaggaccagaggattaggtcgtgccttaggtcaggtcactcgtagaggtgtgggcagaggagatcatgatgattccaatgatggtccacagtgtcgacgacctactgcatccgcacggaggcagcgagtcgctgtgactgcggatcacgttgaggagccaatcatccctgacccagacattcaggatgacccgatggaggcaccagct

SEQ ID NO: 55954 - DNA, 556 bp, Glycine max
  Peptide Sequence Number=SeqID_147639
gatccccgaggaacgccccagaaatcagttcaatagagatcaatgtggaccatccacaaggccacaacaacaagggcctagtctctatgatcacacaatgaagctggaagagactttagctcagtttatgcaggtttctatgtccaatcagaagagcacagagtccgccataaagaatcttgaggtccaagtgggacaacttgcaaagcaattggcagatagatcatcaagcagttttatagctaatacagagaaaaatcacaaggaggaatgtaaagctgtgatgactagaagtagaatggcaatccaaggaaatgataaacttaaagaaattagtaaggagactgaagatgacatggaagaaaagacaccaataaaagagaaagaaaaagaaagaataaaagaagaagaaaaagaaaaagaaaaaaagttgaaaaatgaaaaacataaagagaaagttgttgatgatgagatgaggaaaggcaagagtgaggcaaacactgacaagaagaaggataccactccaaatgaaggcaaggaagtaccttatcctttg

SEQ ID NO: 55955 - DNA, 1146 bp, Glycine max
  Peptide Sequence Number=SeqID_147640
atggcgagccaagagaagtggggcccgtttgcgaatatactagctctgttgatctttggggttgtcctctttccgaatgtggacggttttgtggacttggccgcaattgatgctttccgtgcatatcaccatagcaaggagagtccagtggtggctatcttggtggacttatttgatacctttgatcgaaggtgcgagaaaaatagcgcacggattgtatgttgcttacccgctctctgtgtgtggttggtttcgcacctattccaacaagacataagacacccgtgtccgcttcaaagttatcgctcgtgtgtcgaaaaaagaagagtcaattgggaccaacacttggctgggataggaggcagcgcaaacaattggtttcctcgatggaaggaaggcaaggagggagttcttttctcgtgtggggactaccctaatgttccgttgatagggacgaggggttgtattaactataatcccgcccttgccataagacagctagggtaccccatgaggggagcgccaacagaagaaagtctctcgcctttccttgtgagggatttaggcgcgcaaagtctcaaggtgatacaaagagtccacaaggcgtggagaagtccgttgaggaaagacaaggagcttagaggcatccgtaatggcgtcatcggtggttatcatggatggctaagagttcacacgcaagggttagattggctctctaaatttaaagttatcgatgaggagaacttcgaagctccggaggaagatgaggaagtccaagctctaaaattagagttagggaaggcaagactcgccaaagaaaaattcaagtcagccgctacacacatccggaaggagtgcatcgagttacgagaggaaaacgcggccactgcaagagcccttgaacaagaaaccaaaagggcccgcaaggaggaacatggccgagagaaattccaaggagctttgtggggtagcaacaatgagctcaagctccgaagagaggaaagagaccagtcacgggtgcatggcatgatcttaaaagaagagttagctgcttgcgcaagatccaagaggagtttggctcaacacttggaagccacggagcaaagcatgctagctatcataggggccagtataaggaagagttga

SEQ ID NO: 55956 - DNA, 309 bp, Glycine max
  Peptide Sequence Number=SeqID_147641
atggcagtgcagcagagctcgtcagtggccaaatcgcaaatggtaatggcgatttgccttgcccacggatcgccagcatggctggcgggttgccttcgttgctgcttcttccattataaaacctggagcttcgagagtgcacagctgcacttccttctttgcttgttcttcataagtttctcctgcattcttcatttggttgctgtcttttgtttttgggctatggtttgtttcactccttatacgtggtttgtctcatcttctcctcttcatattgcgcgtgacttctctgtacttgatataagttag

SEQ ID NO: 55957 - DNA, 339 bp, Glycine max
  Peptide Sequence Number=SeqID_147642
atgctaagagagtcggagcaaccggggcaaaaaggaaggaaggagatacctatgccattacttcggtgcccgcatgggtcaagcctccacagacctcttatggtacgcatcagtacgcgcaacatcttccgagcttttcagctcgcgccgggaacttctccaattctgcacccgtacagcctaaggcgcccacccccatctagagggaggcccccaagctccggctccaaccacgactcgcccagccggcaatgcctactttggctccggttccaatgcgatgaggaactttcccccgaagctaattccagaattcaccccactcccaatgacgtatga

SEQ ID NO: 55958 - DNA, 249 bp, Glycine max
  Peptide Sequence Number=SeqID_147643
atggatattgaggaatccattcatgttacctttgataaatctaatgctatcttgtcaagaaagaatatgctagatgatattgccgattctttagaacaaatgcctaatcatggaccagattctaaaggaaatggtaaaggaaacaatgaagatcctccagaagaagtcaaatccaatgatgaacttccaaaagatcatccccttgacaacattattggtgatatctcaaaaggggtaacaactagataa

SEQ ID NO: 55959 - DNA, 618 bp, Glycine max
  Peptide Sequence Number=SeqID_147644
atgggttcgatgagaaggccatcgcccatttgctatgtataccagggcaggattttgccccggactgctgctgggagacgggtgcagatcatgcgcaccaacatgaccaccctgactcagatctgcatgactttgctgctcagcaacatccagcccagcgaccataattccgacctccccctgccgaagtgtcagctggtgtacaccatcctgatgcggatgagcattcacgtggctcagttaatcgctgatgccatctatctatttgcaggtatggcgcctaccaggcaccctctggacccggataagtccaacagggccctgggatttcccgccttgatcacaggactcttccagtcgttcggagtccccgtcgcacctagcaaggtgattcggccgcccatcacccgagcttttattgagaagtattgcacacagagacaggcccagggggatgctccgcaggccgcagacgcgccaccacctcatcaagctagtccagccgattcgtttgatacggagcagtatttgcggcatttggttcgccaggaggcggccaaccaccaggctcatgtacaaactcatgattgtctttaccagatgagcctcagcctgtag

SEQ ID NO: 55960 - DNA, 750 bp, Glycine max
  Peptide Sequence Number=SeqID_147645
atgccaactttcctgaccacgctgcggctggacagccggctcgccgaaccgctgtaccggcagatttacctgcggattaaagacgccatcgcccagggcagcctggcggcgggcagccggttaccctcggtgcgcgggttggcgagcgagctgggcgtggcgcgcgccacggtggaaagcgcctacgcgcaacttattgccgaaggtttcttgcagagccgcgggcaggcgggcacctatgtttcaccgcagctgccgcacgtgccgccgggcgcggtatccgccgcgccgccgctggcggcgatagcgccggatccgctgcagccgcagggcatgctgcagcctttccagctgggcgtgccggcgctggatgcgtttccgcgggcgctgtggcagcgcattgtcgcccgccggctgcgcgcttccacggtggcttccctggcgctgccgccggccggcggcctgcctgagctgcgtgaggcgatcgcccattatctgcatttgtcgcgcggcatcagctgtcggccggaacagattttcctctgcgccggttatccggcgttgttggattgggtggtggagacgctgttgcacgccggcgacgcggtatggatagaagatcccggctatccggttacgcgcccgctgctgcgggccgccggcgtcaggccgctcgccgtgccggtggatgaacaaggcatggacgtggccgccggtatgctgacggcgcccgaggcgcggctggcggtg

SEQ ID NO: 55961 - DNA, 570 bp, Glycine max
  Peptide Sequence Number=SeqID_147646
atggctgcctttgttaggcagtatcagtacaattttgatatggttccggataggatgcaagtagagaacatgtgcaaaaagggggacggatcattcaaagaacacgcccaaaaggtggagggatctggcggcccaggtggtacccccaataatggaaagggagacgataatcgtgatggtagacacattatcgatttggtcttcgccagtgaaaggatcaatgtgggtccaaaaagaggcaaatttgatcatcctactaggacgactgagaaaactggggcaaataaagagggtgaggatgagggagaaacccatgctgtaactgccattcctgtgcggccaagtttcccaccaacccaacaatatctttactcagccaataacaaacttcctccttacccaccgcccagttatccacaaaggccatccctaaatcaaccacaaagtctgtctaccgcacttccaatgacgaacaccacctttagcacaaaccaaaaacaccaaccaagaagtgaattttgcagcgagaaagcctgtagaattcaccccaattccagtgtcctatgctga

SEQ ID NO: 55962 - DNA, 689 bp, Glycine max
  Peptide Sequence Number=SeqID_147647
cggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccaaaggcgagggggtgcagccctctaaaggcgaggaagtgttgtcctctaaaggcgaggacgtgtagccctctaaaggagaggacgtgtagtcctccaaaggtgaggacgtgcagtcctctgaaattgaggacgtgtagtccttcgaaggggaggacgtctagtcctatgatggtgagggagtgcaatcctctaaaggcgagggcatgttatcctcaaaaggtgatgacgtgtagccctttgaaggtgaggacgtgcagtcctctgaaggtgaggacgtgtagtcctctgacgacgagggcgtgcagccctccaaaggcgaggatgtga

SEQ ID NO: 55963 - DNA, 447 bp, Glycine max
  Peptide Sequence Number=SeqID_147648
atggggacaaatcaaaccggcaagaggttttaccaagtcaaggttaaaaacctagataccaccagcgtcaaggaattagggcggttgatgggacctctccaaatgcaagccttccgcaagacttacggaaagatcttagagttgaccttagcagaggggaagaaaaccatatctttcatccgggtgtctcctctctttgagcagaattgcaactgtggtcaaggattcagcaagaagtttggaccacataaaacagactcggaacggcatagcgggcctaccatgggggtaactagaagacaaggcgaggggtatgcccaatcaaggagattgggtcccgtttatggatgtgttagctttgctaatttttgggatcgtcctctttccaaacgtggatggtttggtggacctagcagcaatcgacgctttccttgcataccaccatag

SEQ ID NO: 55964 - DNA, 252 bp, Glycine max
  Peptide Sequence Number=SeqID_147649
atgaatatgctaatgaatgatcagggcacttggatccacctcaagctggcatgctttgctccgtggcttctaagtgttgggccaaaactcctcttggatcttgagcaagcagctaactcctcctttaagaccatgccatgtactcgtgactggtgtcgcaacctacccttcggcgggagggcgacgcgtgactcgcgggatgcgggttccacgaaaggaatacgcgcggagtcgccaccaacgtttatttga

SEQ ID NO: 55965 - DNA, 238 bp, Glycine max
  Peptide Sequence Number=SeqID_147650
tatgagaattgtcgaaactggaaatccaaggttcattgaaaatggtgaaatcagtgggagtgcagttccacgagaagtggaaattaaagaagttagagtgcaagtccttttagtttatgcctctagcagtaagactaaacgtgactctcatggaaaccttgaacgttacaaggctaaacttgttgctaagggatttactcagaaagatggcattgattataaagagatgtttttaccg

SEQ ID NO: 55966 - DNA, 589 bp, Glycine max
  Peptide Sequence Number=SeqID_147651
ccttccagtcttttgaggtggtaagcatggcctctgtagattccttctctgggaaacctggcctgtccgatacggcagtaatggtggcccgagtgatgttggggaatagttacgagcccagaatgagtttaggcaaggacaacgacggcagaacctgcctgataagcgccagaggaaaccacgagaagtttgggttaggctataaacccatacaagcggacataaggaaaagcgttgcaggaaggaagagcggaggtcaaggcttgcgattggtacaagaagtcgaaggaggcccgccctgccacatcagtaggagctttataagcgcgggtctaggacacgaaggccaagtcgttgtgatatgcaaagatgattctccgagtgggtcagttttggtacgaccatgccctcctggtttccgactaggaaattggcgagtggaggagaacccagacatttacgcaacaagcataatatccgacgacgagtccctagaaggtactaatacctgggacctgaccatcgatttcgagcaagaaacgaatcaaacggaggatgaagaggacgaggatgtgggacttcccccgga

SEQ ID NO: 55967 - DNA, 103 bp, Glycine max
  Peptide Sequence Number=SeqID_147652
cgcacccgtgagcctcgccctcgctcgcccgcgaagggcacgttccgacagggggcttaggggctacgattcgaagttcccgcaagctttgggggtggtttga

SEQ ID NO: 55968 - DNA, 300 bp, Glycine max
  Peptide Sequence Number=SeqID_147653
atggggtcgaaacaagttctgaggggctttatggggcaacaacaacgaactcaagctttgaagggccgaaagagactagtcgagagtcaaaggacggaagagaagatgtgggatatcattgacctgtataaagagaagcaaaatctagctgcaacccatgagcaaagactagaggacgagcatgcaaaagtatcggtcctgcaagcggaaagggaagcaagggagagagtgatagattcattatacagagaagctatgatgtggatggataggttcggtttcactttgaatggaagttaa

SEQ ID NO: 55969 - DNA, 219 bp, Glycine max
  Peptide Sequence Number=SeqID_147654
atggagtctggctcttgtgaagaacatatgcatgtctgcatagtcatttgcctcacaagctttcgagggatcaggtggcagggcctcactgttgcccttagagtttctggggttgttgctgttgttggattgggtgattcctccatccagggttatatctgttgctggaaaggtcatgattgctctgctgtgggtgattttgctgctgaggttgaggag

SEQ ID NO: 55970 - DNA, 351 bp, Glycine max
  Peptide Sequence Number=SeqID_147655
atgactttacaacttgttgaccgctccattactagaccatatggagtaattgaagatgtggtggtcagagtgaaacattttatcttcccggcagactttgtgggaatgccattcatgttaattgcaagctgcatagttgatatggggagaaagaagctggaaatgggctttgaagatcagaaaattgatttttatttgtttgttgaagacaagcctgctccagaacaaaatttttacttacaggtaatggaagtgggtcaagaggttctgaagaatttttttctgaaaaatagtcctttcgctaagcacaagacttgcgctaagcgcatctttgctcatgcgctaagctga

SEQ ID NO: 55971 - DNA, 888 bp, Glycine max
  Peptide Sequence Number=SeqID_147656
atgccggcaacggtgcattccacgcaggacatgtgcgggaaggcctcttccgtgagttccacaccttccaccagcggtgcaagcagctttgccgcgttcgggccgggcagcgcaatgccagacattgagatcgggccattccgtctggaggtaatcctccatcatgttcagcacccgggcggcaccgcccgtggtggtggtgacatggaaacggtcttcggtcatgcggccgataacgccatcatcacggatgaagccgtcatcgccaagcagcaggccataacggcagcgaccggcggcaagctttgtccagggattggtatacatgcggttcatgaactcgaccgcatcagggccgacgacctcgatcttgccgagcgtcgaggcatcgaaaatgcccacactctggcgcaccgcccggcattcgcggcgaacggcggcatccatatcctcgccaggctttggaaaataccaggcgcgacgccattgcccgaccggctcgtaaaccgcgccatgggcctcagcccaactgtcgatctgcgtcttgcgcgtcacttcgaagtgcgcgccgcggtgataaccggcgaaggcgccaaaggttgtcggcgtatagggtggacggaaggtggtgagcccaacttccggctggcgtttgcccagcgcttccgcagcgatgttgaggccgttgatgttggacatcttgccctgatcggtggccatgccgttggtggtgtagcgtttgacgtgctcgatggagcgcatgccctctcgcacggcgagccgcaaatccttggcggtcacatcgttctggtaatcgacaaaagccttgggcttgccgggatcgcgatcgctcggcagctccgtgtgcgatacaccggtgccaatgcg

SEQ ID NO: 55972 - DNA, 72 bp, Glycine max
  Peptide Sequence Number=SeqID_147657
gagagaaatatgtctgaggatccgctgggtataaggagtccgaaagagggatcatttgtttcttatttttag

SEQ ID NO: 55973 - DNA, 246 bp, Glycine max
  Peptide Sequence Number=SeqID_147658
atgaaacagagggatgggtctctggtaatcgattaccagctaatccgtgaacgagtagagatggagtgcctagagggagcttgggagaccctcgaaggcaacatgaggtgccgatttcggggcaccattcgattcacggctacttctttggtgcttccagatgaacctgcacggacgcttcagcgcacggtggagtggacagctccttggattagttttgtatattttgagggtaggtgtatctag

SEQ ID NO: 55974 - DNA, 228 bp, Glycine max
  Peptide Sequence Number=SeqID_147659
atgccggaaatcaaaaggaagtattgttacgcaatctgggtccaaatagcaaccaggcccacttgggccttccaggatgttcctccagaaggcagttgcttatggagaaagcaacctggctcgcttgggcaagctgagctcgtctgtgcgagctgggtggcaaagctcctcccctattttcctataaataaggggaggagtgaagaagaaaggggttcaaccctcctg

SEQ ID NO: 55975 - DNA, 243 bp, Glycine max
  Peptide Sequence Number=SeqID_147660
atgggttgctcggaccacccggaaatccctcatgctcatcctcatcagcttgcacctgtgtctgcaggaatgtctgccccagtgtcctctacatcagctggtgccatcgggtcatccgaaaataagtcatcctctacatctggtgcagggaccactggctcattatgcgccacagtcacaggtcatcgacgctgcggagccttatcagaatcatcacgatctaatcctctagcagtaatgtga

SEQ ID NO: 55976 - DNA, 768 bp, Glycine max
  Peptide Sequence Number=SeqID_147661
atggctacctcaccaaaagaaacttccgctcctggttcacccgctgtaccatcatctccgcaccaggaacaaccagaattcaacatccaacccatacagataattcctggtcaagtttcagtccctgagaaactggttcccagaagacaacagggagtgaagattgctgaaaaccctagctctgcaacaagtcctagggaagtagacccggagatggacaagaaaatccgcagtattgtgagtagcattctggaagatgcttctgtgcctgatgctgagaaagatgttccaacatcttccaccccaagtgtttccgtgcctgatgctgagaaagatgttccaacatcctccgctccaaatgttgaagccctcccttcacccagtgaagaggaatcaacagaagaagaggatcaagcctcagaggagactcctgcaccacgggcaccagaaactgctccaggtgacctcattgacctggaagaagtcgaatctgatgaagaacccattgccaacaggttggcacctggcattgcagaaaggttacaaggcagaaagggaaaaaccccccttaagaggtctggacgaatcaagactatggcacagaagaagagtactccaatcactcctgccacatccagaagaagcaaggttgctatcccctccaagaagaggaaagaaatttcctcatccgattctgatgaggatgtcgaactagatgtctcgacatccaagagggccaagaaatctgggaagaaggtgcctgaaaag

SEQ ID NO: 55977 - DNA, 51 bp, Glycine max
  Peptide Sequence Number=SeqID_147662
gagaaagggagctcagcggcaagaggattgtaacatggagagaagcaggag

SEQ ID NO: 55978 - DNA, 207 bp, Glycine max
  Peptide Sequence Number=SeqID_147663
atgacactctcacttaggaaaactaggcagcaagtatcaaggtccccttgtcatgcacatgcaactcccccctatggtgatcagcctgagtctcaagggagttccaaaccgagtgacatgcccccaagtacaagtattcccccttatgagaaactacgagtacttactgacaaattttatactatttccatgcaatatgaagtatga

SEQ ID NO: 55979 - DNA, 222 bp, Glycine max
  Peptide Sequence Number=SeqID_147664
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggagtatgacccgtgttgtagtcggtgatggtggtgttctgctcaccaaatttgtccttcaatgtagcttctaa

SEQ ID NO: 55980 - DNA, 273 bp, Glycine max
  Peptide Sequence Number=SeqID_147665
atggccttcatcatgttctcatttacacatatcattctaaaattcagagattcatgcaaagattattactcccagctagccattcactcacagagtaacgtcacactcttaccggttttggttcaagcttttctttcacaatcaatttgtctactgactaacaattctactcgagcaatcgctaagcgcgacattcagtggctaagcgcgaggaagaatccagaagaagttgagctgtcaagttcgctaagcgcaccgctccaggtcatctag

SEQ ID NO: 55981 - DNA, 285 bp, Glycine max
  Peptide Sequence Number=SeqID_147666
atggcaacaccaccagcatcccctccgcagtccaatcaacagtcagaggcgatgtctaggaatactagacgatcgacacagcttaggatgttgactagaagaaccttggatcagccgcaacctattgtcaccgttgatgctgcaactgggcgaggatcgggcccccataaagagaaattccacagttatttaggtgttgtagctagagaaaaagttccaattgtacataacagttggaaggatgtaccggacacactaaaggagctagtatggaatgagattttg

SEQ ID NO: 55982 - DNA, 846 bp, Glycine max
  Peptide Sequence Number=SeqID_147667
atgtctcctttccttgtgagggatctcggcgcacaaaattccaagactatacaaagaatccataaggcatgggaaaccccgttaaggaaagatcaagagcttagaggcattcgtaatggcatcattggtgggtaccacgaatggctgaaagctcgcatacgaggtttagattggctcgccaaaggacgaagaagtccaactctcaaaagcgagttaggaaaggcaaaactcgccaaggagaagttcaagttggctgctacacacgttcggaaggagtgtgccgggttacgggaagagaatgcaattaccgcaagagcccttgaacgagagaccaagagggctcgcaaggaagagtatggccggaacaaatttcgcggagctctatggggtagcaatagtgaactcaagctgcgaagggaagaaagggaccagtcgcgagcacatagcatggttctaaaagaggagttgattgcttgttcaaggtccaaaagaagcttgtctcagcgtttatgcgagacagagaccaacatgttagctatcatcgccaagtacgaagaagagttgggtctagccacggcccacgagcatagaatcgcggacgagtatgcccaagtatatgcggaaaaagaggctagaggaagggtgatcgactctttacaccaagaggcaaccacgtggatggatcggtttgctcttaccttgaacgggagtcaagaacttccccgattgttagccaaggccaaggcgatggcagacacctactccacccccgaagagattcatgggcttctcggctattgtcagcatatgatagacttaatggtccacataattagaaatcgttag

SEQ ID NO: 55983 - DNA, 444 bp, Glycine max
  Peptide Sequence Number=SeqID_147668
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccctctctgaccaagttgacccaggtaaatctggagaaatcatccacaacaacataggcatacctctttcctccaaggctttcaacttgcataggccccatcaagtccatgtgaagtag

SEQ ID NO: 55984 - DNA, 516 bp, Glycine max
  Peptide Sequence Number=SeqID_147669
atgccgatctccccctccgaaagtatcagttggtctgtgccatcccgacataggggtcgcgcccacaagacacccaggggacccggaggagcccaacggggccctggggtttccatctcgggttacgggcctctgtcagtcctacagggtgcttgtcccccccagcaaggtcatacctatcatgacatagggattgcgcccacaagacacccagtggacccggagaagtccaacagggtcttggggtttccagatctgattacgggtctctatcagttctacggagtgcctgtcgcccccagcaaggtcatcaggccccctactaaccgagctttcatcaagaagtactgcgcccccaggcaggcgcagggcaagacaccacagcagcctggggatcgccggcagcgggcaacagacacaccgtcgccacctccaaagcccctcagctcatctacaaaagctggagtgttccctatgacccgaccagcaagcgaccaagtccaaagccaaaggtaa

SEQ ID NO: 55985 - DNA, 565 bp, Glycine max
  Peptide Sequence Number=SeqID_147670
atctggcaccgacgaccgctccgcccgggctcgcgccctgggttttgcagcgaccgccgcgccctcctactcatcggggcttggtccttgccccgacggccgggttagcgcgcagttgggcaccgtaacccagcttccggttcatcccgcatcgccagttctgcttaccaaaaatggcccacttggagctctcgattccatggcgcggctcaacagagcagccgcaccgtcctacctatttaaatctttcgcccctatacccaagtcagacgaacgatttgcacgtcagtatcgctgcgggcctccaccagagtttcctctggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcag

SEQ ID NO: 55986 - DNA, 486 bp, Glycine max
  Peptide Sequence Number=SeqID_147671
atgacattgctacttagcaacattctgcccagcgaccgcaatgccaatctccccctgcaaaagtatcagttggtctgtgtcgtcccgacatggggatcgcacccacaaagacacccagtggacctgaagaagtccaacagggccctggggtttccagctctggttacgggcctctgtcggccctacagggcgcccgttccccccagcaagttcatgtcgtcgtggcatagggattgtgcccgcaagacacctagtggacccgaagaacgccaacagggtcttggagttgccagctctaaatacgggtctctatcagttctacggagtgcccgtcgccccaacaaggtcattagaccccacattaaccgggctttcatcaagaagtatgcgcccccagacgggcgcagggcgagacccacagtagcattgggatggccggtagcgggcaatagacgcaccgccaccacctttagagttcacctttag

SEQ ID NO: 55987 - DNA, 117 bp, Glycine max
  Peptide Sequence Number=SeqID_147672
atgaagaaaccggctgccaaccttctcaatgtcctcttatcattgtcggtgtcataccctaatttcgtccggggacctttgcttgatgacatgcgacctttctttggtccttgtgag

SEQ ID NO: 55988 - DNA, 248 bp, Glycine max
  Peptide Sequence Number=SeqID_147673
atgaagaaaaagaaagttgaagcagctggtgtctcgctaagcgaggcatatgcgcttagtgagcaacatccactaagcgagacactcagctcgcttagcgagttaggagaatttggaagagaatctgccaagcatgcacgcacccagcgcgccatcagctcgcccaatgagtcatttgtctcttctagcactaagcgcgcctggctcgctaagccaaaattcactaactctcgcttagcgcaaaaatg

SEQ ID NO: 55989 - DNA, 474 bp, Glycine max
  Peptide Sequence Number=SeqID_147674
gtcgacgtgacatacgagacctggaaggaagtccctgctgctccgaaggatttgatatggaaggatattcaggcagaatttgaaatccctgaagcttatgacagtaggataaagaagaaaattcttcagactgtcggcgagcggtggaggcaatttaaatatgacttgactaggaaatgggcacttgcagccgacaaggacggtgtggatgacattgatgtgtggaaaaaggcacaggccatccagaagcaaaacactgccccccatgtgttgtctcgtgggggttatgaatatttagaacaaaagctcatggctgagaagacaaagaaaagactggaagaagctgcccagtccagaagcactgagggcatcattgaccttccatctcccatcagacgccacgtgaagtggaagctgacccgcaccaagaaaactgggcagatgacgtctgaggcagcaaaggaaatagcttag

SEQ ID NO: 55990 - DNA, 456 bp, Glycine max
  Peptide Sequence Number=SeqID_147675
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttattgggttccttaaagagcaagcgtctttcaaagccatgatgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 55991 - DNA, 165 bp, Glycine max
  Peptide Sequence Number=SeqID_147676
atggacacccgtctccgtgtgattggtgatcccatgaatggagttcaacgggattcacctagtgagtgtggtggtggggccgccactgtgagatatgggctaatctctaaaggacactcacgaaacaagatacaagcgcaaggccgtgtaacgcgctaccactga

SEQ ID NO: 55992 - DNA, 696 bp, Glycine max
  Peptide Sequence Number=SeqID_147677
atgattgagttgcgaaaacttctggataggtatccgacatctgaactgaagtctttctggttaaagaatctctttctagttgctctggaacaattaggagattctctagaagaaatacggagttttgcttttggtggcaacatgctatgggttgttggtcccacttatggggtcaaatcaatacgttctaagaagaaatatttgaatctcatcgatctcataaaaagacgtatattccttgctaattatcagacaattacttattcacaaaccttgcggggggctaatagttttcatttcccatctcatggaaaacccttttcgctccgcttagccctacctccccctagtaggggtattttagtgataggttctataggaactggacgatcctatttggtcaaatacctagcgacaaactcctatgttcctttcattacagtatttctgaacaagttcctggataacaagcctaagggttttcttattgatgatagtgacgatattgatgatagttacgatagtgacgatatcgaccgtgaccttgatatggagctggagcttctaactatgatgaatacgctaactatggatatgatgccagaaatagaccgattttatatcacctttcaattcgaattagcaaaagcaatgtctccttgcataatatggattccaaacatccatgatctggat

SEQ ID NO: 55993 - DNA, 123 bp, Glycine max
  Peptide Sequence Number=SeqID_147678
atggctaccattgaattatcaagtagatatgagagcaagttagcgtatgacatcggaatttgggtgaattctatagacttcttcgctggaaaattccttccctggggtggcctttgtagctga

SEQ ID NO: 55994 - DNA, 681 bp, Glycine max
  Peptide Sequence Number=SeqID_147679
atgttgctaagtagcaatgtcatctatatctgtgtaagagtgttcatgttggtgcgcatgatccgcactcgtctctttgcagcggcacgggtgaaatcttgccccggtatgcatagtagctgtgtgatagcctccctctctggttgtgctcgcacagttggccgtcctccaatatcagggggtggcccaggaaccgtgcggatgtggagcacactgaaaatggcgaggacacgtagtcctctaaaggttagggcgtgcagccctctcgaggctgaggacatggagtcctctggaggtcgaggacgtgtagtcctctcaaaggtgagggcgtgcaaccctctgttggcgaggacgtgtagtcctctaaaggtgagggcgtgtagccctacgaaggtgaggacatgcagtcctctgatggcgagggcgtgtaaccctctgaaggtgaggacatgcagtcctctgatggcgagggcgtgtagccctctgaaggtgaggacgtgtggtcctctaaaggtgagggcgtgtagccctacgaaggcgagggcgagtagccctctcaaggcgaggacgtgtagtcctctagaggtgagggcgtgcagccctctgatggtgaggacatgtagtcctctcaaggtgaggacgtgtagtcctctggaggtgagggcgtgcagccctctgatg

SEQ ID NO: 55995 - DNA, 253 bp, Glycine max
  Peptide Sequence Number=SeqID_147680
gcaggcagtttcactttcagtctgcatttctgagctctccgaaaaggagttagcaatcgatgttaactctaactccagaactagatctcgttacaacgaaattggaagcatgggcggtggtcggatgaacagaatgtccgattccgctttaagcccgacaagcgaagcgggcaagagaactaggcttggtgtggctagctctaaagcaggccctagtattcctactgatctacttctttccgtcccttgctaa

SEQ ID NO: 55996 - DNA, 705 bp, Glycine max
  Peptide Sequence Number=SeqID_147681
gtgtcgcagggttcctttgtcccccatggacgtcaggatgtcctgactgcttccattgggcgactagaacaccctagtcatgtgcgtactgctggagctggtgtgacgatcaagcaatactttagaccggctccacggacctcccgcacttcttcctccatggctcccgaagaactaaagcagggacttgcactgcctccgaagcctgaggttggtccctcagttgctcgtgtcaacacaaaggagagatgtgatgatccctcagggaacggtccagacacgggtgattcagacaaatatgggttgtacatcgaagaaaatcctccccgcctgattgccctaggaagagtttatgagggatccacaaccgttcacaacatctctttgttgcatgatcaagtgaaggttggtgttgaggaggttaaagttacagatgctcccattcatgtacccactgacgagggagctgtgggaccagcaaaacctgcagatagaccagatcataaggtcgatgatcccctatatctgatgacattgaccatcccacagctttttttgaagccgttgcaggttatgtgggatgctaccgtgttcggggtgtttaatgaagacttccccttgtacataaagcatgaagatctgtctaaaatagcacatggtggtcaatgtctcagcatctctgtcatacagttgtggatactgtaa

SEQ ID NO: 55997 - DNA, 288 bp, Glycine max
  Peptide Sequence Number=SeqID_147682
ctccaaactcgaaggtggaggacacatgaacgaaaacacaattcaggggcttcgaaaaagggtgagaatggagaatggcagttagcaatcactacgcatagctccaaactcgaaggtggaggacacatgaacgaaaacgcaattcgtggggctccgaaaagattgagaatggagaattgcactaagcaattcactacgcatggctcccaactcgaaggtggaggacacatgaacgaaaacgcaattcatggggctccgaaaaagggtgagaatggagaattgcactaa

SEQ ID NO: 55998 - DNA, 551 bp, Glycine max
  Peptide Sequence Number=SeqID_147683
cgaggaagcggaagagcgcccaatacgcaacccgcctctccccgcgcgttggccgattcattaatgcagctggcacgacaggtttcccgactggaaagcgggcagaattgaaggcagagctatcaaacaatcccaaattccagaagtaccatcaacagataattgctgagcctcataatcatcctgaatggagcctcgtccatccccactatccttgcagaataccactcaacacccaccggcaggcacacagggacaaagtattgtcatcgacgctcttcgggattactatgccccttgcctattccggcacagccatgggaagacctctccctcgactttattatgggattgtcgaacttttgaggtcattccaccatcctagtagtggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 55999 - DNA, 264 bp, Glycine max
  Peptide Sequence Number=SeqID_147684
atgaattgcgttttcattcatgcgtcctgcacccatgagtttggagccatgcgtagtgattgcttagtgcaattctccattcttaaccctttttcggacccccatgaaattgcgttttcgttcatgtgtcctccacaccacgagtttggagccatgcgtagtgattgcttagtgcaattctccattctcaacccttttttggagcccatgaattgcgttttcgttcatgcgtcctccacccacgagtttggagccatgcggtga

SEQ ID NO: 56000 - DNA, 318 bp, Glycine max
  Peptide Sequence Number=SeqID_147685
gtggagggcaaagaaggcctccttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggtgtgggcgttagagcattga

SEQ ID NO: 56001 - DNA, 315 bp, Glycine max
  Peptide Sequence Number=SeqID_147686
atgtcattctacaatgagattgagaatcaatttggaaaaacaattaaaattttcagaagtgataatgctaaagagtatttctctcatgatctttcttcctttttgtcttccaaagatgtaaccttctttgaagacacacccttcttcacaccctccatagaccatacttcgtctctccaggaagttcttcctattccttctccttatcctctaggtaactcagacctaaatgtcagtgttgtcccatcttccccaccaaattcacctgaagttgcctcttcacctctgattacagatcaacataggacaaggtag

SEQ ID NO: 56002 - DNA, 141 bp, Glycine max
  Peptide Sequence Number=SeqID_147687
atgacggtgtgtgttgtgttgatgatgttgcataagaagaagaatggcagtgaaaacggcaacaacaaggagaacgaagacaccaccatcactgatgtcttgaaggtcgaagcgcactacgaaggttgcgctcccgtatag

SEQ ID NO: 56003 - DNA, 276 bp, Glycine max
  Peptide Sequence Number=SeqID_147688
atgaagacaaaagcccacaacagaatcactgacaatatagtaagtgaaactaagcaagaggctccataccaagatgatgagcttgtagggcttcaagaagtgttggaacttgaccttgatgtcattaatgaatctcttacggatgttgatggaggtggagaagagatagatgcagatttactcaaacaactagacttggttgaaccagacgaggatgaatgcatgttaagtgagaatgacattgagagtgattttgattatacaaatacttcttag

SEQ ID NO: 56004 - DNA, 293 bp, Glycine max
  Peptide Sequence Number=SeqID_147689
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccacctcagactatcaagattaaccaacctgaccaggcaaccagtggtggtcaacctgcgcaaaagtcggcttgctgtggttcatga

SEQ ID NO: 56005 - DNA, 516 bp, Glycine max
  Peptide Sequence Number=SeqID_147690
atggctacctcaccaaaagaaacttcagctcctggttcaccctctgtaccatcatctccgcaccaggaacaaccagaattcaacatccaacccatacaaataattcctggtcaagcttctgtccctgagaaactggttcccagaagacaacagggagtgaagattgctgaaaaccctagccttgcaacaagtcctagggaagtagacacggagatggacaagaaaatccgcagtattgtgagtagcattttgaaagacgcctctgttcctgatgctgagaaagatgttccaacatcctccacccagatgttgctgtccctgaagctgatgaagatgtcccaacatcttccaccccgaatgtttctgtgcctgatgttgagaaagatgtttccaacatcttccggcccaaatgctgaagtactctcttcccccagcaaagagagatcaacagaggaagatgatcaagccacagaggagaccccctgcaccacgggcaccagaacctgctccaggtga

SEQ ID NO: 56006 - DNA, 696 bp, Glycine max
  Peptide Sequence Number=SeqID_147691
atggtaatctaccacactgagtttgatgagttcaaggaagaattggagagaagaaaatgggatgaggagttgaccagttttgatgaaggcaacattagtgttaccattgtgaaaaagttttatgctaacctctatgatcccgaggataaaccacctaagcaggtgagggtgagaggccatttggtgaagtttgatgaggacacgttgaataccttcttgaagacccttgtaatcatcgaggagggggagacattatttgcctactctagatttgcactcttgaggcctgatcctcaagatttggctactaagctctgcatcccagggaggggatttaagcttaatgttgatggtcagcctctgaagatcctcaggaagaacatgactacactcgctcagccttggagtattgtttcttactccaacttggtccctacctcccacacttttgacatcacactggatcgggccaagttgatttatggcattattatgaagatggacatgaatctaggctacctcatctccccccagatttctatcattgcccagcatgactcctctagagttggatttccagccttaatcacagctttgtgtaaagctagaggagtcacattagatttcagatctttggagagccttagtcctgccattaacttggcatatatacagaattgtcggaatctagaatga

SEQ ID NO: 56007 - DNA, 900 bp, Glycine max
  misc_feature (113)..(113): n is a, c, g, or t
  Peptide Sequence Number=SeqID_147692
atgagaaagcgccacgcttcccgaagggagaaaggcggacaggtatccggtaaccggcagggtcggaacaggagagcgcacgagggagcttccagggggaaacgcctgggggncggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccttcacaggagacaagtagagatcgatgataggatctgcccattttgcagaagcgcggaggaggaagcgggacacttgttctttcattgcactaaaatcatccctatgtggtgggaatccttgtcttgggtgaacaatgtgggagtttttccgcaagatccaagacaacatttcctccaacatggatctatagtggctgatggactaaggactaatagatggaaatgctggtggttggctgtcacttggactatttggaagaaaaggaatgacataatcttctcggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 56008 - DNA, 273 bp, Glycine max
  Peptide Sequence Number=SeqID_147693
atgtggatggaccgatttgctcttactttgaacgggagtcaagaacttccccgatcgctagccaaggccaaagcaatggcagacacctactccgcccccgagatgaaagccgacatgtcggctttgaaagagcaaatggcttccatgatgtatgccatgctaggaatgagacaacttatggagaataatatggccaccactaccgctgttagtccggccgccgaagcagacccaactctcccagctaccgcgcaccatcctctaccaaacgtg

SEQ ID NO: 56009 - DNA, 117 bp, Glycine max
  Peptide Sequence Number=SeqID_147694
atggtttttcgtgaagaaaatccaagccaaggtgcttccgtaatcgattctgtagaaattcttcatcgttcttcaccgttcttcgttcgttcttcttcgttcttcggtcttcaaccg

SEQ ID NO: 56010 - DNA, 405 bp, Glycine max
  Peptide Sequence Number=SeqID_147695
atgatacaaggaagattttcctccttagatgcttggaaccggtacacagataatgtcttggggagaaacatcttgcctgagaggaaggtagagctctaccacactgagctagatgattttaagactgaattggagaggcgtaatttccataaacgcctcaccaatttggttgatgggagcatagacttggctttggtgaaagagttctatgcaaacttatacatctctgaggcggaatggagaaggaagagagagaggagatgccacttcaatgagaagatgagtatagaagaagctcaccaccataggaggccatggataagagcttggaggaagaaggagatgaatgaagggagagggagagaagagcacgaaattttgtgctctaagagctctgaaatctga

SEQ ID NO: 56011 - DNA, 435 bp, Glycine max
  Peptide Sequence Number=SeqID_147696
atgaaggaaggcataggtcacatcttagacctcactcccataggagagaaaaggaaacaaagcctcaagaggctaacattaacctcccatacttccatgttacttagattgggaaataagggggcagcaccttctaagcccaatgatgataaggggaagacaatagaaaagcaaccccctaaggctagtatgcaagaaaagactagctttataaagtgctttaaatgtcttggaagaggacacattacttctcaatgccctaccaagaaaaccatgcttatgaggagccaagacattcatagtagccaagatgaggctactacttcaccttcctctagtgaaagtgaagaagcaaaaggggaagaatctagtgaagaaatctacccccaagaagaaggacaacctttaatgtttaaggaggagtgtaaggagtaa

SEQ ID NO: 56012 - DNA, 708 bp, Glycine max
  Peptide Sequence Number=SeqID_147697
atgaaggcaatgcaaaaaaacgcggcgtttcggtatccgattctgactgttctggccgtctcccttagcggatgtgcctggatcccgtctaaaccattggtccagggtgcgacgactgcccaacccgttcctggccccgcgccagttgtcaacggctctattttccagactgcgcagccgattaattacggttatcagccgctgtttgaagatcgccgcccgcgtaacgtcggcgataccctgaccattgtgctgcaggaaaacgtcagcgcgagcaagagctcgtcggcgaatgccagccgcgatggcaaaaccaattttggcttcgatactgtcccacgctacctgcagggactgttcggcaacgcgcgagcagatgtcgatgcctctggcggcaatacctttaacggtaaaggtggcgcgaacgccagcaacaccttcagcggcacgctgacggtcacggttgaccaggtgctggttaacggcaacttacacgttgtgggtgaaaaacagatcgccattaaccagggcactgaattcattcgcttctcaggcgtggttaaccctcgcaccatcagcggcagcaacaccgttccgtccacccaggtggcggatgcacgcattgagtacgtcggtaacggctatatcaatgaagcgcaaaatatgggttggctgcagcgcttcttccttaacttatcgccaatgtaa

SEQ ID NO: 56013 - DNA, 303 bp, Glycine max
  Peptide Sequence Number=SeqID_147698
atgatcggccggacagaggctagggctgcttccttcccaccgcgtccttccttgtgtgtcggagatataaagcgagtgcaccggaaaagaacgggaactgggtcgatctattctatggcgaagcatccgaagcataactgcacactcacacgatctttgccgagagataggagcattcgatgtgtgggacagagggctcgtggtacctgctgcccacccttcctcctctgctttgagaaccgtgtgaacggagagtgggcagaagggaaggaggtcctcatacggagtcgcacacttacttga

SEQ ID NO: 56014 - DNA, 426 bp, Glycine max
  Peptide Sequence Number=SeqID_147699
atggctaagtttgacccagatatagtcctagaattttatgctaatgcttggcccacagaagagggagtgcgggacatgcgatcatgggtgaggggtcagtggattcccttcaatgcagacgccctcagccaattcctgggtgacccactggtgttagaagaaggccaggagtgcaagtttagtcagagaaggaacaggaccgacgggtttgacgaagaggccattgcccagctattatgtatatcgggtcagaattttgcccggaccgctgcagggaggcgggtgcggatcatgcacactagtatgaccaccttgacacatatgtggatgacgttgctgcttagcaatgtcctacccagtgatcataactccgaccttcctctgccgaagtgtcagctggtatgccacccaccaggcaacttctag

SEQ ID NO: 56015 - DNA, 215 bp, Glycine max
  Peptide Sequence Number=SeqID_147700
gtgtcgagggaaggagcccagagtatgaagaacatcaggatttaaggtcaaatcctttccaaggtggaggggatgaagcaatcctaccccccaaggctctagcttctcatcttaaggaggtgagcttagctattagggagcttctcaaggaagttttctcaaagaagcttttcaaggaagttttctcaagaaagcttctcaaggaagctacctag

SEQ ID NO: 56016 - DNA, 402 bp, Glycine max
  Peptide Sequence Number=SeqID_147701
atgggactaaacggccactgcctgaaaggactatgtccccgtgggaccgccggcccccccacaagggacatctcgcgcctatgggccgctataactatccaagaagacactcgaaactggaaggataaacaaacccacccggtggactgccgagctacaagtcccacgacacaggagcgggattctctaaaaagccaaggtcgcggggaatactctaaccctgggaaccggggcctggccaaagtccagggtggctcaaagttcgatcaaggagatccctgtcctgtgccctattcactaagagggggtaaccttgggcaataccaatccatttttggtttctataagcccggggggatttattatccagggaatactcctccaggttataaagcccactag

SEQ ID NO: 56017 - DNA, 171 bp, Glycine max
  Peptide Sequence Number=SeqID_147702
atgtctaatgggaagaggaaggttgaggctggagcaaagatgttgttacttgctcgggcaaaaagccaatatgaaggggagtggatagataaggatctaacttctcaaagaagcctcttgagaaagcttctcaaagaagccacgaggaagcttatggaggaagcctcttaa

SEQ ID NO: 56018 - DNA, 918 bp, Glycine max
  Peptide Sequence Number=SeqID_147703
atggggacaaggggttgcatcaattataatcccgttcttgcgagaaggcaacttggctacctgatgagaggggcaccactagaggaagagcttgcgcctgtcatttcacaaggtttcaatgagaccaatgtggagacacttcagaaggtccgcaaagcatgggaggtggtgcaaaagaaggacaaagaacttaggggcaataataatgggcccatcggtggctaccgtaagtggttgaaagcccacgtgcaaggtttggattggctcccgagtttgagaaccgctaaaagggaggaagttgaggcaccgaaggaagacaaagaggtgcaagcccttagggcagaactcgagcaagcccaaacaatcaaagaaaggttcaaatcagtagctctaaagatccaaaaggagaatgccgaactaagagatataaatatagctaccaccaaggccatggaacaagagaccaagagggctcgtagggaagagcacggccggaacaagttccgaggggctctatggggcagcaacaacgagcttaagctccggagagaggaaaaggaccgatcacgagtagacagtttgatcttgaaagatgagttgaagcggttatgcgagacagagaccaacatgttagctatcatcagcaaataccaagaagagctgaatctagccacggcccacgagcatagagtggcggacgagtatgcccaaatgtatgcggagaaggaggctagaggaagggtgatcgactcgttacatcaagaggcaacaatgtggatggaccgatttgctcttaccttgaacgggagtcaagaacttccccgattgctagccaaggccaaagcaatggcggacacctactccgcccccgaggagatccacggacttctcagctattgtcagcatatgatagactaa

SEQ ID NO: 56019 - DNA, 258 bp, Glycine max
  Peptide Sequence Number=SeqID_147704
atggcgcacagagacaaaatttggtcattctgcaccctttgtcatccagaggcggcgggcccgatgacatacagagacaaaatttggtcattctgcaccctttgtcatccagaggcggcgggcccgatgacatgcggagacaaaatttggtcattccgcacccctttgccattcagacacagtcgtgtccgatggcgcgcagagacaaaatttggtcattctgcaccctttgtcatccagaggcggcgggcccgatga

SEQ ID NO: 56020 - DNA, 219 bp, Glycine max
  Peptide Sequence Number=SeqID_147705
atgtcacaattcttaagagggtacatcaacttgggatgttctactgagaacaagagagggtacatctcttgtggatcagttcaagtggaagatacatccacttggttgttcaaagagaacaagggagggtacatcccttgtggatctttggcttgtaaaggattttacaaggttgaaagaaatctcaagaaccgttggttgcttggggactggatgtag

SEQ ID NO: 56021 - DNA, 378 bp, Glycine max
  Peptide Sequence Number=SeqID_147706
atgccgatctccccctgcggaagtatcagttggtctgtgtcgtcccgacatagggatcgcgatcacaaggcacccagtggacccggaggagtccgacagggccttggggtttccagctctggttacgggcctctgtcagtcctacaggatgcccgtccccccagcaagggatcgcgcccacaagacatcctgtggactcggagaagtccaacagggccttggggtttccagctctggttacgggcctctgtcagtcctacagggtgcccatttcccccagcaaggtcatgccatcgtgacataggtaaggatcgcgcccgcaagacacccagtgggacccggagaagtccaacagggtcttggggtttccagcgctga

SEQ ID NO: 56022 - DNA, 297 bp, Glycine max
  Peptide Sequence Number=SeqID_147707
atgatcctaggtcgtttcccaacgagaagtgacaaaccaaatgttcataatatacttgcagtaacagtaacagtaacgattggggggggggatgccattctcttatcctgggttatggagaattcgtccctaatagtcaaccacttaatccaaccctacttcaatttactaagcgaaaatcaacttaggggagaactgccaggaaaccacattacaagcgaaacctcaaaaagagttgggcttcgtcctcaaaaggaaacaacaccagaaaatctagccttccatggattcaaatag

SEQ ID NO: 56023 - DNA, 1425 bp, Glycine max
  Peptide Sequence Number=SeqID_147708
atgattaacggtatcggaccgggtagtttctcacagctccatctcagcagcgccagcgcacgcgtgaccagcagcacggcaagcaatgcgacccggcaaaatagtctgacggcagacgcctcggcgaaagtcacctttagcgaagccaccgacgccatctctgcggtgtaccagatgacaccggcgcgcgtcaccgccagcacgcttctatcgcctgatatgcagacgcaggcgatgggtgcgctgcgcagctcgggcgtcagcatgaacggcattggcagcgcgctgctgagcgcactgacgcagcagcgtgacgatgtcaccatcagcgtaccggccagcggcggcgcgcaaactgacacgcagagcgcggtggcgctggagattaccactcagtccggcgttagcctcaccctgcagatgacgcggcagcaggatggcgtagcggtggcgctgaaaaccactcacggtaagctgaacgatgacgaagctgcggcaattgccaaactttccggcgcgctggagaaaaccctgagcgggctggataacggcaatggtaaactggatgtcggtgacctgctcagttttgacagtaaccagctggccagcgttgatctgaaaaccgacctgcgtcgcagcggcgaagtaatgcagtcgctgaatctgcatgccgacccgggttcacgctggctgggtttccataatgccgacgccagtttcaaactgacgacggacatgcgcagcctggcgcaggccagcaacgccggtcagcagcagagcgccctggcgcagtggagcgcgaaatttgatcaggccgcttcgcgcggtcacggcgatcgtgcggcgctggcactgtttaagcagggtttcgagaccttaaacagcaccagcgccgcggccggcgtggcgatgcgcaccccgcaggcgatcaccgtaggcgcgcatgcggcgcaggccggtgccatcagcggcctggcggatttctcggccagctatcaccagacggcgcgctccagcaatccgctgaagccggaagaagaagatactttcgctctggatgtggcgcagcgcagcagccagcagaagaacggcgatacgcagcgcatgacgcaggaaaccctgtttaagctgaacgccagttttcataccgcgctaagcgccagttcgccgctggcgctcaatgaaaccaaagagtcacaaaactatcactaccaccagattcacgatgaaacgcgcagtaccactgaggtgacgcaggatgcgcagggcaatctcaccgcccgtttcgcccagcagctgacgcagcaggaaacggtgaagacctatcagctggcgaagctgatcgacagtaccagcacaccgcacagtgagaagagtgaatcgacgcgccactattctccggcgatgtatctggcgcaggcgtag

SEQ ID NO: 56024 - DNA, 2916 bp, Glycine max
  Peptide Sequence Number=SeqID_147709
gcgctggcgtttattcacagcagctcgcgtccgtgggtggacgcgggcgtgagccgcaacgcagacgatccttacattctcgccgatgtcgggcgtatcagcaccgaactgagcgccgccaacgcgctgctggtgcgtgcggcgcgcgtactggacagcattgacccgcacgcgcttaccgctgcgcactgcgcacgcgcctccatcgcggttgcagaagccaaagtgctgaccaccgaaattgcgctgaaagccagtgaaaagctgctggagtggagcggcagccgcggcacattgctgaaacacgggctggaccgccactggcgcaacgcgcgcacccatacgctgcacgatccggttttcgctaaacagccggcagcacgtatccgcagcgcgcagcaggccctgcaggtggcagaagagctggctgaacgctttcgcagcggcgcagcgcagcgcgatcggcagcgtgagctgccacatgctgaacttcagcactatttccagtccggcttaggtgccattaccgtgccgcgtgcgtggggcggcattgagatttccagcgcagaactggcgcagatttttgtcattctcagcgctgccgatgcatcgatcggtcaggtgccacaaaaccacttctacgcgctggaagtgctgcgcgttaacggcagcgatgcccagcagcagcggctgtacaacgaagtgctggcgggcgttcactatggcaacgcgctggcggagttcgcctccgcggcggcgcatcagcgcaccaccgccttcagtcagaccgccagcgggctgcgcctcaacggcgacaaattttactgcaccggggcgctgtttgccgaccgcatcccgacgctggccatcgccgatgacggcaaagaacagctggtgtttgtgccgcgccatcagccgggcgtgacggtgattgatgactggagcggtttcggccagcgcaccaccggcagcggcagcgtgcagtttcgtgatgtggcgatcgcgccggacgatgtggtgccgtttcacagcgcgtttgagcggccgaccaccgtcggaccgtttgcccagattatgcatgcggctatcgaccagggcattgcccgcgcggccttcaacgacatgctggcttttgtgcagcagcgcgcgcggccgtggccggacagcggcgtcgagcgagcctgtgacgatccgctgacgctggatcgcaccgggcggcttgccgcacgactcagcgccggtgatgcgttgctggatgtcgccggggaggcggtcgatgtcgcccaacgcaacccgagcgctgaacacgtcgcgctggcatcggttgaagtggcgaaagcccgtgcctggaccactgaggtggcgctggaagccggcaacctgctgtttgagctgggcggatcccgcgccagcctgcgcgagcacaatctcgatcgccactggcgcaacgcgcgtacccacacgctgcatgacccgattctgctcaatgcttttaacatgaactgcgtggggcatattcaccatggcatgtggacccatccgcaggaccgctcagtggagttcaattcgctggcgtactggctggatttagcgcgtctgctggagcgcggcctgttcgacggactgttcattgccgatattctcggcgtttacgatgtgtatcagcagggtatcggcctgacggcgcgcgagtccattcagctgccggtgaacgatccgctgatgctgatttccggcatggccagcgtgacgcagcacctgggctttggcgtgaccgccaatctcagctacgaagccccttatccttttgcccgccgcctgtcgacgctcgaccatctgaccaatggccgcatcggctggaacatcgtgaccggctatctcgacagcgcggcgcgcgccatggggcagcagcaactgctggcgcacgatcggcgctacgaccaggccgatgaatttcttgatgtcacttatcagctgtgggaaggcagctggcaggacgatgcgttgctggccgacaaacagcgccggctgtatgccgacgcgcagaagattcacgcgatcaatcatcagggcgaattttatcaggtgcagggctatcacctgagcagcccttcgccgcagcgcacgccgctgctgttccaggcaggctcatccgcgcgcggcgtggcgtttgctgcgcggcacgccgagtgcagtttcgtgaatgccagctcgccggcggcgctgcgcgagcaggcgcagcgtctgcgccacgcggcggtggcggcgggtcgccaggcggacgacttacgcatctttatgggcgtcagcgtgatcgttgccgccagcgaacgcgaagcgcaggagaagcaccgcagctatctggaatacgccagtgccgaagccggcattgcgcacttctccagctcaattggcgtcgatctcgccgcgtttggcctcgatgaaccgattcacagcggcgacacgcgcgccattgaatcggtgagcaaagcctataacggctggacgcgtcgccagctgctggagcagcatgcgctcggcagccgctatccggtgattgtcggcaacccatctcaggtcgccgaccagttgatccgctggattgatgaaggtgacatcgacggcttcaatctgacgcgcatcctgaatccgcaaagctaccgcgattttattgagctggtggaaatcaggatgaaatttgcctcattagtggcgctgagcgccgcaatatttaccgccagcgcgtttgccgccggtgactacagcggcgccctcaaagtcggtactacggcggctttcgcgccgccgctggaaaccgccgtggctgaagcgaaaaagcagggactgcaggtggagctggtggagttcaccgactggactgcgccgaacgtgagcgtggaaaatggtgacattgac

SEQ ID NO: 56025 - DNA, 1386 bp, Glycine max
  Peptide Sequence Number=SeqID_147710
atggcgtttattatcggcatggcgctgtttggcagcgtgacgtttttgccgctttatttgcaggtagtaaaaaacgccacgcccaccgaggccggactacagctgttaccgctgatgggcgggctgctggtcacctcgaacattagtggtcgcatgattagccgcagcgggaaataccgtttattccccatcgccgggacgctactggccacaaccgggatggcgctgatgacaacgctgacgctggatgcgccgctctggcacatttatctgttctccagcgtgctcggcatgggaatgggcatgactatgcaggtgctggtgctggcggtgcaaaatgcggtgacgcccgatcgcatcggcgtagcgacttcatcggttacgctgtttcgctcggtgggcggttcgattggcgttgcgctgtttggcgctgtgttcagtcacgtgctgaaatccggagtgacccgactgatagagcagggtaacgtgctgccgccttcgctggatccggtcgccgtgaaccatttgcctgcagcgctgcgtcaggcttatttgctggtgttcagtgatgcggtgcatgccgcatttcagatggccgccggcgttatgctgctggcgtttatactttcgctgctgctgccggagtcgccgttgcgcgataaccgttacctttctgtaaacttaggtaaaaatagtgaagacagcgagaattcgggcggagacgctttatttctgcaacttctttacggtataaatctgctatccctgttatccactgtgaaacgtcaccctatgattgctactgcggcccgcaacctgattgcctgcctgatgttattaactctggctggctgctcgtctcactcctcgccagcaccggagcaggaaagtgttgatacctcgcaggacggtggtaaacagcccgatttaattccggtaatagccgctttgcacgatcaaatgcattcgtgggaaggcaccaaatatcagtggggcgggacgcaattatccggggttgactgttccggatttgtctggcgcaccttaaaagatcgtttcaatattcccatggatcgcgtcacaacgcgtgaactgattgccatgggtaagccggtcgatcaggcgcatttacagcctggcgacttagtgttcttccgcattaagcatgagctgcacgtcggcttttacgacaccgatcgccagttcctgcacgcctcagtcagccagggcgtgatgcgctcgtcactgaataatccgtactggaaatcgacccatcctgccgtcaaccatccatctcctgtttcagtggcaattcgcatccaacatgatggctgctttaacgctctgtgccgctttatgggtattgaaatccaatcaacctattga

SEQ ID NO: 56026 - DNA, 162 bp, Glycine max
  Peptide Sequence Number=SeqID_147711
atgaattgttttcatgagtttgtggcttatggagatgtcatgggttgtaggaaagaattcggagaaaaagtgttgatctgggttagcaatgttgaagtcaaccagattttggtgaagaagaaggaagtggttccaaggttgaaggagatggtgactccatga

SEQ ID NO: 56027 - DNA, 135 bp, Glycine max
  Peptide Sequence Number=SeqID_147712
atggggatggctagcaacaggcaacaaatgcaccgccgccacctccagagccctcagctcatccacagaaaggttagagtatttcctacgacacatgaccgaccaataggccgaccaagtccaaagccaaagtaa

SEQ ID NO: 56028 - DNA, 447 bp, Glycine max
  Peptide Sequence Number=SeqID_147713
atgtgggctttcttgaccggtcatccaatcaattgggcccatttgattcgttacggcatgcataaggcattgcggactagtgcacctttaccttaccctcagcttgtgactttatttcttcgccattttgaaattcctttgaattttgagccttttatgcaagttaaacgttccttttctattggtgccggtgtggtaacctccttcggctaccgtaaggacatggatgggcaatggttgaagaaggatgcgcaccctccgcaagacaaacttctttcggagttacgaggcctccgcacctatgttggtgaacactttgattccttggatggtcgtatcgatgccattgatgcttgctatgaaggaatggatacctgcatcactcagcttgaggaggatgtgagttatcttcgttggtgcttcgacctttcaccaccaccttcatag

SEQ ID NO: 56029 - DNA, 375 bp, Glycine max
  Peptide Sequence Number=SeqID_147714
atggcctcagcaaactccttatttccagaagggaattctatcaataggcctccaatctttaatggagagggttaccattactggaaaacccgaatgcaaatttttattgaggcaatagatctaaatatttgggaagccatagaaatagggccttatatacccaccacagtagaaagagtttcaatagatggtagtcatcaagaacacgagatggagctattgagattacatcaacacgaagaaaatgacaagaaaaagaaaggaattgctcttaaagcatcatcctcaattcaagaagaaagtgatcaggataatgatccagatgatgatgatgatctaagtttgtttgtaagaagattcaacaagtttcttaaa

SEQ ID NO: 56030 - DNA, 348 bp, Glycine max
  Peptide Sequence Number=SeqID_147715
atggaacttagtaatggaaagggcccatcaagggtgaatcttgggtttgtcgagccttggaccaaggacgtgtttgccctgggttttgtacttccatggagttgtgtcgaggcttaccaaggacgggccttggattttgtaaacccttatggatcagcaagcgcgaaggttgggtttgatgagtcttgcgtgcagtgcaagtattgtgctcttacatacacgcctcttacaaagtggcaggtactggagacacggtggtgtctatcagtgggactcaccaaaggaggaccttgggtttcgcaagccctttggaggattgaccagggaattttccgacttgggttttga

SEQ ID NO: 56031 - DNA, 526 bp, Glycine max
  Peptide Sequence Number=SeqID_147716
ggagccggcgcctttcgaattcgaagcactttctagtgtgcgctgttttttgattgcagctagcgagcaagaaaacggatgcgcgaacgcggctttctttcgccttgcttgtgacgacgacgtcgagttggcggcggagaaagactcggcattcagtgatatactggaggaaggtggggatgacgtcaagtccgcatggcccttatgggctgggccacacacgtgctacaatggcaattacaatgggaagcaaggctgtaaggcggagcgaatccggaaagattgcctcagttcggattgttctctgcaactcgggaacatgaagttggaatcgctagtaatcgcggatcagcatgccgcggtgaatatgtacccgggccctgtacacaccgcccgtcacaccctgggaattggtttcgcccgaagcatcggaccaatgatcacccatgacttctgtgtaccactagtgccacaaaggcttttggtggtcttattggcgcataccacggtggggtcttcgactggg

SEQ ID NO: 56032 - DNA, 300 bp, Glycine max
  Peptide Sequence Number=SeqID_147717
atggtgtcgcctgttgggagaagggtttgtacttttgacgatttactgtcatgtatcgagaagatcactcttttgtctgacgaagaggataggatacttgaggcacatgaagatgctcccccttctcagccacaatttgaacatcaacagttcaatatactacagcgcagtgtggagactcgaggcttagtgcgacgttgggaaactgttgatgcagcaacgtacagtttgcctccgatgctagaacgacaacatggaatgtattacacaccgccgacattcacccaagaaccatcgtag

SEQ ID NO: 56033 - DNA, 566 bp, Glycine max
  Peptide Sequence Number=SeqID_147718
gaagtcgcgagagaaatatagtcaaagtaaacaatgatattgctgagacgggagaaagcaggaaaggaatgacaatctccgtaggaagtctcatcttagctatcgcccacggctcttataaaaggctttggttggattgctgctatcttgctcagtggattgttagccagttgcttttctcccttgaccttgctactttcatagccatagcaggaagcctggcaactttctttcgagacatggttgaagaaaaggctaatgccctgactccaacggcgcctactccttcccctaaagcggggtacctccctgaatacaacaaaagaaaggctaagaaaagaagaaagaggagaatgcaaaagaaagtgggcactcgtttcgttggttcaactcctctctcaaagagaagcgtaggaatccgcttataccgaacagagcttagcagccacacctacaacttgagatgttcccctgtgagccttttatcttatagtactgcattgggcacagatgccaggctttcagcctttcataggtacggttaccccgcctacttgactacttga

SEQ ID NO: 56034 - DNA, 1166 bp, Glycine max
  Peptide Sequence Number=SeqID_147719
gatccccatggccaatcaaggagactgggtcccgtttatggatgtgttagctttgctaatttttggggtcgtcctctttccaaacgtggatggtttggtagacctagtagcaatcgacgctttccttgcctaccaccatagcaaggaaagtccggtggtagctgtcttggcagatctatttgacacatttgaccgaagaatagattgggaccagctcttggccgggataggaggtagaacaatcagttggttcccccgatggaaggaaggaaaagaaggagtccttttctcatgtggaagatacccaaacattccgttggtaggaacgaggggttgtattaactacaatcccgcgctcgctataagacaactagggtaccccatgaggggagcaccgacggaagaaagcatgtctcctttccttagcttagaggcattcgtaatggcatcattggtgggtacacgaatggctgaaagtcatatacgaggtttagattggctcgccaagttaaaagtcgtcagcgaagagaattttgaagcaccggaagaggacgaggaagtccaagctctcaaaagcgagttaggaaaggcaaaactcgccaaggagaagttcaagttggctgctacacacgttcggaaggagtgtgccgggttacgggaagagaatgcaattaccgcaagggcccttgaacgagagaccaagagggctcgcaaggaagagtatggccggaacaaatttcgcggagctctatggggtagcaatagtgaactcaagttgcgaaaggaagaaagggaccagtcgcgagcacatagcatggttttgaaagaggagttagttgcctgttcaaggtccaaaagaagcttgtctcagcgtttatgcgagacggagaccaacatgctagctatcatcgccaagtaccaagaagagttaggtctagccacggcccacgagcatagaatcgcagatgagtatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctatt

SEQ ID NO: 56035 - DNA, 474 bp, Glycine max
  misc_feature (432)..(432): n is a, c, g, or t
  Peptide Sequence Number=SeqID_147720
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggctccgnccccctgacgagcatcacaaaaatccgacgctcaagtcagag

SEQ ID NO: 56036 - DNA, 540 bp, Glycine max
  Peptide Sequence Number=SeqID_147721
atggagaggagtatgattgatgctgccagtggtggagctcttggtgatatgacccctgctgaggctaggaatttgattgagaagatggcttccaactcccaacaattcagtgcaagaaatgatgctattgtccttagaggagtccatgaggtggccacagattcatctgcatctactgaaaataaaaagcttgaaggaaaacttgatgccttggtcaacctagtaactcagcttgccatgaatcagaaatctacacctgttgcaagagtctgtggtctatgttcttctatagatcactatacagatcttatccttctttgcaacaatctggagtcaatgagcaacctgaagcttatgctgcaaatatttataatagacctcctcagcagcaaaaccaacaacagcagaataataatgacctttcaagcaatagatacaatccagcttgtccctccttttcagaatgttgctggtccaaccaagccatatgttcctcctccaatacagcagcagcaacaacagcagtcacaacaaagataa

SEQ ID NO: 56037 - DNA, 177 bp, Glycine max
  Peptide Sequence Number=SeqID_147722
atggttgctcacatcccagatccaagggttgatccttctcaatatcgtgatttagtacattattggtgttctgagaaaggacagaaaataagaaacatcaacaaaaggagctgctcaaaatatgaggacttgcattgcatgggaaccaattatcttccaagacggattcatgagatg

SEQ ID NO: 56038 - DNA, 318 bp, Glycine max
  Peptide Sequence Number=SeqID_147723
atgagtttcttcctcaaggtgggacaattggccaagcagatagctgacaagtcatccaacagttttatggcaaatacagaaaagaatcccaaggaggaatgcaaagctgtgatgacaaggagtaaaaggaaactggaaataaccatggccttcggagaagctttacagcaaatgccactctactccaaattcttgaaggatatgttaacaaggaaacataagtatattcaccaggaaaacatcgtagtggaaggaaattgtagtgttgtgattcaaaagatcctctcccacccaagcataaagaccctgggagtgtaa

SEQ ID NO: 56039 - DNA, 373 bp, Glycine max
  Peptide Sequence Number=SeqID_147724
gctcgatcgtgtccaaggacatgcagagacaaaatatggtcattctacgccttgtgtcaaccaagaggaacagattcgacagtatcaggatgatgttggtcattcggtgctgatcattttcaaaatttttgtaggttccgctggcagggaggttgaccagccaaatgggggggtacaaatagcaatcaggcccacttgggccttcgaggaagttcccccagaaggcggtgccttctggaggaagcaacctagctcgcctgggcaagctggccgtggcgcttccgtaacgcttccgagacgtttccgtgggcgatttcgcgaggattttccaccgttcttcgtcgttcttcgttcgtgcttcggtcttcaaccg

SEQ ID NO: 56040 - DNA, 228 bp, Glycine max
  Peptide Sequence Number=SeqID_147725
atgaacgccaaggatactgggctgccttgcagcaacatcctctgcttgtttagcgccgggaaggggtggcgcttggtcggtcgcgatcctatccttcattcgcttccatccctaagtacctgcaagtacgggtcaaatgatatgcgaccaatcgtgaccgatcatcgtcttaccttggttgattcccgcagtcaacttgtcttgacttctaactgtgacctgagatga

SEQ ID NO: 56041 - DNA, 285 bp, Glycine max
  Peptide Sequence Number=SeqID_147726
atgacccctactcatgatgccttgctatattacaacaggaggtggaacatgccccgccaacacgactttgtcggttactcgttcacagtaaaaaatccaaaaagacttgacattccttcgggatgtaccatcaatgaactggaggatttgatcaaacaagttgcacctcaagggcttcccccttatggtcattatgagtattcagacatagttatcaaatttgaaattattgagttgaaaactgacgatgacatgctaaaggtcttagtacagtctaactactag

SEQ ID NO: 56042 - DNA, 228 bp, Glycine max
  Peptide Sequence Number=SeqID_147727
atgttattttttgatgataacaaaggtgatgacaaaaagctcaaaggtcaatcaaagaatgagttcaagatgttcaagatagaatcaagaacacttcaagattcaagaggaaagttgatttcaagaatcaagaatcaagattcaagaatcaagagaagacttaatcaaaaactgagtagcacatggatttttctcaaaacatgtttaccaaagagtttttactctctg

SEQ ID NO: 56043 - DNA, 48 bp, Glycine max
  Peptide Sequence Number=SeqID_147728
atggggattttcaaccatggagttgcagcagaagataaaggagaagag

SEQ ID NO: 56044 - DNA, 453 bp, Glycine max
  Peptide Sequence Number=SeqID_147729
atgcaatcacaaagacttgcactgcctccagagcctgaggttggtccctcagctgcttgtgtcaacacaaaggggagttgtgttgatccctcagcggtcgatccagacacgggtgactcagacaaatacgggttgtacattaaagaaaatcctccccacctagttgccctaggaagagtttatgagggatccacaatcgttcaaaccatccctttgttgcatgatcaagtgaaggttggtgttgaggaggttaaagatgcagatgctctcgttcctgtacccactgacgaggctattttagtgggacaggcacttaacaccttccttgcttggccgacacatctcataaagcgtttatcagaacatggagttgtgtctccagcaaaacctgcagataggccggatcctgaggtcgatgatcccctatatctgatgacattgaccatcgcataa

SEQ ID NO: 56045 - DNA, 261 bp, Glycine max
  Peptide Sequence Number=SeqID_147730
atgctcagggcacaaaattccacagcacaccacagtgcctattttgggaaaagagctctagaggcagcaagaggagcagcttttgcagagatacctaggttttgtaagcttattattgttaagaacttgaatgaagcagaattagaacttagtcttacaagagggatctgcagattaagttttggttttaagtatgctattacaataatactgtttggtctaagtctagtccaacaagaggaatctgaggacaaagcttag

SEQ ID NO: 56046 - DNA, 498 bp, Glycine max
  Peptide Sequence Number=SeqID_147731
atgaagaggactgatgcagcaataaaaaatttggaggtacaaataggccaactagctgaggtagttgctaaaaagcccactgaaacctttgcggtaaatactgagatgaaacccaaagaggattgcaaggtaattttcactgagagagaagagaaggaaaagaaaactgaggaagatgtgcgtgatgaagaaggagaaaagaaggaagaaaaagaaagaaatgaggagaaagcccaacaatgggagaagtactcacaagtagaaattcaacaagaaagcattctccaagtcaatacccctcctcatcaacttattgtcaaggaagaaagacatggagaacatgagaaagccttaagtgtcattctttccttgatcgccaccacttctcttgcaataatgtggaaggtgcttccagaatacatgagtttcatggcgtctctagctaagaggcaaaaatgcaaggaagatgtgttctacgtgaccttcatgccaccttga

SEQ ID NO: 56047 - DNA, 717 bp, Glycine max
  Peptide Sequence Number=SeqID_147732
atggggacaaatcaaaccagcaagaggttttaccaagtcaaggttaaaggcctagataccaccagcatcaaggaattaggacggttgatggaacctctccgaatgcaagccttccgtaagacttacggaaagatcttagatttgaccatagcggagatatccatagaggccattgcgtcactcacccaatactacgaccagcctttgagatgcttcacgttcggagacttccaattggtaccgaccattgaagaatttgaagagattctaggatgtcctctcgggggaagaaaaccatatcttttctctggttgtctcccctctttgagcagaattgcaactgtggtcaaggattcagcaagaggaggtagaacaatcaattggttcccccgatggaaggaaggaaaagaaggagtccttttctcatgtggaggatacccaaacattccgctgataggaacgaggggttgtattaactacaatcctgcgctcgctataagacatctagggtaccccatgaggggagcaccgacggaagaagacatgtctcctttccttgtgagggattttggcgcacaaaattccaaggctatacaaagaatccataaggcatgggaaaccccgttaaggaaagatcaagaacttaggggcattcgtaatggcatcattggtgggtaccatgaatggctgaaagttcatatacgaggtttagattga

SEQ ID NO: 56048 - DNA, 513 bp, Glycine max
  Peptide Sequence Number=SeqID_147733
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccggttcaagatgtatccttgattggggacccaaatgatttagggtcattgattgttggaggaggaatggagggttatggagattga

SEQ ID NO: 56049 - DNA, 237 bp, Glycine max
  Peptide Sequence Number=SeqID_147734
atgacggcaggacatttgtcggaatctgtgggatgccctcgacctttaatgtgcccccaagaaatatggtgtgctgcattcgcggaatggttgatagtaaagagacggtgtccgccctttcaggatttatctaaaaaaatgttacggtggaaagtcacacaatggggtggaccacatcgaaaattcgaatatgaccatgacacaaaaagaaatgttgaagataattgccactggtaa

SEQ ID NO: 56050 - DNA, 204 bp, Glycine max
  Peptide Sequence Number=SeqID_147735
atgactatgacacaagaccatgagaagcttggttcaaatttaattgcgacttgcgtagtaggcatgatcagagaagatccatcaataaaaatttctttgattcaagaaaggataaatagtgaattttcctataagggtaagtcgcgaacatcgtcagtttcatcgagtattttggacatttggtcaatgcaaagaagcttttaa

SEQ ID NO: 56051 - DNA, 711 bp, Glycine max
  Peptide Sequence Number=SeqID_147736
atgactaccctgactcagacatggatgacgttgctgcttagcaacatcttacccagcgatcataattccgacctccctctaccgaagtgtcagctggtgtacgccatcctgacacggatgaacattcatgtggctcagttgatcactaatgccatttatttgtttgtaggtatggcgcctactaggcaccctctggacccggataagtccaacagggccctgggatttccagctttgatcacaggactctgccagtcgttcggagtccccgtcgcaccaagtaaggtgattcggccacccatcacctgggcttttattgagaagtatttcacacagagacaggcccagggtgatgcaccccaggccgcaggcgcgccaccaccacctcatcaggctgacccagctgggtcatttgacacagagcggtatttgcggcactcgatgcgccagcacgcggccaaccacaggggactggggcaggtccatgagtgtctctaccaggtaagcctcagcatgcagagccaaggcttcgctccttttctgtgccctactccagaccaattcaaggcagaggtcgcatggcccggggattggcccgaggcccaagcaagggaggcacccgcggaggctcccgacgatggagaggaggccggcatggatgaggagatgtcagatttgctcggcttcttgggagggagtggagccacatga

SEQ ID NO: 56052 - DNA, 723 bp, Glycine max
  Peptide Sequence Number=SeqID_147737
atggtcaacattccctcggacataacaaacagaaagagtgatgagtatcagaaagtgtttgtcagaggaaaatgtattagattctcccctgctgtaatcaacaagtacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattggcactgccaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctcctctatccctgcattacaaactgtttgaggggacacatgtcccagacattgtctcgacatcagggaaagctgctacttcaggtgctgtgtccaaggatgatttgattgctgaactcaaggacacatgcaaggtgctggaggcaaccatcaaagccaacacagagaagaaaatggagctggaacgcctgatcaaaagactctcagacaatggcgttgatgatggagaagcagctgaggaagaagaagatgcagcagaggatacagaatcagatgatgatgattctgatgccacccgatga

SEQ ID NO: 56053 - DNA, 699 bp, Glycine max
  Peptide Sequence Number=SeqID_147738
atggtggaaccatcaaagaagagaaagagttcttcaagtcggagtcaacgacattccgagactcaggaaatgccaattccttcctctattccctctgcctcattgttttcatccgaagaacaacagatatggtacacaaatatcttttcttctcattctattgttgatccaaaattcattgatatggatttctattcaaatgagagttttgaatgcatccaggcatttgaaaactccaatcttattcctttcatgtctttaaaattgcttgtttactctgagttagtcaaatccttctattcaaaccttgaaatccaagaaggcactttaatttctgaagtttatgggattaaaatggtcattgaccaatccctattatatgagttaacccaattatccagtgaaggtgtaccatttgaaggtacactgattgatgattggaaatatgaattttctgtgcatgatgcccgctggttggtttgtaccaaccaagcggatatgaccggaaggcttcttgccggttcattggcttttgagagttgcatccttcattaccttattgttcgtatcttgcttccaagatcttcaaaccttgcacaggtttttgaagaagatcttattgttatgtgggcttttcataaaggccgacaaattgattgggcacacttagtccgatatcgcatgcataaggcattgtga

SEQ ID NO: 56054 - DNA, 328 bp, Glycine max
  Peptide Sequence Number=SeqID_147739
atggctccaaagaagcttctctctaagagggcaaggaaggacaccgtgggagaaggatccgagagacgggtccaactgcaagagggggaatacatggagttccaggaggaagttgccaggaggcaatggactcaactcacagggcccatggctaaatatgacccagaaatagtcatggaattctatgcaaatgtatggcccatagaggaaggagtcagggataagcactcttgggtgcggggccaatgggtcccctttgatgaagatgccatccatcagttcttggggcatccgttggtcctagaagaggggcaatattgcgagttca

SEQ ID NO: 56055 - DNA, 537 bp, Glycine max
  Peptide Sequence Number=SeqID_147740
atggagagaagtatgatagatgctgccagtggtggagcccttggagacatgactcctgctgaagccagaaatttaattgaaaagatggcctccaactcccagcagtttagcgccagaaatgatgccatagtcattagaggagtgcatgaggtagctacaaacccatctgcatcatctgaaactaagaagcttgaaggcaaactggatgcattggttaacttggtaacccagctggccttgaatcagaaatctgtacctgtcgcaaggacctttgcccttccatgcagcaacctggagcaattgagcagcctgaagcttatgctgcaaatatttacaatagacctcctcaacctcagcagcaaatcaccacagcagagcaattatgacctttccagcaacagatacaaccctggatggaggaatcaccctaacctcagatggtccagccctcggcaacaacaacagcagcctgctccttccttccaaaatgctgctggcccaagcagaccatacattcctccaccaatccaacaatag

SEQ ID NO: 56056 - DNA, 275 bp, Glycine max
  Peptide Sequence Number=SeqID_147741
gagaagaggcagaggagacacaggtaggtagctggctagcgcagctcctgaggcgatcccttgaggctacttcagagcattctgcaccagtggtaaacgtaccctgtcgtcagcctgcagcagacccctccactcctcttctacagatgccagatgacccaagtacaccagtcctagctgtggacacttctcctcccactactccaatgcttcagctgacagatgaggaggatggtcagacacaagatacacaagaccagtcacaggaattttga

SEQ ID NO: 56057 - DNA, 461 bp, Glycine max
  Peptide Sequence Number=SeqID_147742
atgagcagaagagaagaagagattgtagaggttgacactcaagaggaaagccctgtgaatgagcatgatttagaagaagaagatgaggagaaagcgcaacaacgggaacaatgcttacaagaagataatctccaagttaacacatgttctcatcaactgactatcaaagaagaaaggcatgaagaccatgagggttcaatcattctgggacaaccctgtctgtcatttgctagttgtgttttagacatgggtaaaggtagattagaattgaatgtagaggatcaaaagatctcttttgacttaattgaagcaataaaacacctagatgatggtgaggattggtttgaagcagaaatgtcggagcaggagatggaattaatagcctcagccatggattggaaaacaatagaccaaaagaaaaatcccaaagtagaattaaagatccttccaacgcatctaaa

SEQ ID NO: 56058 - DNA, 348 bp, Glycine max
  Peptide Sequence Number=SeqID_147743
atggcaaccccatttaaaacaaaagatattaatgaggaagtaacctctgaagatattaaaagcctaatggaacaggcaaactacaccaataaatatttacaaattttaggagaaaccattaaaactaaggtagctcctatgcaaaaatcggttgaagaagcctctccaagtattcccattgaaaaatcactgttcaaacctttcaaagttagtgagaaagctaagcgaaagattagagaacttaggaaaactaaatccttagttgaaggagtaggtcattccggaaactccccaaccctcgaaaaatacttccaaaatggtaacaagaagtacctccaaattaattaa

SEQ ID NO: 56059 - DNA, 371 bp, Glycine max
  Peptide Sequence Number=SeqID_147744
cagctccagttcttccaggtcccttcgctcagagcttagaacttttcatgtctatgctgcagagcctgcatcagggccagctcctgatcatacagagtttgcaggatgtggtccaacagcggccagttatgagcttggaggagtttgttcagaagatggcctggccaggagtccagccttctcctttgggaggggtagcagctaccccacaggtgacaccagagccttccactgcagtgttggacatatcttcttctcaacttgagtcatctgcaccagtgccaaacctacctctttctcaggattcaccatcaagcactactgcactggagctgaatgagcatgccatggactctgcactggatcattga

SEQ ID NO: 56060 - DNA, 336 bp, Glycine max
  Peptide Sequence Number=SeqID_147745
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccctgtgccagataaatgctttgataaatgtgccattggggcatga

SEQ ID NO: 56061 - DNA, 519 bp, Glycine max
  Peptide Sequence Number=SeqID_147746
atggcttctccacctgcctcgcctcctcctcctcctccttcacctcctcctcctcctcctcttccttcagacgcatcagcttcaccgtctgttgtcaagcggacatgcaaagccttacatctacgatccttgtctaccagaccacctggtgctgacagaccagtggtccatgttgatcctactaccggcaaggctgacgatccccacaggaaaaaattaagaacatatttggggattgtggcgtgtgataaggtggacgtcacatacgagaactggaaggaggtccctactgctcagaaggacttgatttgggaggatattcaggtggaatttgaaatcccagagccttctgacagtaggacgaaaaagaagttgcttcagactatcggtgagagatggagacagtttaaatcagacctcacgaggaaatgggcccttgcagccgatcaggatggtgtggacgacaccgtatgtgagaaatacgacataagcaaggaaaaatgggcccagttttgctag

SEQ ID NO: 56062 - DNA, 129 bp, Glycine max
  Peptide Sequence Number=SeqID_147747
atggcacaacctccacctcgtgagaggactctaagggaaatggctgcacctgatttcacctatgaaagcttgtgcatccaataccctgatgaggatgtcccatatgtgaagacccgcacaaacatttga

SEQ ID NO: 56063 - DNA, 220 bp, Glycine max
  Peptide Sequence Number=SeqID_147748
gtcgactctagaggatccctggggagatgaatggcagcggaatggagaaggaagagagagaggagatcgccacttcaaggagaagatgagtctagaagaagctcaccaccataggaggccatggataagagcttggaggaagaaggagatgaatgaagggagagaaagagaagagcacgaaattttttgctctaaaagagctctaaaatctgaagtttaa

SEQ ID NO: 56064 - DNA, 293 bp, Glycine max
  Peptide Sequence Number=SeqID_147749
ttttgggaagtaatcccaaggcccagcagagtgacaaatcaaaggagatgatgagaagtaataccaaggcccagcagactgaggaacctttcgtgtactccaacccaacttctaaaggtcaccctctatcttctttatacgaggaccctatacagctgcaatgtgacatcttgaaggaaatgggcttgtcttatgaggaagaagatagcaaggttaaggggctgttgttggatatggagaataaagatgatttgatggcagcaaagaagggaattaaatctcagcaattatga

SEQ ID NO: 56065 - DNA, 459 bp, Glycine max
  Peptide Sequence Number=SeqID_147750
atgaccacccttacgtggatgtcgttgctatttagcaacattctgcccaacgaccacaatgccaatctccccctgcagatgtatcagttgggatcgcgcctacaagacacccagtggacccgaagaagtccaacagggccctggggtttccagctctggttacgggcctctgtagtcctacagggtgcccgttccccccggcaaggtcacggatcgcgcctgcaagacacccagtggacgcgaagaagtccaacagggtcttggagttgccaagctctcattacgggcctcagtcagttctacggagtgcctgtcacccccagcaaggtcatcaggccccctactaatcgagctttcatcaagaagtactgcgtccccaggcaggcgcagggcgaaacaccacagcagcctgaggatggccgacagcgggcaacagacgcaccaccaccacctctatag

SEQ ID NO: 56066 - DNA, 858 bp, Glycine max
  Peptide Sequence Number=SeqID_147751
ccgtcgcgcacgtcgcgcacgatgcgcgacaggctctcgttcatggccttgagcgcggccatcaggtcgccggtctcgtcgcgcgaagtgacctggatgttgccgctcaggtcaccattggcgacacgacgcgcggcgtccaccgccagccccaggggccgcgtgatgccgcgcgtcaccagccagccgagcagcaggccgagggccacgccggccagcgacagcaggatcatgatgagacgggtgctgcgatacagatcggtgacttcgtgcaccgcctgatcggcggcttcttccttggcctgcgccaactcgctcatcaggctctcggccttgcccgacgacgccgccgcgcgcttggtgatgctggcaatggcgggatcgacctgcgccaggggcagcgattgcgcgttgtcgaagaattcgatggcctcgcgcttccagagctcctcggcttcggtgaattgcgccagcaggcgtttgccgctttcgcggatgaagttctgcgcggccttggcgcgcaggcgctccaggttttcgacatcgcggtcgaattcggcgcgcagcgcctggcgttcctcctgggacgtggccgccaggaaactcttgcgcgcccggccagccgcgatcaggctgatgttggcttccttgatgtcggacagtccgcgaaattcgatctgggcgatctgatcattcatgtcgttgatgcgggccagcccccacaccccgaacgcgccgatgatgccgcccagcaaggccaccagcaggaacgcgcccgacaggcgcacgccgatgcgcgcgccgatatgcaatctcgaaaaaaaccgcaacatgcttgccttcccgtcagacaccacg

SEQ ID NO: 56067 - DNA, 459 bp, Glycine max
  Peptide Sequence Number=SeqID_147752
atggctggtacgttctttcttttgaaaaagcaaaatagtttagagattatgagcagtgagaaagaaataactccgaacagagttgtgaactggccattcaggactctgtatcattattttggggacgccacaattacggaagccacggaagccctggaagccatttttcaaaaacgtggaggagcttgccgcccagttgcttcctccttaagcaacccaactttcaaaatgttttggaagggcctagattcgaaatgctatttacactctgtcgcaacctacccttcggtgggagggcgacgcgtgactcgcgggaagcgtgttccacgaaaggaatacgcgcggagtcgccaccaacgtttatttgaggaaaacgtcggaaaaaccgggaaagacgcgatctacgaactttttagtgaaaggttcgggagttgtatttacgcacggggaaggtattag

SEQ ID NO: 56068 - DNA, 122 bp, Glycine max
  Peptide Sequence Number=SeqID_147753
gtgtgtttcttcccaaattgtgtgcagtagcagaaggtgcaaatgctcgtcgacaaatgggtgagatcaaaagctcagagctctcagatgaatctgccattgctccattccctcaatactaa

SEQ ID NO: 56069 - DNA, 282 bp, Glycine max
  Peptide Sequence Number=SeqID_147754
atggtggttcgtgccttcgttggcactcgtcgagaggttaggggagaaatcgacctccctgtacagataggcccccatacctgtcagttgccttttgggacgcccgtggatccactcggtgggagtcgttccctctacactccactaaaaattgaaattcgtagtagaggggcatttggttatcgtatcgggcgaggaagacatcttgatgagttgcccatcctctatgtcatatgtggaagccgcagaggagtcattagaaacaaccttccagtcttttga

SEQ ID NO: 56070 - DNA, 366 bp, Glycine max
  Peptide Sequence Number=SeqID_147755
atgcaggttagctcgcctgggcgagcaacccctgcaccaaaatataaaagtgacgaaaggggggacgtttttgcattcaaaaacttcttttccccccttttcaaaagccatacccacggaatttacgagtttgcacccctaggatctctacttttcgcattcttcgattctattttgcgcctttattcatccccaacaagtattagaaataccagaatgtgcacgtatgcaatttttgatagccaaagtgctttgagtatgcatgtatgtaaatttagcaaaggaaatgcgtgtgatgtaggaaatggccccgaggaagcttgcctcaaagaggtccaggaaggacaatgcggccgaaggaactag

SEQ ID NO: 56071 - DNA, 600 bp, Glycine max
  Peptide Sequence Number=SeqID_147756
atgagggattcttaccctctttgccaatcccaggtcgaagaaaagagggtatacggaatccctagctttggctctcccgggagactagcccagtccaccgattcaggtgctggtaaacgtcggatatttgccattggcaactacgtcaaccaacggttgctaaagcctcttcatgattgggcccctcaccgtaaaggtggtcggggtgatcctgtagaatatccgttcgctcgtggtagacccgttgtctcttttgagacagggcagccattgggttatctgtcgtcttggcctctcttcacactgagtcaccatttagtgcttcagtcttgtgcagagaaggtgtatccgggcagatattttgacaggtacgctatcctaggcgatgacatatgtatcgctgataggaaggttgcgtccgtatatcatcaggtcgtgacagatcttggtgtagatctttctatacctaagtctcttgtctccgattctggtggtgctgaattttcaaagcgttttaggtgtcataatttgagtgtggatttcttaagatggaaagcctgccgaagacttctaggcaaggaaagagaggaaggtgagtaa

SEQ ID NO: 56072 - DNA, 792 bp, Glycine max
  Peptide Sequence Number=SeqID_147757
atgcgggcttcccgttggccggtcaagttcctggtgtccgataatccggaagtggtgaatcgccatctggcaaaagtgtacggccaggcttccgtaggcgcacctccgatgtccgtgccgcacatcgacacccgcatgcttgacggcaaacgcgtggtgctgtttggaccgttcgcaaccttctccagcaagttcctgaaaaatggctccctgtgggatctgctgagcgccacgaccacgtctaacgtcaagccgatgatggatgtcggtctggataacttcgacctggtgaaatacctgattagccaggtgatgctctcagacgaagaacgctttgaagcgctgaaagagtactatccgcaggcgaaaaaagaagactggcgtttgtggcaggcgggtcagcgcgtacagatcatcaaacgcgatccgaaagaaggtggcgtgctgcgtctgggtaccgaagtggtaagcgataaggacggcaccattgccgcgctgctgggggcgtccccgggggcatctactgctgcgccaatcatgctgcacctgatggaaaaagtgtttaaagataaagtttccagcccggaatggcaggcgaagctgaaaacgattattccatcctacggcacgaagctgaacggtaacgtggacgcgacggagcaggagctggaatacaccagccgcgtactgcaactgcaatacgtcaaaccgcaggctgctgcagatgccgcaccaaaagcggagctgaaggctcagccggaaaacaaaccggttgcggatatcgcgctgtaa

SEQ ID NO: 56073 - DNA, 222 bp, Glycine max
  Peptide Sequence Number=SeqID_147758
atgttggtggcgactccgcgcattttccttccttggaagatgcaccatcgggtcccacgtcgcgcccccgccggagggcaggttgcgacaataagcaaacaaaaattttgccacatagggaattggaaaggaggattggtgccatcccttgaagaatttgagtcaagaagcaagggggcaaccaccttaagagctattggactaagaagcactccaaattga

SEQ ID NO: 56074 - DNA, 291 bp, Glycine max
  Peptide Sequence Number=SeqID_147759
atggatcatttcaaggtccaacgccttaaaaggaccaccttccaagtgctaataccttcctcaaacgtaaatacaacttccgaatctggaatattctttatgaccggtttccttcgatttttccgacgttttccacaaataaacgttggtggcgactccgcgcattttcctcctttggaagacgcacctgtgagcctcgccttgctcgcccgcaaaagggtaggttgcgacagccacgaccaggctttccttgctatggtgaaaggcgaggaaagtgtcactcgttgctag

SEQ ID NO: 56075 - DNA, 346 bp, Glycine max
  Peptide Sequence Number=SeqID_147760
atggggacaaatcaaactggcaaaaggttttatcaagtcaagattaagggcctagatatcaccagcattaaggagttggggcggttgatgggacctctccaaatgcaagccttccgcaaggcatacggaaagatcttagatttgaccatagcagagatatccacagaaggcattgcatcactcacccaatactatgaccagcccttgagatgcttcacggccataccacggaagtacttcatgggaagcataagcgagtggatagtccctactgctacaatgatgttcttcaaaggggatgatacctctagaaaccatcaaagagaccgatataactaccttgggg

SEQ ID NO: 56076 - DNA, 1029 bp, Glycine max
  Peptide Sequence Number=SeqID_147761
atggatgacaacaaaagcaaagcactcgccgccgcactctctcaaattgaaaaacagttcggcaaaggctccatcatgcgcatgggggatgctgatatcggcgaagacctgcaagtggtttccactggctcattaggtctggatattgcactgggcgtaggcgggttgccacgcgggcggattgttgaaatctacggcccggaatcttccggtaaaaccacattgaccttgtccgccattgccgagatgcaaaagctgggcggaacggctgcttttatcgatgctgagcacgcactggatccgcaatacgcggccaagttaggtgtgaatgtgccggatttgctgatttcacaaccagatacaggtgaacaggcgctggaaattgccgatatgctggtgcgttccggttctgttgatatcgtggtcgttgactctgtagccgctttgacgccgcgtgccgaaatcgaaggtgaaatgggtgacagccacatgggcttgcaggcacgcctaatgtcacaagctttgcgcaaactgaccggtaacatcaaacgtaccaatacgctggtgatttttattaaccagatccgtatgaaaatcggcgtcatgtttggcaacccggaaaccacgactggcggtaacgcgctgaagttttactcatctgtccgtctggatatccgtcgtaccggcgcgatcaaaaagggcgatgaagtcattggttctgaaaccaaggtcaaagtcatcaaaaataaagtggcaccgccgttcaaacaggctgaatttgacattatgtatggtgagggtatttcccgtttgggcgaagtgattgagttgggtactaacctgaaactggttgaaaaatcaggtgcgtggtacagctataacggtgagaagatcggccaggggaaagaaaacgccaaagagttcttgcgtgagaatccagcgattgcggcagaaattgaggccaagattcgtgaaaactctaatgtgctggcagatggcatggccgctgccagaggtgaggacgattaa

SEQ ID NO: 56077 - DNA, 144 bp, Glycine max
  Peptide Sequence Number=SeqID_147762
atgtctggtcaaagaaaatttttcaatcatccactcgctaagcgcgccctgtgcgctaagcgaatcattatgcatgcgctgagcgagtcacctctcgcgctaagcgtatcaacccctactcattggctgaaagggcctagctga

SEQ ID NO: 56078 - DNA, 75 bp, Glycine max
  Peptide Sequence Number=SeqID_147763
atgagtgataaacgcgcagagacaaattctgcgccctttgtcattcaggagcagcgagtcgagtggttccgctga

SEQ ID NO: 56079 - DNA, 135 bp, Glycine max
  Peptide Sequence Number=SeqID_147764
atgaaggcttgcggttcttgctccctcaagccactttcggttgctttttgctttcatttttggtgttattattcactccaacaagtacaacataggagattcaaaataggtgcccgaatgcaattccaagcttag

SEQ ID NO: 56080 - DNA, 298 bp, Glycine max
  Peptide Sequence Number=SeqID_147765
ttaccctaccgttgagaggactacacgtcctcaccatcagagggttgcacgcccttacctccagaggactacatgtcctcgccttgagagggctacacgccctcaccttggaggactacacgtccttcagcaccagagggctgcacgccctcatctccagaggactataagtcctcgccttgagagggctgcacgtccctcaccttgggtactagttaccctcaccgtcagaggactacacgtccctcgccttgagaggactacacgtcctcattcagagggctgcatcgccccttaa

SEQ ID NO: 56081 - DNA, 495 bp, Glycine max
  Peptide Sequence Number=SeqID_147766
atgtgtaaggaaagtccagtggtggctatcttcgcatatcactatagcaaggaaagtccagtggtggctatcttggcagatttgttcgacacctttgaccggaggtgcgagaaaaacagtgcacggattgtctgttgtttacccgctctctgtgtatggttggtttcacacctattccaacaagacacgagacacccgtgtccgcttcaaagttatcgctcatgcaccgaaaaaggaagagtcgtttggggccaacatttggctgggatagggggcagcgcgatcaattggtttcctcgttggaaggaaggcaaggaaggagttcttttctcgtatggggactaccctaatattccattgatagggactagggggtgtattaattataatcccgtactcgccataagacaactagggtatcccatgaggggagcgccaaccgaagaaagtctctcgcctttccttgtgagggatctaggcgcgcaaggtctcaag

SEQ ID NO: 56082 - DNA, 150 bp, Glycine max
  Peptide Sequence Number=SeqID_147767
atgtccaacaaaacgcagagacaaattatggttccgctggcaggaaggttcactggccgaaagacaagtaaagaggggcaactgtcataccctaatttcgtccggggacctttgcttggtggcatgcaactttcatttgaccattttgag

SEQ ID NO: 56083 - DNA, 453 bp, Glycine max
  Peptide Sequence Number=SeqID_147768
atggctagtacattcttccttttgaaaaagcaaaatagtttagagattatgagcgggacaccacacgtgataagccagtcagaagtctataccgctgattcgatatatgagggtcgattctttgaggatcctaacaacgagggtttgacaatcgatttcgatcgagatataagccaaatgataaacgaggaagaggacgtcctgtcgccagagttggagaggttggtcgctcaggaagaacgtgaaatgaagcctcaccaagaagaaaccgaattggtaaacttggggaccccggaggaaagaaagaggtttcttagctgtggcgcggtacccggagtgggtggccaacattatcccagtcccgaaaaaggacggcaaggttcgaatgtgtgtagactaccgggacttgaaccgggccagtccaaaagacaattttcccctgccacacattga

SEQ ID NO: 56084 - DNA, 368 bp, Glycine max
  Peptide Sequence Number=SeqID_147769
atggagggggattcaatcatacacacagtggcatatgcagatgatgttgtcagggtaagtgtagaaacagttattgatcctgaggctgagcatccacaacgtattccacacaacgaggatgcacatgtgccgaagccggctaatatggacgcagatgatccgttacgtggattgataaagtacagtttcgatatttacgacaagccacttgaaatcagctttgacgggagctttcttggaattgtagatgcatctacatcgatattcatcacatattcagatgatagacgcagcgaatgcgaacaatatcttgaaatatggcttaaggaatctgaccgagaggtgtacattggaccttacttccatca

SEQ ID NO: 56085 - DNA, 477 bp, Glycine max
  Peptide Sequence Number=SeqID_147770
tggatcccgttcgatgcagatgctatcggccagctcctgggatatcctttagtgttggatgagggccaggagtgtgagtatggccagaggaggaaccggtctgatgggttcgatgaggaggccatcgcccagttgttgtgtataccggggcaggattttgcccggaccgctgccgggagacgtactgcacgcagagacaggtccagggcggccaaccatcaggcacatgtacagactcatgattgtctgtatcagatgagtctcagcctgcagagtcaaggctttacttcttttctgtgccctactacggaccagttcagggcagaggtcgcgtggcctggggattggcctgacgcccaggtaggagaggcaccagcaggggcaccagcagaggcccccgatgaggcagaggaggcccgcgaggacgaagagatgaccgatttacttgatttcttaggagggagcggagccgcatga

SEQ ID NO: 56086 - DNA, 232 bp, Glycine max
  Peptide Sequence Number=SeqID_147771
atggcaagagctggtgacaatggtggtgtatatcatcaactggacggatctcaacgcttatttctggatgccatgagtacacaaatgcaacgtttgttgaactgtaacaaagaagagctctacagacgaatagccaaatcttccttgtttactcttaaacctctatcccttagagaagtgtgtgataaccaaatcagaatgagagaaaagagagaacaagagaaagaaaata

SEQ ID NO: 56087 - DNA, 1051 bp, Glycine max
  Peptide Sequence Number=SeqID_147772
aatgttgctaagtagcaacatcatccatatctgtgtaagagtggtcatgttggtgcgcatgatccgcactcgtctctttgcagcggcacgggtgaaatcttggcccggtatgcatagtagctgcgtgatagcctccctctctggttgtgctcgcacagttggtcaccctccaatatcaggaggtggcccaggaactgataaagggaactattggccccttaaccgggagcgcaagtctcgggcgtgcaaccctctcaagctaaggacatgtcaccctttgaaggcgagggcgtgcagccctctgaaggtgaggacatgcagtcctctgaaggtgagggcgtgcagccctctgatggagaggatgtgtagtcctctgaagatgaggacgtgtagtcctctgaaggtgaggacgtgcagtcctcggaagatgaggatgtgcagtcctctgaaggtgagggtgtacagccctttgatggcgaggacatgtagtcctctaaaggcgaggacatgtagtcctctgaacgtgaggacgtgcagtcctctgaaggtgaggacgtgcagtcatttaaaggtgagggcgtgcagccctctgatggcgaggacgtgtagtcctctaaaggagaggacgtgcagtcctctgaaggtgagggcgtgcagccctctgatgacgaggacgtgtagtcctctaaaggcgaggacatgtagtcctttgaaggtgagggcgtgcagacctatgaaggcgaggacgtgtagtcctccaaaggtgagggcgtgtagccctacgaaggcacggacgtgcagtcctctgagggcgagggcgtgtagccctcagaaggagaggacgtgtggttcactaaaggtgaggacgtgcagtcctctgaaggcgaggacgtgtggtcctctaaagatgagggcgtgtagccatacgatggtgaggacgtgcagtcctctaatggcgagggcgtgtagccctctgaaggtgaggatgtgcattcctctgaaggcgaggacgtgtagccctctgaagatgaggccgtgtagccctctgaag

SEQ ID NO: 56088 - DNA, 234 bp, Glycine max
  Peptide Sequence Number=SeqID_147773
atgtgcagcgccaccgattacaaaattaaatcaatcgggggtatgtgcatcttaatccaaatgtgggcatggaaacgctgcacgactttggctccaaagaggactcctcttgtactagaaaataaaccactggggcacaggtgtctgcgacgtggaaaccaacatattgacaatgatgatctaatagttttccgtcgcaaattggatatcatgaaacgacatgagtttctgtga

SEQ ID NO: 56089 - DNA, 345 bp, Glycine max
  Peptide Sequence Number=SeqID_147774
atgacggagaaaaaaatgatgacaatgatagtagacacaataccggtattctattatgaaaagatggtgagctacacacgttcaagctttgatgatatggtcttcaccgacgaaaggatcgatgtgggtctgaaaaaaggcaaatttagtcatcctgcttggatgaatgagaaaactggggcaaatgaagagggtgaggatgaaggagaagcccgggctgtgactcccattccaatacagccaaatttcccaccaacccaacaatgtcattactcagccaataacaaaccttctccttacccaccgcccagttatccacaaaggccatccctaaatcgacaataa

SEQ ID NO: 56090 - DNA, 606 bp, Glycine max
  Peptide Sequence Number=SeqID_147775
atgacgttgttgctcagcaaaatcttgcccagcaatcataattccgacctccctctgccgaaatgtatgccgcctaccaggcaccctctagacccagataagtctaacagggccttgggatttctagcattgatcacgggtctctgccagtcgttcggggttcctgtcacacctagtaaggtgattcgattgccgatcactcaggttttcatagaaaagtattacacgcctagacaggcgcagggtggcgacccgcaggccccagacgcaccaccgccacctcatcaggctgatctagttgggtcatttgacacagagcggtatttacggcatttggttcaccggcaggcggccaaccacagggcgcacgtgcagacccatgactgtctctaccagctcagcctcagcctgcagagccaaggtttcgttccttttccatgccctactctggatcagttcagggcagaggtcgcatggcccggagattggcctgaggcccaggcaggggaggcgcccgcagaggctcccggcgatgcagatgaggctcacgtggacgaggagatgacaaatttactcaatttcttggaagggagcggagccacatga

SEQ ID NO: 56091 - DNA, 108 bp, Glycine max
  Peptide Sequence Number=SeqID_147776
aatttcaagttcaaccttcttggcacttctctctctctcgaaattgctgaggaaaattatttccatgaagaaaatccaagccgaggcgcttccgtaacgtttccgtga

SEQ ID NO: 56092 - DNA, 652 bp, Glycine max
  Peptide Sequence Number=SeqID_147777
gaatagggtggtcggaataccgaggaagcacttggaggagaaagcgaaggctttggcggatcaaggtgaatgggctttgttcattgatgtcttggcgctattggtatttggagccgtcgtctttccaactgtggatgggctagtggatctagcgacgattgacaccttccatacttatcaccatagcaaggaaagtttggtcatggctgttttggccaatgcctacgacacatttaaccggagatgcgagaagagcggcgcaaggattgtctgttgcacacccactctttatgtatggatggtctctcacctctttcatcatgaaagtagacctgtctatcccctacaaggtcaccacatttgccccgagaaagggaaggcgaattgggagcacctcttggccaatatggtagaggcatccgttaattggttcccccgatggaaggaaggaagagtcggggttttgtcctcatgtgaggggttctcaaacatccccttgatgggaatgaggggttgtatcaattacaatctcatccttgccataagacaacttggttatcccatgagaagagcatcgtcagaagaaagtatcacacctttcatcgcacggggtttcagtgaccccaatgcaaggatatttcaaagagtttga

SEQ ID NO: 56093 - DNA, 216 bp, Glycine max
  Peptide Sequence Number=SeqID_147778
atggttggagcattctcgcaaaacatcgtgaccctgactggtctccctatgatcttacttagtgagagtgacctgacaaacccattgtttggtgtgtcttattatgtactcctaagcgtcccagggtggtttttcactgacatgatgactaggtggattgctttaaggaaccatatgctgaaggacgtcgggacacaacgctctgataggatgtaa

SEQ ID NO: 56094 - DNA, 163 bp, Glycine max
  Peptide Sequence Number=SeqID_147779
ggaattggaaaagggaggaattggtgcccatcaattgaagaaatttgaagtcaaagaagcaacgggccaaccacccttaaagagctattggactaagaagcattccaaattgagtgaaacaccaaagagagaacaaccaccaaaattgaggacttttctgtaa

SEQ ID NO: 56095 - DNA, 282 bp, Glycine max
  Peptide Sequence Number=SeqID_147780
atgagacaatttggaatgcaacaacctattccgcgcctagtaatgcaacccaacaacatacatgacttgacattaaagggaaaagaaggaaaaaattggatgcgactaatgcaactcgcgcttaatgaatggaatagtcgctatgaaaggagagtagagcaagcgccgccacaaacagggacccttagtatgaactcagaatatatgaggtggtacaggcgtaaaacaaaaggcgaaatcgtcgaaacaatgcattttatggtgtcgcctcttgggagaagg

SEQ ID NO: 56096 - DNA, 337 bp, Glycine max
  Peptide Sequence Number=SeqID_147781
taatgcacggctagacaggcacagggtggcgacccgcaggccccagatgcatcgccgccacccccttaggctgatccagctggccaaccacagggcgcacgtgcagacccatgactctctctaccagcttagtctcagcctgcagagccagggttttacttcttttccatgccctactccgaatcagttcagggccgaggtcgcatggtctggagattggcctgaggcccaggcagcagaggcacccgcagaggctcccaacaaggcagatgatgcccacgaggacgaggagatgaccgattttcttgatttcttgggagggagcggagccacatga

SEQ ID NO: 56097 - DNA, 375 bp, Glycine max
  Peptide Sequence Number=SeqID_147782
atggccaaatacaggctaaaagcccaagtggagaaggacgaaggctcaagtggagaaggacaaagccctcgagtggagaaggatgaaggcccagaggcaaagacactatcaagactattaattacttatcaaggtaatcctggtggcgtctaccctgacttatcttccttcactggaagtggcgtctacctagacttatcttccttcattggaagtggcgtctaccctgacttatcttccttcaccggaagtggcgtctaccctaacttatcttccttcaccggaagtggcgtcatccaaaccttcgtagcctgtatcaaacgatccgctcctactcaggttcacatcatctggtatcagagcttcagctcttga

SEQ ID NO: 56098 - DNA, 102 bp, Glycine max
  Peptide Sequence Number=SeqID_147783
atggagaattggcgaacagcgctaggcgatcaattcgcggggctccagactcaaggctccagactcgaaggtggaggacacatgaacagcgctaggcaatga

SEQ ID NO: 56099 - DNA, 472 bp, Glycine max
  Peptide Sequence Number=SeqID_147784
atgacgaagaaaagtgctgaaacgtctcgagctgatgtgagacccaagaaacccactgggggtgaagatccaagaagggaaacaagaagagaagaggcaggcaattcccaggctcaaatgcctaagaagaaaaagaaagtgaagcaggtcgagcctgaaccttctgtgactgtcgagggtggtgagccagccaggaagaaaaagaaaaagaccaagtcttcaaaagaacaaggtgacaatcaacctgttgacgtccaaccaccttcgactgatgttgacggcactgaagcagaggctactccctctattgctgagaagggcaaccctgtcgagcaaccggacttaccacaagaacaacctaccgtcgaggtacaacaaaatgtttctgtagaagaaataccctcatgtgctcgaacatctcctgctcctgagacggatgcagtgaatgctgaggaacagggtgaaggtcaag

SEQ ID NO: 56100 - DNA, 2286 bp, Glycine max
  Peptide Sequence Number=SeqID_147785
atgattgaaaagaccatcggtggccaggatgcactcccgaacatcagcgacgccgagcggatcttcgctgaactgctgcaggggctggctgaggcacaaccgggcttcccgctggcacagcttaagtcttttgtggagcaggaattcgcgcaaattaagcacgtgctgcacggtattagcctgctgggtcagtgcccggacagcatcaacgcggcgctgatctgccgcggtgaaaaactgtcgattgccatcatggccggcctgctggaagcgcgtggccacaacgtgaccgtgatcgatccggttgaaaaactgctggcggtgggccactacctcgaatccaccgttgatattgccgaatcaacccgccgtatcgccgccagcaaaattccgtctgaccatatgatcctgatggccggtttcaccgccgggaacgagaagggcgagctggtggtgctgggccgtaacggctccgactactccgccgccgtactggccgcctgtttacgcgcggactgttgtgaaatctggactgacgtcgacggcgtgtacacctgcgacccgcgccaggtaccggacgccaggttgctgaaatcgatgtcgtaccaggaggcgatggagctctcctatttcggcgctaaagtccttcacccgcgtaccatttccccgattgcccagttccagatcccttgcctgattaaaaacaccggtaacccgcaagcgccgggtacgctgattggcgccagcaccgatgaagacggtctgccggtgaaaggtatctctaacctgaacaacatggcgatgttcagcgtctccggtccggggatgaaagggatggtcggcatggccgcccgcgtgtttgcggccatgtcccgcaacggtatctctgtggtgctgatcacccagtcctcttccgaatacagcatcagcttctgcgtgccgcaggctgactgcctgcgcgcccgccgcgcgctggaggaagagttctatctggagctgaaagaagagctgctggagccgctcgcgattcaggagcgtctggcgatcatctccgtggtgggcgacggcatgcgcaccctgcgcggtatctctgccaaattctttgccgcgctggcgcgggctaatatcaatatcgtggcaattgcccagggctcgtcagagcgctctatttccgtggtggtggataacgacgatgccaccaccggcgttcgcgtggttcaccagatgctgttcaacaccgatcaggtcattgagctgttcctgatcggcgtcggaggcgtgggcggtgcactgctggagcaggttaagcgtcagcaggcgtggctgaagaagaagcatatcgatctgcgcgtctgcgggattgccaactcaaaagcgctgctgaccaacgttcacggtctgaatctggaaaactggcaggccgagatgaaggaggcaaaagagccgttcaacctgggccgcctgatccgtctggtaaaagagtatcacctgcttaacccggtgattgttgactgtacgtcaaaccaggccgttgccgatcagtacgcggacttcctgcgtgaaggccaacacctcgtcgatggattactaccaccagtgcgtctggcggcgagcaagtcgcgccgcaagttcctctacgacaccaacgtcggggcaggcctgccggtgattgagaacctgcagaacctgctgaacgcgggtgacgagctgcagcgattctccggcattctctccggctcgctgtcgtttatcttcggcaaactggacgaaggcatgagcctgtcggaagcgacccgcgccgcccgtgaactgggctacaccgagccggatccgcgcgacgatctttccggtatggacgtggcgcgcaagctgctgatcctggcgcgtgaaacgggccgcgatcttgagctttctgatatcgtgattgaaccggtactgccggcagaatttgacagcagcggtgatgtcggcgcctttatggccaggctgtcgcagcttgacgacgtttttgccgcccgcgttgcgaaagcccgtgatgaaggtaaggtattgcgctatgttggcaacattgaagaagatggcgtgtgtcgggtgaaaattgccgaagttgacggcaacgatccgctgtacaaagtcaaaaacggcgaaaacgccctcgcgttttacagccactattatcagccattgccgctggtgcttcgcggctatggcgcagggaacgatgttacagcggcgggtgtgtttgccgatctgctgcgtaccctgtcatggaagttaggagtttaa

SEQ ID NO: 56101 - DNA, 219 bp, Glycine max
  Peptide Sequence Number=SeqID_147786
atgcaagccttgatatgtactaaaaattggttactacgatttgatatgcaaggaaaagaagatgaagatgtggagatggagaagactcaagctacatcaaatatagaatcattttttgttggagatgtttcatattctaaagcaagcacaaaggaaccaagtgctaaaatatccaaagccaaatacaaggatgaaatagtaaattgtccagaaaattaa

SEQ ID NO: 56102 - DNA, 707 bp, Glycine max
  Peptide Sequence Number=SeqID_147787
tcgagaggggttttgacgaaaatgcaattgaggttcagcttcaggggagaagctctgtaacgaagggaaaacaagggagggttaaggagacagagggtgttttgaatggagcagtttattctcactgccatggcttcttctcagttcagaagattatcaggctatcgatgaagaagcatccaacaggcatgctcttcaaactattggagattctctgtaacttcaatccaagcaagttgacgctgtccaatagatcaaagatttctataagatctccagaatcaagagacaagaagattcattcatgcaaaacaaatccaaaaagaaacacaaacaagatacatagagagtcgaaagattcccaaaacccaaattcacgcagtgtgccttgcatgcccatcaaggctgatttgaagtggccgaaagaggcatggattctgggtcaagatgtttcttccgggttcactcctagcatcaggaagaagcccaggttttttgttcaacaggaagaagcacaggcatggagcaaacttaatttgctgcaggatcatcaaccattaggcgccaaaaaaggacagtctttgagggtggcactcctttcacttttgaaatacaggttgcacagttcaaccagtttaaggcacgcatcggaaagttcttcaggcaagaagggagaaactccttcagataacactttcataggctag

SEQ ID NO: 56103 - DNA, 192 bp, Glycine max
  Peptide Sequence Number=SeqID_147788
atgttgatgcacaatcccacccaggcccatttgggccctccagaagattcctccagaaggcggttgcttctggaggaagcaccctgctcgcctgggcgagctgagctcgcctgggcgagctgggcggcaacacctcccctatttgctataaataggggaggaaatgacgaaggaaggggtccagccccttag

SEQ ID NO: 56104 - DNA, 480 bp, Glycine max
  Peptide Sequence Number=SeqID_147789
atggttgctagtgatattgccatcttaagagacaaagcccacttcccaaccaagaagagcttattggagcttacatcgcaagatacgttgttggcacagaacaagttgctatccaagcaactggaggcattaacagaaacactcaggtgtgccatctgtggtggagctcacaattctggttgttgtatcctcaatgaagaaccagctcatgaagtcaattatatggggaaccagccaagacaaaatttcaatgcagaccagggtggtccatctacaaggccacaacaacaagggcctagtctctatgatcgaacaacgaagctggaagagactctagctcaatttatgcagcaattagcatataaaccatcaagcagttttatagcaaacacagagaaaaatcctaaggaagagtgtaaagttgtaatgacaaggagcagaatggcaattcaagctgatgaaggtagagctaaagggaag

SEQ ID NO: 56105 - DNA, 132 bp, Glycine max
  Peptide Sequence Number=SeqID_147790
atgtccaaaggaaatgataaaggaaacaatgaagatcctccagaagaagttaaatccaataatgaacttccaagagaatggaaagcttcaagagatcatcccctcgaacattatggtgatatctcaaaaggg

SEQ ID NO: 56106 - DNA, 486 bp, Glycine max
  Peptide Sequence Number=SeqID_147791
atggagagaagtatgatagatgctgccagtggtggagcccttggagacatgacccctgctgaagccaggaatttaattgagaagatggcttccgactcccaacagtttagcgccataaatgaggctatagtcattagaggagtgcatgaggtagccacaaactcatctgcatcatctgaaactaagaagcttgaagttaaactagacgccttggttaacctgcctgaagcttatgctgcaaacatctacaatagacctcctcaacctcagcagcaaaatcagccacaacagaacaattatgacctctccagcaacagaccatatgttcctccacccatccagcagcaacaacaaaagcagcaaccgcaacagccccagaaacaacaaacagttgaggctcctccgcaaccttcccttaaagaacttatgaggcaaatgactatgcaaaacatgcagtttcaacaagagatcggagcctccatttag

SEQ ID NO: 56107 - DNA, 311 bp, Glycine max
  Peptide Sequence Number=SeqID_147792
gggctctatggggcagtaacagcgagcttaaactccggagagaggaaagggaccaatcacgagtagacagtttgatcttgaaagatgagctaaaggctagagggagggtgatcaactcattacatcaagaggcgacaatgtggatggaccgatttgctcttactttgaacgggagtcaagaacttccccgattgctagccaaggccaaagcaatggcggacacctacttcgccctcgaggagatccacggactcctcagctattgtcagcatatgataaacttaatgacccatataattaggaacctctag

SEQ ID NO: 56108 - DNA, 294 bp, Glycine max
  Peptide Sequence Number=SeqID_147793
gtggttgtcatcatcaaaaagggggagaatgtaaatcatgaagattttgatgatatcaagaagaatttgcttgagaaagagggagataagaatctaacaaggctgcttcaaatgataagcatttgcttcaagaataattcaagattgcttcaacaaacaaagccttgttcaagatcactaaagaccaagccttgccttaaaacaatgtgctttcaagacatgcaaggctctggtaatcgattaccaggaagtgtaatcgattaccagaagacagggttgagaaatagctgttga

SEQ ID NO: 56109 - DNA, 717 bp, Glycine max
  Peptide Sequence Number=SeqID_147794
ggactagtgccgctcccgagttcgatagccatcgcttcaggagcgctgagcaccagtagcgttttgaagccatcatgggatggtccttccaccgagagagacgcgtcagctcaggacgacgagtacacagatttccaggaggagatagctcgccagcgtggacgttgctggtcactcccatggccagttgatccggatatagttctcgagttttatgccaatgcttggcctacagaggagggcgtgcgggacatgcggtcatgggagtgcgagtacattcagagaaggaaccgggccgatggatttgacgaggaggccattgctcaacaactatgcataccaggtcaggattttgcccggaccgctgccgggagacgggtgcagatcatgcacaccaacatgactaccttgacccagacatggatgacgttgctgctcagcaacatcctgcccagcgatcataatttcgaccgccctctgccgaagtgtcagctggtgtatgccatcctgacacggatgagtgtccatgtggctcagttgatcgctgatgccatttatttatttgcaggtatgccgcctaccaggcaccctctagacctagataagtctaacaaggccttgggttttccagcattgatcacgggtctctgccagtcgttcggggttcccgtcacacctagtaatggtgattcgaccgccgatcacccgacctttcag

SEQ ID NO: 56110 - DNA, 384 bp, Glycine max
  Peptide Sequence Number=SeqID_147795
gcgctgattgcaccagcacaaatacatctattacgtaaagggctgtccattgtcgttaagaaaggacgcggcaataagattgctattatgcaaatcggtgatgatttttacccgtatttaaaggatagtttcacccacagtgaggtcctgcaatccggcattgcggtcaacgcggatataattgccgcacaccagaccagcgcctggagcggaagtaaaccgatctatcgtatcacctttaaatttaagacccgcgagcaggtggaagttcaagctagcctgaatcacaccctgaatttcagcgacattgaacgttttaagccgggagataacatggaaatcgtctctaccatagtgctaaccatggcatgggccattccgctg

SEQ ID NO: 56111 - DNA, 240 bp, Glycine max
  Peptide Sequence Number=SeqID_147796
atgagtgttcaatgtaatcaagcaagtcggagacctagcatgaccacagattcacctccactccttatgttcccatggaccccgtccccagtggagtcgccaacagtcgcaatctacccttcggcgggagggcgacatgagactcacgggatgcgtcttccaagaaaggaatacgtgcagagtcgccaccaaagtttaaacgtcggaaaaaccggaaaagacgtggtctacgaactttaa

SEQ ID NO: 56112 - DNA, 297 bp, Glycine max
  Peptide Sequence Number=SeqID_147797
atgatgccccatcgcaaatccaaacgacccattcccctttccttctggatctccggcaaaaggccggaaacctatggagacacccaagaaaatcaacaaggaagactcgggcgaattctgacgggcaaacctcgaaagtggaaatcgaatgccgacgcaaattcggatgaccataactttcaactcggttgtccgatagatttttatgatatattgagaccgtcgttgcttgcaaatgcctgcaggtcgactctagaggatacaaacccacaacatttcctccagatctccgtgtaa

SEQ ID NO: 56113 - DNA, 461 bp, Glycine max
  Peptide Sequence Number=SeqID_147798
attctcccctgctgtgatcaacaaatacctggacagaccaacaaatggagtgatggatattgctgtctctgagcatcaaattgccaagggaatcactgccaaacgagtccagcattggccaaagaaagggaagctttctgcagggaagctgaggggagctgctgctgctgatgatgactctgattgggagctactagaagatgctgcagtaagagcatggagacagggggagcagatagctgatgtcacaggagacgtcttgacatcctggagaagactagtagctgatagaagatgctgcagtaagcatggagacaggctgggagcagaagcagaaagcagatgtcatgtgagatgtcttgacatcctggaaacgacttgcaacttgtctagactacagattccgctgtgcttgattactctgataatggaagttgctgatcccacttgcataactgctc

SEQ ID NO: 56114 - DNA, 153 bp, Glycine max
  Peptide Sequence Number=SeqID_147799
gtcgactctagaggatcccacgttaagagactgtgagtctcttgttgtaaagcatctgaacacaagggatgggttgtccctgtgtggttcagactttgtaaaggattttacaaagatagtggaaatctcaagtgggttgcttgagtactggac

SEQ ID NO: 56115 - DNA, 781 bp, Glycine max
  Peptide Sequence Number=SeqID_147800
gactacacgtcctcacctctagaggactacatgtcctcgtcttcagaggactacacgtcctcgccatcagaggactccacgtcctcgcctttagaggactgcacgtcctcgccttcagaggactgcacatcctcgccttcagagggctgcacgccctcacctttagaggacttcacgtcctcaccttcagagggctgcacgtcctcaccttcaaaggactacacgtcctcaccatcagagggctgcaagccctcgccttcagaggactagaagtcctcgccttcagagggctacacgccttcgcttttagagtactacacgtcctcgcctttgagggctacgcatcctcactttcagagggccaactgtgcgagcacaaccaaaggaaggctatcgcccagctactgtgcataacggggcaaggtttcacccgtgccattgcaaagagacgagtggattgcgcccgcaagacacccagcggacccggagaagcccaacagggccctggggtgtccagctctggttacgggcctctgttagtcctacagggtgccagttccccccaacaagggatcgcgcccgcaagacacctagtcaacccgaagaagtccaaaagggtcctgaggtttccagctctgattacgggcctctgtcaattctacggagtgcccatcatccccagcaaggtcatcaggcctcctactaaccgagctttcatcaagaagtattgcacccccagacaggcagagggcgagacaccacaacagcattgggatggccg

SEQ ID NO: 56116 - DNA, 321 bp, Glycine max
  Peptide Sequence Number=SeqID_147801
atggcttccaactcccaacagtttagcgccagaaatgatgctatagtcattagaggagtgcatgaagtagccacaaactcatctacatcatctgaaactaagaagcttgaaggtaaactagatgccttggttaacctggtaacccaactgaccatgaatcaaaaatctgcacttgtcaccagactctgtggtttatgctcctctgccgaccaccacacagacctttgcccttctgtgcagcaatctgaagcaattgaacaacctgaagcttatgctgcaaacatctacaatagacctcttcaacctcagcaacaaaattag

SEQ ID NO: 56117 - DNA, 255 bp, Glycine max
  Peptide Sequence Number=SeqID_147802
atggctatgcttcactgcttttcaagattctcagagcagaatccctctaggccaaccctggatggggtccagtttccctcccttggccaagggaagaaggaaagccttgttgctagattctctgaagtggaaatgaaatcagcagtgtggacaatgtcccctctgttcagccagctggtggtttgctttctttatggaacaattcagcttttcatgtggaaaggagaattaaaggccatagctttttatttttag

SEQ ID NO: 56118 - DNA, 627 bp, Glycine max
  Peptide Sequence Number=SeqID_147803
atggcttccaagaaaagaaagttcattgcttcttcatcttctcatatcaaatttgacaaatcaagattccattctcaggaagcttgcgacagatataatgatattgtggtgccaaggaaactactactagagagaaatgtagtagtatactacactgaatttgacgaacttaaggaggaattagaaagaagaaaatgggataaggagttgacaagcttcactgaaggtagtattgatgtagctattgtcaaggaattctacgtaaacctctacgactcggaagacaagtcacctaagcaggagttggctgctaagctctacatcccagggaggggatttgagctaaatgctgatggtcagcctttgaagattttaaggaagaacatgatcactttagctcagacatggagcgttctttccatctctaacttggttcctacctcccacacatctaatgtcacattaaacagggccaagttaatctatggaataattatgaagatggacatgaatttgggttacctcatctttcaccagatctctattatagctcagcatgactcctctaggcttggatttccagcattaatcatagctttgtgtaaagctagaggagtcacatcatga

SEQ ID NO: 56119 - DNA, 453 bp, Glycine max
  Peptide Sequence Number=SeqID_147804
atgtctcctccacctctagaacctcacaatcactcacagactcatctcatgctctcaggaagacttcctcttcaagctcggttctttgcaggtggctttgttcgtgcttgcgcgcttagcgcaactctgaaccacttagcgtgcattagtgaatttcagcttagcgcgcatcttctcactcagcagatggactcaagcggtgcgcttagtgggatgaaccctcactcagcgaacatgcacagctcatccttcttccaggttcttccttgcactcagccgaggagtgttacgctcagcggatggctcgctaagccagcagattggcttagcgagaggatgaaaagcaacacttcacaaacttgcctaattaacctgaaattgagaggaattgatattaaaacacacaaaatggaagtactaagtatttattacctatctttaacaaaaaagtga

SEQ ID NO: 56120 - DNA, 87 bp, Glycine max
  Peptide Sequence Number=SeqID_147805
atgagcaagatgctccaagaggattgggctagagctgctgaagaaggctctagggttctcatgaacctcaggggctctataatgtag

SEQ ID NO: 56121 - DNA, 741 bp, Glycine max
  Peptide Sequence Number=SeqID_147806
atgaacacattcattggctggccaactaatcttgtcaaacctttctccgctgattccaatcaagatgtaaggaatccaaaaggacatattgatcggtcaaatgcaggtgttgcaaaggatccacttggagaaatcatgaaaatactttatgaagtgtatatgaatccagtggaactcccttgggaggctagccgatttggaattccaaatatagatgccaaattttacatcacacatgctgatatggctgaaataatatcaggtcacaagtgtttaaaaatttctatactacaactatggatgatgtatttggatgagtgtgctacaagcagaggtgatggctcagtgtatggcttccttgagcctcaatcaatacacattggtaaggaggactgtcaacaatgtcaactttatattgagacatgggtgaaggaatcacaacgatgcttgtacttaggagcatacttgcatcatgcaatgaagacaataagtagttctttggaaggcatgtctcagcaaggtccacctcggtggattgaacccaagagtcatgttcaaagtggagggtacgagtgtggatactatgtgatgcattggatgtggtgcatcgttagtggtcgtttgaaggatgactggaacaggtggttctcggatggatcagcattagacgtggaggccatgacaataattcgaaagaattggacaacttactttttagctactagaaataacatatgctaa

SEQ ID NO: 56122 - DNA, 1545 bp, Glycine max
  Peptide Sequence Number=SeqID_147807
atggagttcaaagataaaagaatgaaggcaacgtctgagattctgaatagtatgagaattctaaaactgcaagcatgggagatgaagttcctatcaaagattattcagcttaggaagactgaggagacatggctaaagaaatttctagttggtacagcaattgttagatttctcttctataacaccccaacttttattgctgtggttacatttggtgaatgtgctcttatcggaatcccacttgaatcaggaaaggtcttatcagcacttgcaacattcagaattcttcaaatgcccatatatagtcttcctgacaccatttcaatgattgcacaaactaaggtttcccttgaaaggattgcatcatttcttcgtctagatgagtggaagactgatgtagtagagaagcttccacgggatagttctgataaggcaattgaattagtagatggaaatttctcttgggatttatcttcccctaatccaacattgaaaaacgtaaatctcacagtttttcatggtatgagggttgttatatgtggtacaaaggcttatgtttctcaatcaccatggatacagagtggcaagatagaagacaacatattatttggtaaagagatggatagggaaaagtatgatgaggtgctagaagcatgttccttgacaaaagaccttgaggttctaccatttggtgatcagaccactatcggagagaagggaatcaatttgagtggtggacagaagcaaagagtgcaaagagcccgtgctctataccaagattctgatatatatctgtttgatgatcccttcagtgcattggatgctcatacaagatcccatctctttaaggtcatgagagaaggaagaataactcaatcaggaaaatacaatgacattctcaggtcaggcactgattttatggaacttgtaggtgcacacaaagcagctttgtcttcaatcaagtccttggagagaaggccaacatttaaaacatcaactaccaccaaggaggacacaagttcagtaagttgttttgaacttgacaaaaatgtgaaatacatcacaacagcttatggaggagctcttgtacccttcatattactttcaacgatactcactgtggcttttcaaattgctagcaattattggatgattttggctactcttatgtctacaactgcagaacctgatattggaagctttaaacttatggttgtctatgttgctttggcaattggaagttccattttcacctttgccagagcatttcttgctgtgatagctggatacaagacagccactgcttccacagaccaaaatgcactagatatgaacatttcaaatctagtatgggcaattgtcttcaatctggttcaaatattgggaaatattgttgcgatgtctcaagctgcatggcagacttctcttcgacagggcttagtgatgatgggtcacaaacttctctttcaacacttggtgaagacaggggatgctggtgaaggccaaaggggacgctgggtgaagagtcgaaagggatggctgtaa

SEQ ID NO: 56123 - DNA, 438 bp, Glycine max
  Peptide Sequence Number=SeqID_147808
atgaagatctttaaagggtataccaagaatctgcaccgtccggaagcatctattgttgaaagatgtgcgaaaaaaggcacaggccatccagaaacaaaacactgcccctcacgtgctatctcgtggggttatgaatatttagaaaagaagttgatggatgagaagagaaagaaaaaactagatgaagttgctcaatccggaagcattgatacaatcattgatcctccatctcctatcaaacgacacgtgaagtggaagctagcccgcaccaagaaaactggtcacatgacatctgaggcagcaaaggaaattgctgacaagattgattcgtttgaggagcaggcttcacagggttcctttgtcgctcatggatgtcatgatgttctgactgctgccattgggcgaccagaacaccctggtcgtgtgcgtgctatatga

SEQ ID NO: 56124 - DNA, 291 bp, Glycine max
  Peptide Sequence Number=SeqID_147809
ggtgtcacaaatctcccttgttacacttacgcttccacttcactttctcacgttcattgctcatgtgcaagactcgttgtcttcctcgtcctcttcgtccttggactccgactactcttcgtggcggcggtggaggagacacgagaagcaacggggcagaaagagcgaggaaaagaaggaggaagaagagagacaaagagcggaaaaagaaaaagaggctcaacaattttgatgactcatactcttcggaggagtgagatgaacaacccagggttccgcctgaatctttga

SEQ ID NO: 56125 - DNA, 477 bp, Glycine max
  Peptide Sequence Number=SeqID_147810
atggccaccgttgtagctaccacattaattgcctccgccatcaccactgtcattaaccaccaccacctctgccaccgtgaccttcgttgtcaccactgtcaccaccactatcaccatcttccaccactaccattgtcaattacccctagacccactaccaaaactgtcattgttggtggcggtggcgacaacaacgatgacaatcatgacggcggaggtgccgatagtcgtggtgatgatgatgggttaatcataaataatggagatcttataggatgtgatttgtttggtgaatctttcagagatataattgttatatttgggtccgtttggggtagttgcaagtttttgctaccactatcaccaccaccaccattgccattgccacccccacctgtgaatcatgcaggttttgatgatgccaaagtattacctaaagatgtttgtcatcataaaaaatggggaaaatgtgaatga

SEQ ID NO: 56126 - DNA, 327 bp, Glycine max
  Peptide Sequence Number=SeqID_147811
atggatgccaacaccttagaaactcaggaatcacttaaaattagtgagaagaagaagaaaaaggagaaaaatccaagccgaggtgcttccgtaacgctttcgagacgtttccgtgagcgattccgtggaagttcttcgctattctccgtcgttcttcattcgttctttgtcgttcttcggtcttcaaccatgaaactaaggctaaaatcaactcacaaaccaagctttgtctgcaaaagtcacttaacatggaccgttttaaggtccaacgccttaaaacgatcctctttgcttttatcggttaacatggaccgttcaaaagcataa

SEQ ID NO: 56127 - DNA, 1104 bp, Glycine max
  Peptide Sequence Number=SeqID_147812
atgcatgtttgcttcgtaactgatagcctcactttgtttgtttctggtggtgacgacaaggtcatccacgaagaagcatacagcaaaattatggctcgcattccggataagataaagaacatcaatggatcaaaagaaacccttaaacttgttgtgaggataactgatctttggtttgttgggacgcccgacaagtctgaacaagctgagatggttatagtggactccgatggtgatgaaatccatgttgtttgtaagcaagatcagctaaagtcttggaagatggatttgaaggaaaattgtacttatgtcatgcacaattttaaagtcatcaagaatgatggtcaatacagagtttgtgaccaccaatataaattagcatttactagagttattgttgttatgcaatctgatttggatggtcttccttttaaaaatttcaaatttgctgaatttgccaatgtcattgttggccgcttccaacctagtctattggttgacattattggtgtcgtttatgaggtggtcttctgccatgtttcatcaaggagtacaagggttgtttttaaactgaaggacttgagtgaccaattgttatcttgcactctctgggaagattattgcttccagttcttagagtacttaaatgagcttgaaaatgatggccccataattgttctgttgacccatgctagaattaaagaagcccaaggatcctatccaccgtcggtgagtaattctttgaaggcttcaaagttacttattaatcaaccggtggttgaaattcaagaattcaaacagaggctttttgaattaggcattgaggtctggtcagttttgacacctcgtggtcaaggcagttcacagctttcaggttctacccaattatcatcaaaggatgcatttttttcaaaggctgaggcaaagagcatttatgagattaacaacatttttgaagaaattgtttgtgttatcgttggcacgattaccagaattgttatggaaaatcattcatggtgttatccagcttgcattcactgtcacaaaaaaattgatatagacactgctccattcacatgcgcatgtggcaaatataatgagtga

SEQ ID NO: 56128 - DNA, 507 bp, Glycine max
  Peptide Sequence Number=SeqID_147813
atgaaagctgggaggcttagtggtagtgttgggcccaagaaccagttgataagtccagcatcgcatctcccattctacattgatgttattgagaccaagtgggaacatgatgacatgctccatatggatcacttctctgagttcctatgttgttgtcgtatactagatgttcaggagctaggatttgtatcattcactttttcttttcatggaactagactacgttgtcctattgtcgcttcgcgatgcccatgcttgagaggactatccaaggaggaagagcttggcttgagtggctcaacatggatggaccaatcactagagcaaggagtaagagatttcaaaaagagtttggttccatcaattggtatcaaagccgatggttcaacttggtgtccggctccgacgagtaagatgatgatggtggagatcccttgtattgaaagtcttcctagaggaaggtccaggcagcatgtcccatgggtggagcggcgatgcaatatctag

SEQ ID NO: 56129 - DNA, 144 bp, Glycine max
  Peptide Sequence Number=SeqID_147814
atgacgttcttttctcttagaagtcaaccactaacagattctttagtgcatcgcataatttatatcggtcacatctatggcaatcatttttttcaggtttacttaaaagaccgttgtcctttacctcctgtagcattgttatga

SEQ ID NO: 56130 - DNA, 1128 bp, Glycine max
  Peptide Sequence Number=SeqID_147815
catgataaaggtggcggagataatcacgatgatgctatagtcaagtcgaataatgagtcagttgggggaatcaatcatgaggatttagttacgaattctaatgatagaattttgaaaacagaccccaacatttatgggccttggtttcttgttaagaagagtatgggtaaaggcggcgtcaagggaaaggttaatggaggcaatgcgagaaattctacgaatgaccatgtaatgcatgatgaggctggtggcccaaaagatatgaaatgggttgttccagaattgagcaacaaaaatgacacaaaggggaataagaatcagaatggggcctcaacgttaggcccaaaacagggggtggatgaggcgaagaaggattcaagtttgaacaacttagacatgattcatgcactccataataccaagtcagggttcatgtttagtgcaaaatttataaacaacaattcggggaagtcaatgttcattctagatgaagaaacaatgagattgatccaggtgaaaacaaaaattctcttaaaaaggggttcttcgtctttgccacctgatggaaaaggaagtgaagttgttgtcatcaaggagatgagtgtttcttatgctatggaaactaatgttgtgagtgtggctaacgctatgaaaattgaagttgtagttcagaataagaccagggctactagaccagataagtctaggggtctgtggtgtttgcggaatcctaatttgtggcgggtcaaggtgttagaagaagctgctcaaattctgcatttggaagaatcaaagaggattggtggaactgaatctcttaatcacaaaggtaggagggcatttagagaggttatggattattgtcatatgctggatgcagcttggctgacacaaccagagctaagaatggtggtggatggaaactggaaaaaagatgaagaagctggaaagggatctttggaaggaattggaggaagtgttatttcagaaagatgttctttggttctaaaaatcaagatgtttccaagtttggagaacaaggagattgagatgctgagaggtgatatctcggatgacgaagttaggaaaacaattttccatatgggggtgttacaaggctttgggtga

SEQ ID NO: 56131 - DNA, 231 bp, Glycine max
  Peptide Sequence Number=SeqID_147816
atggctcaaatctttgggattgaattaaagttgtttgggacaagtttgtggctgtctaattggattccagagttaggtcccttggttgagtttgcaacaagggagcttaatgggaaggatttgaccaagacaattactgagttggtggtgcacgaaggaggttcgaattctgattacttaggaagtagtttgatgagaacattgaaacttaaggatccacacaagaactag

SEQ ID NO: 56132 - DNA, 282 bp, Glycine max
  Peptide Sequence Number=SeqID_147817
atgcgtatttggtatcaaaagctactactcatcgaactcatcaactcagaacttattaggctgatacaatgtggagagaaggaactccctcggccactcaaccaatccaaagagtatattcccaacaaccttgaaaggtgcaacgctccattggtacactcgcttgccgcaaaactcagtagactcattcgtagcccttatcacatattttggagctcaatatgcgacaagaatatcccatcatttgactacagtggctctcacaaacgtttggcaagatga

SEQ ID NO: 56133 - DNA, 333 bp, Glycine max
  Peptide Sequence Number=SeqID_147818
atggaggctcttcaaaaactgcttcaacagtctatggtaattgcagaaaaaggtggtactactgtagtggctcaaagaggcaattttttacatgccctaaacattagcaaagaaagaacaaagtcatggatcattgacttaggagcctcagatcacatgactggagattttactttgtttagtagttattctccatgtccctataattatactgtccggatagctgatgaaactcattctaaggggaagatgattggcaacgctgaagagtgtgttgtactctccttcaagttgaaaaaccagaagaagaactcaagaaccattcttatgtag

SEQ ID NO: 56134 - DNA, 225 bp, Glycine max
  Peptide Sequence Number=SeqID_147819
atggacaggagatgcgctattttgtacaacatggaagaggaggcaggacatatgttcttccactgcagcaaagttatacctatttggtgggaaacactatcttgggtgaagaagtctacagccttaccgtatgatccaagacatcatttcctacaccatggatctatattgaatgaggggactagggctaatagatggaagtgttggtggctggcagtgacctag

SEQ ID NO: 56135 - DNA, 156 bp, Glycine max
  Peptide Sequence Number=SeqID_147820
atggatgagtgggaggatggtagtggcaaaatggaggtcgtagaggccgtccgacgagggcaaagtgaatggcgccacgacgagtgtcttatgagtgacaaggggctgctccaccctgatactccgctatcgcacgctattgactactatgactaa

SEQ ID NO: 56136 - DNA, 436 bp, Glycine max
  Peptide Sequence Number=SeqID_147821
atgtgctttgtcgatggtgagactgacaaagcagctgacgggggtggtggaagcattgtgggcggttgtcactacggtttcagtgggagaaactctttggaaggggaaggggaaggagactactgtgagactatgattgcaagtgcgagagagagagagattatgatccatggtcgtgtggagggtgtgagattgcaagccgtgatcatgtgggggtgcgaggtgggcttgtgtggaggagccgtggcgacgctggcacggtggagcgcgaggaaaggaagggagtccgagcattccgccaaggaggttggcgacacacgtgagtcgccattggcattggtgaggcagccagtgacgtggagagcagcagggttttgctaccatggttggcgaaacaggtgccttgcacatttcgccattcccatgagcgaaacag

SEQ ID NO: 56137 - DNA, 222 bp, Glycine max
  Peptide Sequence Number=SeqID_147822
atgacatggtccaaggatgatccagttggagcaccgtttgctcgaaagtttaccaaggatgatccagttctcaacaaaattgacaaggaactcttgagaagatctgatggtcattttacacctggaggttcggtgaaggtgaaggtacccgtgttcagtgttgcggtggtcgttggcagcatacgaggtaccgcagattgcacggatcaagttgatccataa

SEQ ID NO: 56138 - DNA, 147 bp, Glycine max
  Peptide Sequence Number=SeqID_147823
atgtcggcttggcggctcccacaaaaagaatctccttctacgtcatctattgttgctcatgtgcttccacgagcgaagtttgctcttccctccactgcattccctttgtcagtgattgtgagtcttcgcgtttggcagtcaggttga

SEQ ID NO: 56139 - DNA, 357 bp, Glycine max
  Peptide Sequence Number=SeqID_147824
atgttgtacttggaatgtgatccaattccaaaagctgttgagaatgaggatgatttagatgatgtacctgttgctagccatgaggaagatgttggtggtggagagagagagagggatgctgatgctgttgagcagagacgtgttggtgagcaaagggatgctgatgctggtgaacagagagatggtggtggtagtgaggaggaaaaggaaattgacagtgatgagtggtttacagatttctcttgtatgaggaatgaagttgaagttgaagttgagacagatggttatcattcagaggagctgaaaatccccattagtagtgatgatgaagatgaggatgttgaagtttatccttaa

SEQ ID NO: 56140 - DNA, 390 bp, Glycine max
  Peptide Sequence Number=SeqID_147825
atggcaagcaaagacagctcgtggcggtcatcgggggtgagtggtggtggaggaggagcttgggggcattggggagggtgttactatcatcatcctcataaaaggatgaagagcatgcagctagcctatgtcttatggcaggatcataaaaagatgagtgttggtttgcttatggttcaatctggactatgcaagattgaaagttcaaatttgttaagattcatgtttcacgctggttttgatggttgtttgttggatccagaaaccaagttaaaaggaagggcaaaatggttattttgcaatgatttcagacaaccattcacccagggtagcaaccagctcgcctgggctaatcaagtttcttcaggcttaagcaaccaactcacctag

SEQ ID NO: 56141 - DNA, 642 bp, Glycine max
  Peptide Sequence Number=SeqID_147826
atgtcttcaaggaaaagaaatagcgtcggttcaaggcccactgctcaatatgatacatggagattccattcctttgatgcttggactagatatactgacaatgtgttgagaagacacatattagctgagaggaaagtggaaatctatcacacaaagttggatgaattcaagggcaagctgaagaggcgtaattttcacaagcccctcaccaacttagctgatagtagcattgacctcgcattggtgaaggagttttacgccaacctctacagtcccgaggggccttcacctaaacaagtcagaattcggcgccacttaataaggattgatgcagacaacctcaatgcctttctagaaacacctgtggtgcttgctgagggtgaatttttgcctgcctactcaagatactgcaggatgcctactgataatagagaaattgaagctgcactgtgcatatccagccaagggtttattctaaatgctgaaggtcacccggggaagatcctcagaaaagatctaaccacccttgctcaggtctggagtgttctatcctactccaacctggctccgacctctcacacatcggatctgactgtggatcaagctagctttatgcaggaccagaggagttgcctccgatag

SEQ ID NO: 56142 - DNA, 1434 bp, Glycine max
  Peptide Sequence Number=SeqID_147827
atggcaagtccaatgacgtgtagagataaatatggtcatttgctccctttgtcgaagactcgatgtctatcaaccgaaactactttagtctcccttcgtcatccaaagatggcaagtctgatgacacgcagaaaccaatatggtcatctactccctttgtcgaaggctcgatgtctatcgaccgaaactacattagtctctccttttcgaaatcctgagacaatcaagtctgatgacacacaatcaagtccaaagacacgcaacaaccaacatggttgtctgcaccctttgtcgaagacgcgacatctatcgaccgagactactttagtctttacttttcgtcatccagagacaatcaagtacaacgacaagcagcaaccaacatggtcatcttcaccctttgtcgaagacgtgacgtctatcgatggagactactttagtctcccttcgtcatccagagatggcaagtctgacgatgcgcatagaccaatatgtcaatctactcactttgtcgaagactcgatgtctatcaaccgagactacattagtctcccttcgtcatccaaagacggaaagtacgatgacgcgcatagaccaatatggtcatctgctccctttatcaaagattggatgtctatcgaccaaagacaatcaagtccgatgacacgcagtgaccaacatggtcatctacaccctttgtcgaagatgcgatgtctatcgatcgagactactttagtatctcctttttgtcatccaacgacaatcatgtccgatgacacgcagcaaccgacatggtcgtctgcaccatgtgtcgaagacgtgtcgtctattgatcgagactactttggcctctccttttcatcatccatagacaatcaagcgcgacatctatcgatcgagactactttttgctctacttttcatcatccagagacaatcaagtccaatgacatgcagcaaccaaaatggtcgtctccaccctttgtcgaagacccgacgtctatcgaccgagactactttagtcttccttcatcatccagagatggcaagtccgatgacacgaagagaccaatatggtcatctgctacctttgttgaagactcgatcgaccaacatggtcgtctgcaccctttgtcgaagacgcgacgtctattgaccgagactactttagtctcaacttttcgtcatccagagacaatcaagtttaatggcacgcaacaaccaacatggttgtctacaccctttgttgaagacgcgacgtctatcgaccaagactactttagtctcccttcgccatatagagacagcaagtccgatgacatgcagcaaccaacatggtcatctgctccctttgtcgaagactcgatgtctatcgaccgagactactttagtctcccttcctcatccagagacagcaagtccgatgacgcgtag

SEQ ID NO: 56143 - DNA, 642 bp, Glycine max
  Peptide Sequence Number=SeqID_147828
atgagggaggtggttgccgcccagctcgtccagcctagttgcaatcctttccaaggagctgtgaactttggcttggtgctcttgatggaggtgaagaataacatccatcttctgaatcataagagactcaaaagggttccattagtgtgcatgctcttgttgagcttcttcttccacttcctcttccatctggttgatgtttattgttgctggtggctctcctaccacaatccattcatgatcaacatatctcatcccaagcttcttgagatgcctttcggttatctcattggaggctttggtgaaatcaacaatctcattagaaacatcgatattcaagtaatcaatgaatctagaggtcatgcggatgagggcacacactacctattcacgcctaaccacaaggcgagactcacgggtgcgtcttccaaaggaggaaaatgcgcggagtcgccaccaacgtttatttgtggaaaacgttggaaaaatcgaaggaaactggtcatgaagaatattctagattcgggagttgtatttacgtttgaggaaggtattaacacctctcacgttgacaaaagaggggttcttgctcctacgtaccctccatcgaagaggaaatcagacctacgtagttctttctaa

SEQ ID NO: 56144 - DNA, 654 bp, Glycine max
  Peptide Sequence Number=SeqID_147829
atggaggaagtagccaaggaagccaaattcatgagagaacacactaaaaaattagaagaagcgataatcaacattagcaccacatcttactccaacctcgagaacaccatggaggtaataaatttgttaaaagatcatgtaaaggagttagtagtgcaaacaaaacaaatcgccaacaaggttgactgcaatgttgtaacaacaagaagtgggttaacaactaaagagccaataagaaaggacatgaaggtagatgacagagagaaggaagacatacaagatgaggacgtgatagttgaagaaatagcacgagagccaattaagacaaagagccaacttatacaagaagctaaacaagcaattatacgtgagaagttgtatcctcacaaaccaacaaagcaagacaaggaacggtttttgatgatgccaaagtataataaaacaagattgcttcaagaaatattcaaggttaagcaaacagagattgcttcaagattaattcaaggtcaagcgaacaagatcaattgtgatcaagagactgtttgtctcttggctagtgagaatcttgaacacaagggagagggatcccaagatgtgttcaaagtctgtaaaggatttacagagatagtggaaaatatcaagtgggatgcttga

SEQ ID NO: 56145 - DNA, 435 bp, Glycine max
  Peptide Sequence Number=SeqID_147830
atggatccaaaatctaccctaaggctcatgagaaccctaagatttggatggaaggagatctatgattgggtatgcattcacgattggaaactcccttgtcagttggaaggccacacttcaacccacaatgggtttgtccctacagaggcagagtacatagctttaacaaaagcagtaaaggaagggatctggttgaagggtttgattaacaatcttgggtttccacaagaaaaggctatcattttctacaagagtttgagtgcaatctgtttagccaaggatcattccatcatgagaggactaagcacattgatatcagataccacttcatctgttctgagaagagggtcgaggtccaaaatctggatactagggagaatccaattgatatgttcattaagcctattccaagaagcaagttcatgtactgactag

SEQ ID NO: 56146 - DNA, 153 bp, Glycine max
  Peptide Sequence Number=SeqID_147831
atgaaaaatcaggaatttagaattcctgtgactggtcttgtgtatcctcttcatctgtgtgggctcaggaggagcagcctcgccgggtctcacctgttgaggtgcctgggttgtaaagcttccaccatttctcacaatcgaaggtcgagataa

SEQ ID NO: 56147 - DNA, 237 bp, Glycine max
  Peptide Sequence Number=SeqID_147832
atggaagaagcaaaggagaaggattttgggcgagggtgttggatgagaatggaaggagaagggaaggcaatggataggagtaggaagagggagaagggaagggcacatatgggggagagggagaaggagaagggcactgatggcaagagaggaggacaatgggggaaaagaaagagaaggggggtacggggaagagggaagaaggaggggtggaaaattttgaagtttggggcataa

SEQ ID NO: 56148 - DNA, 324 bp, Glycine max
  Peptide Sequence Number=SeqID_147833
atggaggagttttctttgcaggtgggctggccaggagtccaaccttcttctcatggaggaggtgatgtcgcaacctacccttcggcgggagggcgacacggggctcacggggctcacggggctcacggatgcatcttccatgggaggaaaatgcgcggagtcgccaccaacgtttattcgaggaaaacgtcggaaaatccggaaaggtatggtctacgaactttaagtgtgaaaggttcaggagttgtatttacgcacggggaagggtgtttcccttgctcctacgtattcctcaattgtgataaggaaatcagacctacgtag

SEQ ID NO: 56149 - DNA, 492 bp, Glycine max
  Peptide Sequence Number=SeqID_147834
atgaggccgaggcgctaccgaattgtgatcgtaatcgacttctacatcgttcttcgttcggtgttcttcgttcgtcatccgaaatgtttgtttgtcctatacacacatggcacctacaccttcgcacacaccgtgagttattgggccctatacccgggtctgtggagatgtaagaagtggaggttgatctgtggtcatgctgggtctccgactcgcttgatgacaacaaagcctcatctagagtttttctctttgatgtatgtttgtctttgtgctaccaaccacatgctctcatgcatgcatactcatactgtgtcatcactcatgcatcgcattagtctcgttatctttgtcacgggaagccgaaaggtccgcatcaccttctttattgcatgcattgggcaccatggtaatgtctgcgaacgaaccatgatacccaatgcattgtgggtaataagggatggtctttcggactcttatgtccgtaggtaa

SEQ ID NO: 56150 - DNA, 339 bp, Glycine max
  Peptide Sequence Number=SeqID_147835
atgcttcactccatgctccagagcatccatagggggcagtccatcatcatgcagaaccttcagggcttgggcttgccctccattatgagcatggaggagtttgacgcacaggtggactggccaagagaccaaccttgttcctctagagggggtggggcctttacagcccaggagcctgtgactgaggagccaccagcaccagcaccatcatcagcagtagcagaggaggagaccactccaactcagaccccacaaccatctccaccacctgcacctgctcttgaggagattcagccatcaacactggatcttaatgaagaacagccacacgaggagtag

SEQ ID NO: 56151 - DNA, 384 bp, Glycine max
  Peptide Sequence Number=SeqID_147836
atgaacaggctaagcgcagcaggcgtgcttagcgcgttcatcacgaatcccataaagatacacaagggttttcaccccttttttaaccatattgcccctaatgggcttctagactacctaaagtctgtagaagcaagcttcatgatgatgaatcaaggtacatcctttgtggtacaagtagagggtacatctacttgggttgttgtaactgagaacaagagagggtacatctcttgtggatcagttcaagtggagggtacatccacttggttgttcaaagagaacaagggagggtacatcccttgtggatctttgcttgtaaaggattttacaaggttgaaaagaaatctcaagaaccggtggttgcttggggactggatgtag

SEQ ID NO: 56152 - DNA, 507 bp, Glycine max
  Peptide Sequence Number=SeqID_147837
atggtcattaaccaatccctattctatgacttgacccaattatctagtgaaggtgtaccatttgaaggtacactaaataatgattggaaatttgatttctttgtgcatgatgcccgctggttggtttgcaccaaccaagaggatatgaccagaaggttgcttgtcggatcattggctcttgaaagccgcatccttcactatctcattgtgcgtattttacttccaagatcttcaaactttgcacaggtttctgaagaatatcttattgtcatgtgggcttttcataccggccaacaaattgattgggcacacttagtccgatattgcatgcataaggcattgcgattaaatgctcctttaccatatcctcatccagtcactcttttccttctacactttaacatccctcttgattttgaaccttatgttccaatcaagagatctttttttattggtgttgctgtgattgcatcttttggttaccgcaaagagcatgatggttcttgg

SEQ ID NO: 56153 - DNA, 87 bp, Glycine max
  Peptide Sequence Number=SeqID_147838
atggaggatgtctccaagcagttctcttggaaggtgggtaggggagaccaagctcttttctgggaagattcttgggttgacggtggg

SEQ ID NO: 56154 - DNA, 498 bp, Glycine max
  Peptide Sequence Number=SeqID_147839
atgttagataatcttgtgggctcactagatcttgctaaggttaaaaattctggcaaaggaaaggttttgatgcaagcaatgtatggagttaaggtggagactgtatttatttgtagggtgtttactgtagcattctctggctcgtcaaagaagttatcagacttgaatgtggcggatatacattcatgggctctacattttagaaggttgcagaatcttgtaaatgaggaaattagagatggtgtagataccgttgagatagaatggcttctgaagactgttgaggaattacgtgcgggtatcgagaagctttcacaaggaaatgatcttcttgcaaagggagtagataggttttttgaagccgttatgactagtcgcgatactttgctcagctctgtgatcgttccccatgccgtagcagctagttcactaattttgtgtcacaacctgcatttcaaagatagctttaggggaggactattgacagatactcattag

SEQ ID NO: 56155 - DNA, 393 bp, Glycine max
  Peptide Sequence Number=SeqID_147840
atgcttaagagcattctattacagagtttacaggtggtggcgcctccaggatctattccttcagtggagcagttcactgagatggtagcctggcctgggacccaaccttctcttcacagggaagatgaaggtcccacagcccaggtatcccagcatgtggaggatgattcatttgaggccaccattccagagccatttgttataggagaagaggcagaggagacacaggtgagacaggtagctgctacaacacctgagcgatcccttaaggctacttcagagccttctgcacaaggggaggacataccttacctcagcctgctgcagaggacccgactacaccagtcctggctatggacacttctcctccagctactccagtattgcatctga

SEQ ID NO: 56156 - DNA, 362 bp, Glycine max
  Peptide Sequence Number=SeqID_147841
ttcttaaaggtgaaaattttaaggactggaaagagaacatgcaaattgttcttggctacatggatctagaccttgcattaaagattgagaaaccctcttcttctacggattccaatgatataactagtgccaaagatttccttgctgaaattgaaaagctctttgcaaaaagcgataaggcggaaacaagtactctccttcagaacttgatttacatgaggtatcaagtgctaagttctctaccttcacagtttagtcagtttaagatctcttacaactgtcagaaggagaaatggtctcttaatgagcttatttcattctatgtacaagaaggaggaaaggctgaagcaaaaaaggactga

SEQ ID NO: 56157 - DNA, 456 bp, Glycine max
  Peptide Sequence Number=SeqID_147842
atggtggtgtatctggcggagatcatgccggctgaagtacgtgcttcgggcttttcgctggcctacagcctggcccgcgctgtttgggatggttttacgccgggcgatttcgcaaagctatctgattcatgctacacgataaagcgatgcctggcgtctggctgtcgtttgccgtccttctccgctgctgattggccgcgggaaccgttcagtgcggtttcgcagacctgcgcttcacctcaacactcccgctcaatcggccccttctcccgcgtgcgggagaaggcgggggatgagggtgccagccagctcctgctctgcgtgctggccctcaccctgaccctctcccgcacgcgggagagggaaccgttcagtgcggtttcgcagacctgcgcttcacctcaacgcccgcgcggtgggctccttctcccgtcagcgggagaaggcgggggatga

SEQ ID NO: 56158 - DNA, 233 bp, Glycine max
  Peptide Sequence Number=SeqID_147843
atgaggggcatcatgcatgagcctcaagtgaacataggggcagatccaaagttctcacccgtcgatgtttttaaacaaggaaaaaggaggggagaccagccctggaatttcaatagattgattaaacgtcaaacgtctctattcccgtcactccaaaatggtcaagtgactaaatcaaacagaacatacactctgagggagttcccggagagatttgcaaaagataggataag

SEQ ID NO: 56159 - DNA, 356 bp, Glycine max
  Peptide Sequence Number=SeqID_147844
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgggacttgcaaatccaggatatagggctcttgggaccataggcataactgaagaggctgaggcaaggggaagcttttaa

SEQ ID NO: 56160 - DNA, 297 bp, Glycine max
  Peptide Sequence Number=SeqID_147845
atggtgaaagttggaacctcttacgtgccgatcaacttcatttcggcaaagtgtggcccaggctatacccggtcaacagggacaccaggcgcgctttcccattcgccatgtcaggctgcgcaactgcttaagaacggccaacccgggcgatcggtgcgggcctttgcgctattacgccagctggcgctaaagggcggatgtgtgcatactggcgattactatgttggcactgataacgccagggtgttccagtcagaatgcgttcgtggcagagaaaaaaggctgcaccgggagtga

SEQ ID NO: 56161 - DNA, 372 bp, Glycine max
  Peptide Sequence Number=SeqID_147846
atggtgaaagttggaacctcttacgtgccgatcaacgttgctcttctcatgcaaaagtatatatatgccaggttccggtacaacagacaccaggacttatgcttatttgcgaagtatccgtcaccgagggctgcccgctttccattcgggaaaccatgtcaggctgcgcaactgcttatgaatcggccaacgcgcgggcgatcgagtgcgggcctttgcgtattacccagcggcgctaaaggcggatgtgctgcatacggcgattactatgttggcactgagaaaaaagctgcacggtgctcagctgaatatgtaatgactcactatagggcgaattggagctccaccgcggttgcggccgctcagaactag

SEQ ID NO: 56162 - DNA, 417 bp, Glycine max
  Peptide Sequence Number=SeqID_147847
atgaattttgcagcgaaaaagcctatagaattcaccccgattttggtgtcctatgctgacttgctcccatatctacttgataattcaatggtagccataaccccagccaaggttcatcaacctccatttttccgagaatacgacttgatggcaacgtgtgcttgtcatgaagaagccccggggcattccattgagcattgtagggccctgaagcgtaaggattttcaagtttatgccattaatataaaccacagttacaatgctaaaatggataaatctgacatctttgtccctcatcctctcgtaattacatctttgcttccactggaatgtgggtgcaagccattggtttgtttgctcgagcgacatgcgctcctgagtgctgacttccaagaccattcaatcagaaattactag

SEQ ID NO: 56163 - DNA, 351 bp, Glycine max
  Peptide Sequence Number=SeqID_147848
atgggtgaatcaagaggagacacaggaacagatgaaagccgacatgtcggctctgaaagaacagatggcttccatgatggaggccatgttaggaatgaggcagctcatggagaaaaacgtggccactgctgccgctgtcagttcggctgccgaagcagacccaactctcttggctaccgcgcgccatcctccctcaaacataggtacggacggggaaaaataggaacacgctggggcatgacgactctttaccctcatctgggatacaaccgagcggcttacccttatggattgccgcccaactactcaccacccgtcctgcaagacgatgcgggccatattgcttctccc

SEQ ID NO: 56164 - DNA, 812 bp, Glycine max
  Peptide Sequence Number=SeqID_147849
ggctacacgtcctcaccttcagagggctacacgccctcgccatccgaggactacatgtcctcaccttcgtagggctacacgccctcaccttcagagggctacacgccctcaccttccgaggactacatgtcctcacctttagaggactacacgtcctcgccatcagaggactgcatgtcctcaccttcgtagggctacacgtcctcaccttcagagggctacacgccctcgccatcagaggactgcatgtcctcaccttcgtagggctacacgccctcaccttgagagggctacatgccctcgccatcagaggactgtatgtcctcaccttgagaggactacatgtcctcgccttgagaggactacacgtcctcaccatcagagggctgcacgccctcacctccagaggactacacgtcctcgccttgagagggctacccgcccttgccttgggtactagttaccctcaccttcagaggactacacgtcctcaccttcagagggctacacgccctcaccatcagaggattggatgtcctcacctttgtagggctacacgtcctcaccttcagagggctacacgccctcgccatcagaggactgcatgtcctcaccttcgtagggctacacgccctcaccttgagagggctacatgcccttgccatcagaggactacatgtcctcaccttcagagggctgcacgccctcaccttgagaggactacacgtcctcgccatcagagggctgcacgccctcacctccagaggactacacatcctcgtcttgagagggctgcacgccctcacctttag

SEQ ID NO: 56165 - DNA, 845 bp, Glycine max
  Peptide Sequence Number=SeqID_147850
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtcactgtgaccgaagagtctggtggcatgcggggacacccgacggtaacccgcaaacgttcttttgctatctggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 56166 - DNA, 288 bp, Glycine max
  Peptide Sequence Number=SeqID_147851
aggactacacgtcctcgccttgagaggactacacgtcctcacaatcagagggctgcacgccctcacctccagaggactacatgtcctcgccttgtcaaagggctcacgccctcaccttgtagggtactagttaccctcaccttcagaggactacacgtcctcgcctttagaggactacacgtcctcaccatcagagggctacgcccttacctcagaggactacatgtcctcgcctttcggagggctacacgccctcaccttcagaggactattgcaccctcatcatag

SEQ ID NO: 56167 - DNA, 288 bp, Glycine max
  Peptide Sequence Number=SeqID_147852
atgggggaatacgcaaaagatgaggaattgctaatacattccttccaagaaaagtcttactggggtagctgttacctggatgcaactatagaacatttgcaaaaaagggggacggatctttcaaagaacacgcccaaaaggtggagggatctggcggcccaggtggtacccccaatgatggaaagggagacgatgatcgtgatggtagacacattatcgatactctactatgaaaagatggtgggctacgcaccctcaaagctttgcggatttggtcttcgccagtga

SEQ ID NO: 56168 - DNA, 792 bp, Glycine max
  Peptide Sequence Number=SeqID_147853
atggacaagaagatccgcagtattgtgagtaacattctgaaaaatgcctctgttcctgatgctgagaaagatgttccaacatcttccaccccaaatgctgaagtcgtctcttcacccagcaaagaggaatcaacagaggaagaggaacaagccacagaggagacccctgcaccacgggcaccagaacctgctccaggtgacctcattgacctagaagaagtagaatctgatgaggaacccattgccaacaagttggcacctggcattgcagaaagattacaaagccgaaagggaaaaacttccccattaagagatgttcccgacatcaagagggccaagacatcagggaaaaaggtgcctggtaatgtccctgatgcaccattggacaacatctcattccactccattggcaatgctttgaaaggtggaaattcgtgtatcaactgcagacttgccttggaaagagaactgggaagagctgccttggattgcaaggagatcatggaaaaactcagtgtcgtggtaatcccgtcttcagcatttcccaacagctctcagattttcacgaaaccatttcaaaagctctgcttctccatggctacctcaccaaaagaaacttcagctcctggttcaccctctgtaccatcatccccatcatccaccaaagcaccatcaatccaggaacaacctgaattccatatccaacccatgcagatgattcctggtcaagcccctgttcctgaaaaactggttcccaaacgacaacagggtgtgagatttctgaaaccctag

SEQ ID NO: 56169 - DNA, 96 bp, Glycine max
  Peptide Sequence Number=SeqID_147854
atgaagaacgggaaaaaagagaggtggttgccgcccagctcgcccaagcgagctgggttacttccaccagaaggcaccgcctgtagaagcatatga

SEQ ID NO: 56170 - DNA, 246 bp, Glycine max
  Peptide Sequence Number=SeqID_147855
atgaccccttcacagcaacatgatgccccaattccaacacctaacgccccattaggtacgccatggaatgtacccagaataatacttgatataggtgacttattaggagctgatttgcgtcaccaattttctgctgaggctgaccaagtagaaatggggagacatcggggcagaagaaatcctgatcgccaagcgcaaagatgggatcgaccatgtgacatcctcacgtcatcacggatatcataa

SEQ ID NO: 56171 - DNA, 72 bp, Glycine max
  Peptide Sequence Number=SeqID_147856
atggtcattcccaagttcaaggtgccggactttgacaagaaccttcctgagtccattcttggaaggacctaa

SEQ ID NO: 56172 - DNA, 267 bp, Glycine max
  Peptide Sequence Number=SeqID_147857
atgtggaatcgacacaggcttaaaggagcactcaaaccaggtgtatttacccccaaggcctatactccgaagagtctgttagggcctctccctcctaattcagctttacttagttttaaaagattggctaaaattttgttaaaacataagcacttagacaatgaaggaaagctggagttgctgcacatgatgtctaacattatgtcaaggaatcagattgggctgcacaatgcacaaggcaagataaaatgtcaaatgaagaattga

SEQ ID NO: 56173 - DNA, 396 bp, Glycine max
  Peptide Sequence Number=SeqID_147858
atggctccagaagaactagagcagctgactcaacaaatcaaggaccagctagaggagtcaatcacagaaaaaggacttgcattgcctccgaagcctgaggttggtccctcagctgcgtgtgtcagcacaaaggggagttatgttggtccttcaccgactgatccagagacgggtgactcagacaaatgcgggttgtacatcgaagaaaatcctttccgcctagttgccctaggaagagtttatgagggatctacagcggttcacaacatccctttgttgcatggccaagtgaaggttggtgttgacgaggttaaagatgcagaggcccccattcctgtacccactgacgaggcagttgtgtctctagaaaaacctgcagatgggccggatccttag

SEQ ID NO: 56174 - DNA, 321 bp, Glycine max
  Peptide Sequence Number=SeqID_147859
atgtcaagactcatacgcgattctcctcaaatttcagccagcccgcatcaattagactttacaccttacgcttcagggtcatacaatgctcaatggaatgccccgggactcctatatgataagcacacattgcgttcgagtcgtattctcggagaaatggaggttgatgaaccttggctggggttaaggctaccattgaattatcaagtagatatgggagcaaggatggcctttgtggataactgggtggtaggtaaggagaagggttgttattggctgagtaatgacattgttgggctggtgggaagtttggccatgtag

SEQ ID NO: 56175 - DNA, 408 bp, Glycine max
  Peptide Sequence Number=SeqID_147860
atgactagaggcaatccatctgacttacaaccctttgatcctgagatagatatgacatttcatagattagttagacatcatttagtaccttttgagcatccagagcattctgttattggtgattttgagcattatagttttgaacattctgattttgaacattctaagaacatggcacaacctccaccccgtgagaggactctaagggaaatggctgcacctgatttcacttacgaaagcctgtgtatccaataccctgatgaggatatcccatatgttcttaaaactggactaatccacttgcttccaaagtttctagcctccatagaagccccacaagcaagctttccatcaagtggtaatcagagcacaagagcttcaagtaggtgctccttaaacctccattaa

SEQ ID NO: 56176 - DNA, 638 bp, Glycine max
  Peptide Sequence Number=SeqID_147861
atggccaagcgtgacgaaatgatcttccggctactgggcctgcgcctgatgttcaagctgaaggtgcgcaacgtgcaggaacacgatggcatgtctcttgaaactccttggcagtacctctttggaagcagtcgtatgttcagccctgacacctccatcagtgagttcattccgttgtcgtcgcatgttgccccgaacgtggtcaagaccacgggcggcgactacctgctgacctggcatctggaagggctgccgttcgtcggccgtgaggagtgggagctcgagcatcgccacaacacgttcaaccgcctgctgcagacgctgcgcgcgcctgattttgtcaacgtcgccttctgggtgcatgacatccgtcgccgccgcacgctgaagggcaagagcaactacaagcagcgcttcaaccaggatgtgtcagatcagtacatgggcatgctgtcctcgcagcgcatcatgcagaacgagctgtacctgaccatgatctaccgcccggtggtgacgggtaagcgcttcgtcgaaaaatcggcgaacgtggacaagctgcgcgccgagcaggagcaggcgatcgagaagctgatggagctggccggcaacgtcgaggccgtgatccgcgattacgcgcc

SEQ ID NO: 56177 - DNA, 369 bp, Glycine max
  Peptide Sequence Number=SeqID_147862
atggccatatacagaggtatgcttcttgacctggcaagaaatttaaggaacaaattgggtgttggtggtctaacagcggaagtcagaatgctggtatacattattatgtatattttggcaccaagatccaacaatcatgctcgagtcactgatgatgacttgcagattatgtatgggctgaaatcagatattatgttgaaaagccgtcgactggtggattttgaatttccatatgcagtcttgacctcaagattcatttattatttcaatatcgatgtttctaataagattgtagactttaccaaagcctctaatgagataaccgaatggcatctcaagaagcttggcatggcatatgttgatcattag

SEQ ID NO: 56178 - DNA, 577 bp, Glycine max
  Peptide Sequence Number=SeqID_147863
tgctggaattacgaacactttccatcggtccatcggtgtgtcgttgatgatggttatgctgaggctagcccacgtgcctataggtggcatacggatggggtacattcagaccgttcctccgccaccgtttcgtgattcgttgacaggtactgatatagacgaccggtgggtatactttttagatcatgtggtgcctacaggggagctctgtgtagttcttgggcaggtggccccagactacatggagtggttttttcagattttgcacccttttgtgacgctgacggaggacactgctgagccgagacctgcgcctccccccccccccactcatgatgatgagttcgtcgagccacctgtccccgaggttccagtcgcgtcggatctccctacacattttgtggttgattgcacaggatgtgtaaggattgctgagcatttggagcgggccatcaacctcaggatggtgactaaagggactgacttatatgatatcatggatatttgtcagaggatagctagaggtaacgacccagatgacagtcttatgccgcgacagagacaccgcatatattaa

SEQ ID NO: 56179 - DNA, 381 bp, Glycine max
  Peptide Sequence Number=SeqID_147864
atgcatgatgcgatcaaggaacaagccagagcaaagggtcacttcagggcagttgcagctcgcccaggcgagctaaaacttagtgttgaagtaatgagctcgcccaggcgagttggtttcttcaccctgaagctatttggtggcgcaggcaagccagaggctagcctggcgcgacattcattggctaattggctaagcgcgaggaagaatccaaaagaagaggagttgtcaagttcgctaagcgcaccgctccaagtcatcaagcgcaccgcttcaggtcatccgctaagcgagagaagcgcgctaagccaaaaatcactaacgtgcaataagcggttcatacgtgtgctaagcggttcatactttccgctgtgcatttaa

SEQ ID NO: 56180 - DNA, 429 bp, Glycine max
  Peptide Sequence Number=SeqID_147865
atgtcagttctggaattgtacatagaaaaggatgtggctggtggttctatgtttcattctgcaaattctcttacatcatgtgaaaataatttatctaataatgaggcggaaccaccaagaaatgtaagcaatttacatggtgatgaagatgatgatgattatcttgtgtctaactcatacgttgaagagtctttagacgaagatgatagtgttgacggtatatctgatacagacaatgaagtgaccgatgtgattcaaccagtgtacaaggaattcaaaatccattttggaatgatgctttgcattataacaatatcaattggagtcatcctgatgaggaggacatttgcggtttggagatgccatccagttttaatgttgggcaataattatatgttggcatggattttgatagtaaagatgcggtaa

SEQ ID NO: 56181 - DNA, 225 bp, Glycine max
  Peptide Sequence Number=SeqID_147866
atggccaggaagatcttagagccggttattattggctcactatggaaagcgattgctgtgcccatgctaggtttcgattgtaccattaagatggccgaatatgattgtcgcgtgcgatcccttggaagatctcagagcaatggcaccattgattttgacgtaaagctactcaaagtgtatgcaggagacttgcggcggatttcaagccagctcgataacgtctag

SEQ ID NO: 56182 - DNA, 534 bp, Glycine max
  Peptide Sequence Number=SeqID_147867
ggtgaacccttgggtactagtacccttgtctccagaggactatacatcctcgccttgagaggactacacgtcctcaccatcagagggctgcacaccctcacctccagaggactacatgtcctcgccttgagagggctacacgccctcaccttgggtactagttaccctcaccgtcagaggactacacgtcctcgccttgagaggactacacatcctcaccatcagagggctgcacgccctcacctccagaggactacatgtcctcgccttgagagggctacacgccctcaccttggaggactacacgtcctcgccttgagaggactacacgtcctcaccaccagagggctgcacgccctcacctccagaggactatacgtcctcgccttgagagggctacacgccctcaccttgggtactagttaccttcaacttcagaggactacacgtcctcgccgtcaaagggtcatgtgccttcacctttgcagggctacacgccctcaccttcagaggactacacgtcctcacctttag

SEQ ID NO: 56183 - DNA, 234 bp, Glycine max
  Peptide Sequence Number=SeqID_147868
atgcgctttacgacttccttatcgaatgcgtgttatgtagctagagtgatgaatgaaatagaggaggtgcaagagcagatgaagcccaatatggaggccatgaaagagcagatgaccacaatgatggaagccatgatgagtatgagaaaaatgatagaggtcaacatgactacagtcgtttttgcaagtaccgccactgaggtggacccgattcacccatctggcctcaaccaa

SEQ ID NO: 56184 - DNA, 1805 bp, Glycine max
  Peptide Sequence Number=SeqID_147869
ggtggacccttgggtactagtaccctcacctttagaagactacacgtcctcgccttcagagggctacacgccctcaccttcagaggactacacgtcctcgcctttagagggctacacgtcctcgccatcgaagggctgcaagccctcaccttcagaggactacacgtcctcgccttcatagggctgcacgccctcgcctttagaggactacacgtcctcaccatcagagggctgtatgccctcgccctcagagggctacactccctcaccttcagaggactacacgtcctcgccttgagagggctacacgccttcaccttcagagggctgcacacccttaccttcagaggactacacgtccttgccttcaaagggttgcatgccctcacctttagaggactacatgtcctcaccatcagagggttgtatgccctcgcctttagagggctacacgccttcacctttagaggactacacgtcctcaccatcagagggctgtatgccctctccttcagagggctacgcgccctcgccttcagaggactacatgtcctcgccttgagcgggctacacgccttcgccttgggtactagtaccctcaccttcagaggactacacgacctcgccttcagagggttgcaccccctcaccttcagagggctgcacacgctcaccttcagagggctacatgccttcacattcagaggactacatgtcctcaccttcagaggactacacgtcctcggcttcagaggacttcatgtcctcaccttcagaggactagacgtcctcgccttcagaggactagacgccctcacctttagagggctgcacgccctcgccttcagagggctacacgccttcgcctttaaagggctacacgccctcactttcagaggactactcgtcctcgcctttagaggactagacgtcctcgccatcagagggctgcacatcctcgcctttagaggactagacgtcctcgccttcagagggctgcacgccctcgtcttcaaaggactagatatcctcgccttcggaggactagacgtcctcaccttaagcgggctgcacgcccgcgccttgggtactagtaccctcaccttcagagggctgcacacccttaccttcagaggactacacgtccttgccttcaaagggctacacgccctcgcctttagaggactacacgtcttcaccatcagagggatgtatgccctcgccttcagagggctacacgcccttgcctttagaggactacacgtcctcaccatcagagggctgtatgccttcgccttcagagggctacacaccctcgcctttagaggactacacgtcctcgccttgagagggctacacgccctcgccttgggtactagtgccctcaccttcagagggctgcacgccctcaccttcagaggactacacgtcctcgccttcagagggttgcacgccctcaccttcagagggttgcacaccttcaccttcagaggactacatgtcctcaccttcagaggactacacgtcctcggcttcagaggacttcatgtcctcaccttcagaggactagacgtcctcgccttcagagaactagacgtcctcgccttcaaaggactaaacgtcctcaccttcagaggactagacgtccttgccttcagagggttgcacgccctcgccttcatagggctacatgccctcaccttcagaggactacacgtcctcgcctttagaggactagacgtcctcgctttcagagggctacacatcctcgcctttagaggactagacgtcctcgccttcagagg

SEQ ID NO: 56185 - DNA, 360 bp, Glycine max
  Peptide Sequence Number=SeqID_147870
atgctgtgtaaatccccctgttgcgcttttgcgcatctgcatcatgctgtcacacaggcgttgtatgtgggtctcgtcttttgtcgtaggaagtcggaagatccatattgtcttcttaactgcacacatggggcactgtgcccccaaatgcgcaacctcacattttgcatgagtcattgtgttgaagtattggcgatcaaaattgccattccctgggttatggggttgaaccaagctcgtgcttttaggaaaaaggttcatcgagtcaagttgaagtatggaagtaaccattttgcaaaaattggggcaaaagatggatcgtgttacatcattgcttcgtctactgccaaacacgtttag

SEQ ID NO: 56186 - DNA, 456 bp, Glycine max
  Peptide Sequence Number=SeqID_147871
atggctggtacattattccttttgaaacagcaaaatagtttagaggttatgagcggaaagaaagaaatgactccgaatagagttgtgaactggccattcgggactctatatttgcatcctggtcattccgtgcattttgagcattctgttgagggtgattctgaatattctgattttgagcattccactactaattttcatactgagaacatggctcaacctccaccttgtgagaggactcttagggagatggctgcacctgatttcacttatgaaagcttgtgcattcaatatcctaatcaggcttttccatatgttctcaagactggactaatacatttgctgcccaagtttcatggtcttgcaggtgaagatcctcataagcatattaaggagttccatattatttgttccaccatgaagcccttgatgtccaagaagatcatatctttctaa

SEQ ID NO: 56187 - DNA, 264 bp, Glycine max
  Peptide Sequence Number=SeqID_147872
atggaaaaatcctacaagatgaatttcaaaaagaaagaaaagaaaggatatatcacttgcgaagataatgtcataaattattcaagtgattcagagaagaaaatcataagtctggatatcatgatgaaagactatgaaaatggagaagagcaaatggaagttggaagtagttattggaagttgaaagttaaaaatggaagttggaagttggaagtggaagttactggaagttggaagttggaaatgaaagttattggaagttga

SEQ ID NO: 56188 - DNA, 827 bp, Glycine max
  Peptide Sequence Number=SeqID_147873
gtcgatctagaggatcccttatttgggaggcagtgcctgcgattgaagggctggttgtcgccacaggattaagtccattgatcgagtgttcagttgtaactggcgatcctagacttatatccgcatttgtggagaggtggcacagggagaccagcaccttccaccttccagtaggagagttgacgatcacactagatgatgtgtcgtcactcctccatctccctatcagtggcgccttccacagcttcgaggctttttccgtggacgaggcggtatttttgttgatggagttgcttgaggtgtctggtgaggaggctagagccgagacaagtaggggctatgcctggggagctgcggccctggttcatatgtatgaccagttagatgaagcttctaggaccacgacacgacagattggggggtaccttactttattacagtgtgtcatcgataatgcgtatgaggagacgtcccctcgtgcctctgggtggctgacgacgaaggctcatatgaagggaattataggagcgtcgtaccgggcacattgtgatgctttgacggtcacagacgtgtgttggtttccttacagtgaccatcgaggggttagggggtttgagctgatttcatcgttccagggtcagctgagatggggtcctacgatggtcacagttcgatcggagagggttctacgccagtttgggtacattcagagcatccctccactgcctgttagcgcttcgttgtcatatgataatatagatgacaggtggatgcatttctcggaccacgtagtagctgtgggtgacctttgtgtagtgcctgagtag

SEQ ID NO: 56189 - DNA, 272 bp, Glycine max
  Peptide Sequence Number=SeqID_147874
atggcaatggggcgggtcgggtacgggtattgtctccccaatcccttaccccgactcctcaacatatccccatacccgtacccgatacccgacgggtttgagtttattgtctcatccccgtacccatcgggtacccgtcgggtatcggtaatcccatacccgtacccgtacccgacttttggttatcggggaaaacctgaacctgtacccatacccggtcaattcgggtattacccgtcaaagtcgggacggattcgggcggatacccacag

SEQ ID NO: 56190 - DNA, 186 bp, Glycine max
  Peptide Sequence Number=SeqID_147875
gaagagaaaaaatcagaggaaaacaaagtggaggagaaaaaagcaaatgaagaagaaaagaaagaagaagagaaaaaattagaggaatcaaaagatgataaggaatccaaggaggaatctgcgccgccagaaatcgtgcaaggcacaacctttgcaatgcatggatactttaagcacgatttctag

SEQ ID NO: 56191 - DNA, 288 bp, Glycine max
  Peptide Sequence Number=SeqID_147876
atgaaaagagaaaaacatgtctccaatagtagtcatgactcttgcaagagtttaagtgaagaagttagacactattatagagggcgccatagttcacatactaaacatcactcccaaagaagagaaaaggatagaaggcctcaaaaggttgaacaactctttgcttgctatcatattagcgaagagagaaaaagttccatttggctacccttagctttcaaggatatgccctctattggtggacttcccttgttagggaaacgaatggactcatgggggatcctctag

SEQ ID NO: 56192 - DNA, 468 bp, Glycine max
  Peptide Sequence Number=SeqID_147877
atgaccggtagactgcttgccgggtcattgacatttgattgtcgcatcatgcattatatcattgttagaattttgatgcctcattcttctaatccttctcaagcttctgaggaggacttgattctaatgtgtgctttcttgactggtcgtccaatcgaatgggcccatttggttcgttactgcatgcataaggcattgtggtctggtgcacctctcccttaccctcagcttgtgactttatttcttcgaaattttgaaattcctttggattatgagccttttgtgctagtcaaacgttcctttgttattggtgttggtgcggtaacctcctttggctaccgtaaggacatagatgggcaatggctgaagaaggatgcacaacctccacaagacgagcgtactccctctcctccacctcaacgagatgattcctcagcccttatgaatgaagttctatcggaattatga

SEQ ID NO: 56193 - DNA, 354 bp, Glycine max
  Peptide Sequence Number=SeqID_147878
atggaaagaaaaactagaaagaaaagaaaaaggaaaagagagggaaggcataggttacatcttagacctcactcccataggagagaaaaagaaagaaagcctcaagaggataacattaacctccaatacttccatgggaaggacaatgaagaggcttacttagattggaaaatatgtgtaaagcaacaacttaaaaggaagtctactttaaaatcttatggctctcactcttatccaaagaaagaccaaggtcaaggcatcttaggggtgacaccttctaagcccaaagatgataaggctagtatgcaagagaagactagctttataatgtgctttaaatgtcttgaaagatga

SEQ ID NO: 56194 - DNA, 744 bp, Glycine max
  Peptide Sequence Number=SeqID_147879
atggggacaaatcaaactggcaaaaggttttatcaagtcaagattaagggcctagatatcaccagcattaaggagttagggcgattgatgggacctctccaaatgcaagccttccgcaaggcgtacagaaagatgttagatttgaccatagcagagatatccacagaagccattgcatcactcacccaatactatgaccagcccttgagatgcttcatgtttggagacttccaattagtaccgaccgttgaagaatttgaggagattctaggatgtcctcttgggggaaggaaaccgtatcttttctccgggtttcttccctccttgagcaaaattgcaattgtggtcagggattcggcgagaggattggaccgcgtaaagcaaactcgaaacggcatagtgggcctaccacgaaagtacttagaaggcaaggcgaaggatatggcgaatcaagaggagtgggtcccgtttatggatgtattaggattgctaatctttggggttgtcctctttccaaacgtggttagtttggtggacctagccgtaattgatgctttccttgcatatcaccatagcaaagagagcccggtggtagctgtcttggcggacttatttgacacatttgaccaaaggaggcagaacagtcaactggtttccacgatggaaataaggaaaggagggagttctcttctcatgtgggggctacccaaacatcccgctgataggaacgaggggttgcattaa

SEQ ID NO: 56195 - DNA, 207 bp, Glycine max
  Peptide Sequence Number=SeqID_147880
atgactactgaagagaaaacatctgaagtctctaatactccagaatattcctgcccagccactgctggctatgttggaggaacagagagaggtagattggaactcaatgtggaggatcaaaaagtctcttttgacctctttgaggccatgaaacacttagatataggtgatgcttgttctaagaaggaagaggtggaacaggaaata

SEQ ID NO: 56196 - DNA, 1126 bp, Glycine max
  Peptide Sequence Number=SeqID_147881
atggcgagccaagataagtggggcccatttgcggatatactagctttgttgatttttggggttgtcctctttccgaacatggacggtttggaggacttagccgccattgatgctttcctcgcatatcaccatggcaaggagagtccagtggtggctatcttggcagatttgtttgatacctttgaccggagatgtgagaaaaacagtgcacggattgtctgttatttacccgctctctgtgtgtggttggtttcacacctattccaacaagacacaagacacccgtgtccgcttcaaagctatcgctcttgcgccgaaaaaggaagagtcgattgggaccaacatttggctggaataggaggcaacgcaatcaattggtttcctcgttggaaggaaggcaaggaaggagttctcttctcgtgtggggactaccctaatgttccattgatagggactagggattgtattaattataatcccgcactcgccataagacagctagggtaccccatgaggggagcgccaaccgaagaaagtctctcacctttccttgtgagggatctaggcgcgcaaagtctcaaggtgatacaaagagtccacaaggcgtggagaagtccgttgaagaaagacaaggagcttagaggcatccggaaagagtgcaccgaggcccgcaaggaggaatacggccaagagaaattccgaggagcattgtggggtagcaacaatgagctcaagctccgaagagaggaaagagaccggtcacgggtgcatggcatgatcttaaaagaagagttagctgcgtgcgcaagatccaagaggagtttggctcaacacttggaagccacggagcaaagcatgctagctatcatagggcaatacaaggaagagttgaaccagtctgtggcccatgaacaaaagctagtggaggatcttgcacaagtgtacgccgaaaaagaagcaagagggagggtgattgatgcattgcctcaagaagcgactatgtggatggataggttcgctttgaccttgaatggaagtcaagacctcccgcgtctattagccaaagcaaaagccatggccgaagtgtgtactgcccccgaggagattcaagggctaatcaattact

SEQ ID NO: 56197 - DNA, 270 bp, Glycine max
  Peptide Sequence Number=SeqID_147882
atgggattgagtcaggcatttttgcttaaaaagagattctatcaagtcaaggttaagagcctaggagtcaccagtctgaaagagttagggcagttgatgggtcagctccagcgacaagcttttcataaagcttacggtaagatatgggacctagccgtggcagaggtctccaccgaggccattgcctccctcgcccaatattatgaccagccgttgaggtgcttcacctttgggggacttccagttatcacccacggtggaagagtttga

SEQ ID NO: 56198 - DNA, 567 bp, Glycine max
  Peptide Sequence Number=SeqID_147883
atgacgaacttggttttgtcggatggcggattcagggcaagcgccgcagcttgcgacgttgcggataaagcgcaggggcaggtcgccgtggttggcgtaagcgtagcgttgatcgctgttgaaggtttgtgcgtcgccggcggtgagcgtcagcgtgccttgttccagctccagcgtcagggtaccggcaatcacgtagatcatttcactccagccttcggcgtccggggcagagtcatagcgctcgcccggcatcagcgtccattcccacagctcggcccgttgccgcgccggcacgctggcggcgaacagcgcctggctgcccggctgcgcgccttgccaggccaactcgcccaccagatggctgccgcgcgcctccggcgcctggatcagatcggtgaaagaaatcgccagggcggcggcgatcttgtcgagcaccgccaggctgacgttgcgatcgccggcctcgatgcccgccagcatgcggcggctgacgccggaaagctcggccagcgctttctggctcaggcccgcccgttggcggtagccgcgcagattgctgctcag

SEQ ID NO: 56199 - DNA, 252 bp, Glycine max
  Peptide Sequence Number=SeqID_147884
atggcggaaaccgcaattctgggggctccgaaaaaggttagagaatggagatttgcactaagaaatccctccgcatggctccaacctcgtgggttggggatgcatgacgaataccgcaattcatggggctccgaaaaagggaagggtagagaatggagaattgcactaagcaatcactacacatggctcgaaactcgtgggtggaggatgcatgaacgaaaacgcaattcatggggctccgaaaaagggtag

SEQ ID NO: 56200 - DNA, 516 bp, Glycine max
  Peptide Sequence Number=SeqID_147885
acaacatccggtaccaagcaaagatctgtcatgtccgcgaatggacagtcaaaagccttcaacacctcaagatctctcctcgaagagatcaagtttccttctttcttgttgccgggggtggtccttctgtggacaagatctattgactgtgctgatgaggttgtgcgaggcaaagtgttgggtgccgcccctcgacggggaccgggggtagaactcgacatccctttgggcatatctttgatctttggacctacgtcgggtgcgcatcctaagggtaagccagctcggtgtatccccaatgggggtcctgctagttgtgccccagtgtcgttcacttggcatactcgtcctccaccgcatctcataggcggaggacttgagttcgtcggtagcttggttatgatagtcgggtctgcttcggcagccgaactgacagctttggctagcgagtggcctacgttcttctttaggaccatgagttgcctcgattccggtatgcatgctcttccatcatag

SEQ ID NO: 56201 - DNA, 225 bp, Glycine max
  Peptide Sequence Number=SeqID_147886
atggtttctaaagatatcattctatttgatatcaacgttgtggcagtagggactactagcgacaacatatcatcaaagagaaaaactctagataagtgtcgcaacctacccttcggtgggagggcgatgcagggctcacgggtgcgtcttccatgggaggaaggtgcgcagagtcgccaccaacgtttatttgaggaaaatgtcggaaaaatcagaaaggtgtag

SEQ ID NO: 56202 - DNA, 143 bp, Glycine max
  Peptide Sequence Number=SeqID_147887
ggtcgactctagaggatcccacacccctcccaaagttcaaggtgctggactttgacaagtacaaggggactacttgccccaagaaccatccaaagatgtattgtcggaagataagggcatacgcaaagatgaggaactgctaa

SEQ ID NO: 56203 - DNA, 303 bp, Glycine max
  Peptide Sequence Number=SeqID_147888
atgaagcttgttgaacgagatcagtatattcattggcatagattaaaggatgaagatgttgtacgtgatatcttctggtgtcaccctgatgcagtgaagttatgcaatgcattttcacatcgacaagaatgtcaaggcaaaatgtccctaattggtcaaaaaaatgcatggaagtatgtcatggatgcctgggggagtttggttgattgtcgttccgagcatcagttcgatgattacctcaagaagtttgaaattgtatgttcaccatggccaatgtttgttgactatgttaacgaaacatag

SEQ ID NO: 56204 - DNA, 649 bp, Glycine max
  Peptide Sequence Number=SeqID_147889
atgggtcagttcggcgaggcgatacacctgcccggtgaagtcggtatcgcctccgggttgcacggcctcttgcagggggttggtgtgcaccgccagcgcgtcggcacccacccgccgtaccagggagttgagctgagcggccggggctatgttgcccagctgtgcgagcccgatattgccgatgagcaggatgtcgggagcgacctcacgtaccgcgaaagtatcggcgctgtccggttccaccagcatcacccgctgcgaaccgagcatcatgccgatgccgagctcctgggcggccgcggccaggtttcggttgatggtggccgcgagcttcgcgccgccggtcatggcaccgatgagcaccggagcagccagccgcctgcccaagaactcggtggacaagtcgacgccggcgagactggagttgggcaggcgtcaatgtggcgcttcttgcgttcctgtaacaatgccctggtgcctcttgaagtgtggatcgccattgcgatcgttgccgtcgtggttgttgccgcattggtcttcggactggtgcgttaccgctcccgtcgtatcagcctgacacgttcggacaaaaacacggggatcaccgagggcgccacaccgaccgaccgatccggcggatacaccgccg

SEQ ID NO: 56205 - DNA, 429 bp, Glycine max
  Peptide Sequence Number=SeqID_147890
atgagcagaaaccagacccacgaggtcgccccaaaacacaatctcttcgatgaggaggtacgattcgaagaaataaatcaaaacatggatgactggacacactatgccgcagtgttaatgtgccttagagacattaggcataacaaatttgaagattccttaataggaactgtagaaacaagtctaggacaaggtctagtttatttcaattgttacccaaacaaaacagtgagtctgatggatagaaacattcttgactctctgttcctaaacatccactttcatgggcttaacatgaaagagggatcaattccaacagccttaatctataggattcagtacaaggtcatgaatacttgtgcgtcaagggtccttctaaaaccacaactaggagagacaactttgtttgtcgctgatatgacaggctaa

SEQ ID NO: 56206 - DNA, 472 bp, Glycine max
  Peptide Sequence Number=SeqID_147891
atgccgccagcagtaaaagcgacacacaccatcatcaaccatctcgccagtgctaacggcgagatgctccacgtaggggtctcgccagtgctttctgcgagattggttcctgtgcaaggacatttattgggcagcttagggttcaaaggctacctgtgcattgcaggaaaatatgttgcgttgcaaatttgtgatgacgaagatgttgaaactatgatcgaaagttttcaacaacaacaacaaatgtcagttctagaattgtacgtagaaaaggatgttgttggtggttctatgtttcatgctgcaaattctgttacgtcatgtgaacgtaatgtatctcatcaggagtcggaactgccaagaaatataagcaatttacatgttgatgtacatgatgatgatgatgatgatgattatcttgcatctaactcatacgttgaagagtctttcgatgaagatgatagtgatgatg

SEQ ID NO: 56207 - DNA, 252 bp, Glycine max
  Peptide Sequence Number=SeqID_147892
atgatcatagaagaatctattcttgtttcctttgatgagtctaatgctattcctccaagaaaggatattttagatgatattgcagaatctttagaacaaatgcatattcatgaacaagattttaaaggaaaaggagatggaagcaatgaagatcctccagttgaagccaaaacaaatgatgaacttccgagagaatggaaagcttctagagatcattcccttgacaacatcattggtgatatctcaaaaggg

SEQ ID NO: 56208 - DNA, 501 bp, Glycine max
  Peptide Sequence Number=SeqID_147893
aaacgaggatatgggctacgtgggagtacgtgagctcagatggaggtgggcaataggggatggtggggtggaacttcctgcttttatttttgaccacagagtggtacctggagatatgtcgcgggggtcaggagaccttggggatgtcaggcgagctcctggcagtcaacagataaaaggaacaaagaccacaaagcaaggaggcttgtgtggtggctggccagctgtgaatttgtgtgatatatgggttatggcctctggtaatcgattaccaaggggggaagctaggggagcttctggtaatcgattaccaggggatgtaatcgattaccaggcttcaaaagggaactggaagactgtggaggcctctggtaatcaattaccagtatttgtaatcgattacacagaggaatggatcgtgatggcggcgcagctaatccatgatcgagtagagatggagtgcctagagagagcttgggagaccctcgaaggcaacacaag

SEQ ID NO: 56209 - DNA, 636 bp, Glycine max
  Peptide Sequence Number=SeqID_147894
aagacgcacccgtgagcctcgcctcgctcgcccgcaaaagggtaggttgcgacagttggcgactccactggggattgtttttgtgaagaaaggaggggcgaattgtgaccgactcttagcaaacaaagaaggagcgtcggtcaactggttccctcgatggaaagaaggaagaaccagggttcttatttcgtgcagaggatttccgaatgttcccttgatggggacaaggggttgcatcagttacaatcccgttcttgctataaggcaacttggctaccctatgagaggggcaccgctagaggaagagctcacgcctgtcatttcacgaggtttcaataagaccaacgtggagacacttcagaaggtccgcaaggcatgggaggtggtgcaaaagaaggacaaagaactcaggggcagcaacaatgggcccatcggtggctaccgaaggtggttgaaagcccatgtgcaaggtttggattggctcccgagtttgagaaccgctaaaagggaggaagttgaggcaccggagaatgccgaactaagagatataaatatagctaccaccaaggccttggaacaagagaccaagagggctcgtagggaagagcacggccggaacaagttccgaggggctct

SEQ ID NO: 56210 - DNA, 379 bp, Glycine max
  Peptide Sequence Number=SeqID_147895
atggtgggttacacaccttcaagttttacagatttggtcttcgccagcaaaaggatcgatgtgggtccgaaaagaggcaaatttgatcatcctactaggacgactgagaaaactggggcaaatgaagagggtgagaaagagggagaaacccatgctgtgactgctattcctatacggccaagtttcccaccaacccaacaatgtcattactcagccaataacaaacctcctccttacccaccgaccacaataaccctagccaaggttcatcaagctccatttctccgagaatatgactcgaacgcaacgtgtgcttgtcacggagaagccccagggcgtaccattgagcattgtagagctctgaagcgtaaggtgcaag

SEQ ID NO: 56211 - DNA, 201 bp, Glycine max
  Peptide Sequence Number=SeqID_147896
atgacattgggactggggcgaactctgaaagcttctttaccggagggtttcttcccatgttgtaattcatgccaggattggcatcgttggcgtgacgaggttgcgctagatgatatgaatggcagcggaatggagaaggaagagagagaggagatgccacttcaaggagaagatgagtctagaagaagctcaccaccataa

SEQ ID NO: 56212 - DNA, 800 bp, Glycine max
  Peptide Sequence Number=SeqID_147897
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatgccgtatcgccgccaagcacggccgagcggtagacgaggaggagggcgacgggttgctcccaaatttccctcccccctttgcggggatcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 56213 - DNA, 942 bp, Glycine max
  Peptide Sequence Number=SeqID_147898
gaagccgtactcgttcaggcgagcgtacagcgccatggagttgatcaggccgatgttcgggccttccggcgtttcgatcgggcagacgcggccgtagtgggtcgggtgcacgtcacgcacttcgaagccggcgcgctcgcgggtcagaccgcccgggcccagtgccgaaacacgacgcttgtgcgtgatttccgacagcgggttggtctggtccatgaactgcgacagctggctcgaaccgaagaactccttgatggcggccgagatcggcttggagttgatcaggtcgtgcggcatcaggttttcggtctcggcctggcccagacgttccttgacggcgcgttcgacgcgcacgaggccggcgcggaactggttctcggccagttcgccgacgcaacgcacgcggcggttgcccaggtgatcgatatcgtcgatctggccacggccgttacgcagctcgaccagcaccttgatggtttcaaggatgtcttcgttggtcagcgtcatcgggccggtgatgtcctcaccacggcccaggcggctgttgaccttcatgcgaccgacgcgcgacaggtcgtacgtttcttcgctgtagaacaggcgctggaacagcgcttccaccgcttcttcggtgggcggttcaccaggacgcatcatgcggtagatggcaacgcgcgcggccatctggtcggcggtttcatcggtgcgcagcgtttgcgaaatgtacgggccgcgatccaggtcgttcgtgtagagcgtctggatgtcgtgcacgttggcggcgcgcagggcgcccagcacgctttcggtgatctcgtcgttggcgttggcgatgacttcgccggtatcggcgtcaacgatgttcttggccagcacgcggccgtacaggaagtcttccggcacggagatgcgctggatgccgccggcagccaggtcgcgcag

SEQ ID NO: 56214 - DNA, 330 bp, Glycine max
  Peptide Sequence Number=SeqID_147899
atggagtggtttttccgcatatctcaccctttcatgacaccgacccaggcaggtgaccagcagagggatgcaccagctgcagaccctgaggactacatacagccgcccagcccccaggttccagtggcatttgacccccctccatatgtggatgattacgagggatatgaggcgattgcacagaggttggagcgtgtgctcaaccttaggatagtcactgcaggcacaaagttatatgacattatacaagactgcctggcaatcgcgagagggggacccagtgctgatgggattgtcaaggctcatcagagacgtcgcacggaccattga

SEQ ID NO: 56215 - DNA, 366 bp, Glycine max
  Peptide Sequence Number=SeqID_147900
atggtgaaagttggaacctcttacgtgccgatcaacgtctcattttgcgccgaaaagttggcccagggcgattccggtatcaacagggacaccaaggatttatttattctgcgaagtcgatcttccgatcacaggtatcttattcggcgcaataccgtgcgcctcggggtgatgctgccaagcttactgattccctttagttggcgtatctggtttctatcagctgtcccttcctgttcagctactgacggggttggttatccgcgtcacaattcggcacaaagcataccgccggaagcatcagcgctggcaagtgtagcctggggtgcagacgctgacgctaactcaccaccccgccgcgcttaa

SEQ ID NO: 56216 - DNA, 490 bp, Glycine max
  Peptide Sequence Number=SeqID_147901
atgggtgaccaagaggaggtacaggaacagatgagagccgacatgtcggctttgaaagagcaaatggcttccatgatggatgccatgctaggaatgaggcaactaatggagaaaaatgcggccaccgctgccgctgttagttcggctgtcgaagaagacccaactctcccagctattgcgcaccaccctatcccaaacgtggtaggacaggaaagaagcacactagggcacatcagcaacccccatctgggatacaaccaagtggcttacccttatggattgccacctaattacataccaccagtcatacgtgatgacgcagatcatgtccctccccccatccttgaaggggagcctcttcaacagtcggacgaggtccacgaggatcgtcgagagcatgctgtcgcaacgtgcccttttgcgggcgggcgacgcgtgactcgcgggaagcgtgttccacgaaaggaatacgcgcggagtcgccaccaac

SEQ ID NO: 56217 - DNA, 177 bp, Glycine max
  Peptide Sequence Number=SeqID_147902
atgccacttcaaggagaatatgagtcaagaataagctcaccaccagaggaagccatggataagagcttgaaggtaggaaaagatgagtggagggagagaagaagcacgaaattttgtgcctcaaatgagcccactaatacaagatcacgtccaagattttccactaagtgtggttag

SEQ ID NO: 56218 - DNA, 141 bp, Glycine max
  Peptide Sequence Number=SeqID_147903
atgggcgatttcgtgaagattttccaccattcttcatcgttctttgttcgctcttcatcgttcttcggtcttcaaccgaataaaatccaaccgttcggtcatgccgtaaccacgttggaaaccaaaaaagatgtaaaataa

SEQ ID NO: 56219 - DNA, 213 bp, Glycine max
  Peptide Sequence Number=SeqID_147904
atggtccccagtggagtcgccaactgtcgcaacctacccttcggcgggagggcgacacggggctcgcaagtgcgtcttccaagaaaggaaaatgcgcgaagttgctaccaacgtctattcaaggaaaacgtcggaaaaatgggaaaggtgtggtctacgaactttaatcgtgaaaggttcgggagttgtatttacgcacgaggaaggtattag

SEQ ID NO: 56220 - DNA, 125 bp, Glycine max
  Peptide Sequence Number=SeqID_147905
cttttttcatcaacagtacccattcaccattactgattcaagaaaagcaagcttgcaagaggattggtagaggggatctcatccaaggcctttatgtcttagacctcaaggacactcttgattga

SEQ ID NO: 56221 - DNA, 866 bp, Glycine max
  Peptide Sequence Number=SeqID_147906
agaaaggaggggcaaattgggaccgactcttagcaaacaaagaaggagcgtctgtcaactggttccctcgatggaaagaaggaagaatcggggttcttatttcgtgtagaggatttccgaatgttcccttgatggggacaaggggttgcatcagttacaatcccgttcttgctataaggcaacttggctaccctatgagaggggcactgctagaggaagagctcatgcctgtcatttcacgaggtttcaataaggccaacgtggaaacatttcagaaggtccgcaaggcatgggaggtggtgcaaaagaaggacaaggaactcagggacagtaacaatgggcccataggtcgctaccgaaggtggttgaaagcccacgtgcaaggtttagattggctcccgagtttgagaaccgctaaaagggaggaagttgaggcaccggaggaagacgaagaggccttggaacaagagaccaagagggttcgtagggaagagcacggcagggacaagttccgaggggctctgtggggcagcaacagcgagcttaagcgccggagagaggaaagagaccaatcacgagtacatagcatggtcttcaaagaggagttagctacttgctcaagatccaagaagagtttggcccaacacttagaagccacggagcaaagcatgctagctataatagggcagtacaaagaagagttaaaccagtctttgacccatgagcaaaagctagtagaggacttcgcacaagcatacgccgagaaggaagcaagagggagggtgattgatgcattgcatcaagaagcgaccatgtcgatggataggttcgccttgaccttaaatggaagtcaagacctcccgtga

SEQ ID NO: 56222 - DNA, 800 bp, Glycine max
  Peptide Sequence Number=SeqID_147907
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccctagctgcaagggaagcaggaaccagtatccagactacctctccttcccacctaaactcttaagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 56223 - DNA, 199 bp, Glycine max
  Peptide Sequence Number=SeqID_147908
aggactacacgtcctcgccatcagaggactacacgtccttgccatcagaggactacacgtccttgccatcagagggctacatgccctcaccttcagaggactacgcgtcctcacctttagagggttgcacgtcctcgccttcagagggctgcacaccctctcctttagtgggctagacactctcacattcaaaggatga

SEQ ID NO: 56224 - DNA, 278 bp, Glycine max
  Peptide Sequence Number=SeqID_147909
ctctggttacgggcctctatcagtcctacagggtgcccgtaccccccggcaaggtcacgtcatcatagggattgcgcctgcaagacacccagtggacccgaagaagtccaacagggtcttggaattgtcaagctctaattacgggtctctgtcagttctacggagcaatagacacaccgccaccacctctagagttaacctcagctcatccgcaaaaaggttagagcgttgcctacgacacatggccgaccagcaggcgaccaaatccaaagccaaag

SEQ ID NO: 56225 - DNA, 309 bp, Glycine max
  Peptide Sequence Number=SeqID_147910
atggctccattgccgtcactccaaaatggtcaaatgactatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 56226 - DNA, 375 bp, Glycine max
  Peptide Sequence Number=SeqID_147911
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcggggtgtggtggttacgcgcagcgtgaccgctacacttgccagcgctga

SEQ ID NO: 56227 - DNA, 1111 bp, Glycine max
  Peptide Sequence Number=SeqID_147912
ccgctcgatgccccgaatccgcagtaccagtaccgcaccggcggcaccacggcgcatgcggtctacatcgacgacaccatcaatgtcggcaactggaccatcacgccgggcgtgcgctatgaattcatcgactcgttcctgaacgacaagtccaatcccgcggccaggacccataccagcatcaagtccgaagaacccctgccctcgctgtcggtggtctaccacgtcagcgaacaatggagcgtgttcgccaacgccggccagtcattcggcccgctgcagtactttcagatcgcctcgaccaccaacggcctgcatccggaaaaggccaccacctatgaagtcggcacgcacttcaatggcggcggctggaagggcgagctgacgctgttcaacatcgacttcgacgacgaactgcagctgcgcggcggcaccaacggcggttcggacgcctggaccaacctgggcgccacccgccaccgtggcctggaaaccgggctgtcgtacgacctgggcgaactgtcgacggcgctgtcgggcctgtcgctgtacggcacctatacctacacccaggccacctacaaggccggcgtgttcgagggccgcgacctgcccttctattcgcgcaacgtggcctcgctgggcgcgcgctacacgcgcaaccagtggaccttcaacgtcgacaccttcctgcagtccaagcagcggtcgcccggcgcgcccgatcccggcgcccgctaccagaccgaggaaagcgccaacggcgcctacggcgacatcccgggctacggcacggtgcacgtgcgcgccgcctacgacttcggcaaacagatgcacaacctgaacatcgcgctgggggtgaagaacctgttcgacaagcgctacttcacgcgctccaccgacaacaacgcgggcaagcgtcgctggcgtattgatcgggcgccggcgcgtgcggcgccccttcggcgcatgtgccggcggcacggcgggctgaacccgcgcgttcatggcgggatcacggcgccgctatttgcccaacaggcgcttgacgccagcgaccacgcccagcgtcaccgcccccgcaacgatgccgaacagggcgctgagcaag

SEQ ID NO: 56228 - DNA, 117 bp, Glycine max
  Peptide Sequence Number=SeqID_147913
atgacaaccaatcttagttcccacccaaagaaaaagactaaggtcgacaaaagcggggctcttgctcctacgtaccctccatcgaagaggaaatcagacctacgtagttcttcctaa

SEQ ID NO: 56229 - DNA, 612 bp, Glycine max
  Peptide Sequence Number=SeqID_147914
gatcactactcaccacccgtcttgcaagaagatgcgggccacattgcttctccagtccttgaaagagagcctcctcaacagcccgacgaagtccacaaagactctcaagactatgctcgaagggatgtcgagttctatcccccgatccccgaagggccggcaccaggcacgttgcttcaacccaacatcgcggcatcaccaatagttttgtccatggaaggaccgcccccagcaactgaagaaaggaggaagctcgatctccttgaggaaagattgagggccgtggaaggatttggggactatccgttcgcagacatgacggatctttgcttagtacccaatgttgttattcccccgaagttcaaagggcaggatcatcttgagctaccttctggggtagagacaaaacatgaacagcagaaaccaatcaaggtacacaggaacggatgcaagtggggatggggtcacgaccgactgatcgtcgcccttttctccacgctaagaaagcggagaacgtcgctgcaaggcagccccgtatcctttgtattcgcagttttcttttactttttgtttgttttaaaaataagtaatcaatgcctaactctaacttaa

SEQ ID NO: 56230 - DNA, 651 bp, Glycine max
  Peptide Sequence Number=SeqID_147915
atgagtcttcattcttcatctagtattaatggtgagggttctactcctaaggaccccttaaaaacaagagagaaaagaagaaggaataaaaaaagagtggaagaaataagtcaagaggaaaaagagaaaataagggaaaaagaaagaagggaaatactaagagagttaagaaaagaaaaacatgcctcctatagtagtcataactcttggaagagcctaagtgaagaacttcgtgactattatgaaggaaggcatagggcacatattagacctcactcccattggagagaaaaggaaagaaagcatcaagaggctaacattaacctcccatacttccatgggaaggacaatgtagaggctaacctagattgggaaataagggtagagcaacaacttaaaaggaagtctacttcaaaatctaattgttctcactcttatccaaagaaagaccaagggcaaggcatcttaggggtgacaccttctaagcctaaagatgataagggaaagacaatagaaaagcaaccccttaaggctagtatgcaagaaaagactagctctataaagtgctttaaatgtcttggaagaggacacattacttctcaatgccccaccaagaaaaccatgattatgagggagccaagacatttatag

SEQ ID NO: 56231 - DNA, 496 bp, Glycine max
  Peptide Sequence Number=SeqID_147916
taccctcacccttagagggctacatgccctcgccatcagaggactacacgtcctcgccttcagaggactacacgtcctcgcctttagagggctacacgtcctcgccttcagaggactacacgtcctcgccttaagagggctgcacgccctcgccttcagaggattggacgtcctcacctttagagggctacacgccctcaccttcagaggactacacgtcctccctttcagagggctacacgccctctcctttagaggactacatgtcctcgccttcaaaggggctgcacgccctcgccttcagagggctacatgccctcgccttcagaggattggacgtcctcaccttcaaaggcctacacgccctcaccttcagaggactatacgtcctccccttgagaggactacatgtcctcaccttcaaagggctacatgcccttaccttcagaggactacatgtcttccctttcaaagggctacacgccctcgcctttag

SEQ ID NO: 56232 - DNA, 525 bp, Glycine max
  Peptide Sequence Number=SeqID_147917
atgaggggagcaccgacggaagagagcctctcgcctttccttgtgagagatttcggtgcgcaaagtctcaagattgtacaaagagtccacaaggcgtgggaaagcccgttaaggaaagataaagaacttaggggcatccgtaatggcatcatcgattgttatcatgaatggttaagagttcatacacgagggttagattggctctccatgttgaaaattatcaatgaggagaacttcgaagcttcggaagaggatgaagaagtccaagctctaaaatcagagctaggaaaggcaagactcgccaaagaaaaattcaagtcagtcgctacagacatccggaaagagtgtgccggattacgagaggaaaatgcggctaccacaagagccctcgaacgagaaaccaagagggctcgcaaggaagagtatggccgatataaattccgaggggctttgtggggcagcaacaatgagctcaagctcaggagaaggaaagagaccagtcacgagtacatggcatggtcttaa

SEQ ID NO: 56233 - DNA, 511 bp, Glycine max
  Peptide Sequence Number=SeqID_147918
agcattgtgtcccgacatccttcagcacaaggttcctttaagcacttcacctagccatctgttcccccgaacacaaggttcaagatcatcacaggatccaaacacaaacagcaaaccgggacaagcgcatgagacaatttatgctaagactcaagcctatatgcaatgtggtaccatgtcagtgaaaaacctcatcgggcgcctaggagtacatgacaagacaaaccacacaataggagaccagtcagggttacagtgttttgcgaaaatgctccaaccatatgagatcaacataggtttaaaggagcactcaaactgtgtgactttcaaggcctacactccgaagagtccgtcagggcctctccctcctgattcaggtccaacccagaaaacattttatcacacagactctatctatgaattgtacaaaacacacgacttctcaattattctcaaaataattttaactcgtcgccatttaagggtcttatcattaactcgtcgcccttaa

SEQ ID NO: 56234 - DNA, 454 bp, Glycine max
  Peptide Sequence Number=SeqID_147919
atggctcaattgatttctgatgtcatctattatttgcagggatcgcacccacaaagacacccggtggacccgaagaagtccaacagggccctggggtttccagctctggaatcacacccacaaagacacccagtggacccggagaagtccaactgggccctggggtttccagctttggttacaggcctttgtagtcctacagggtgcctgttccccccgacaaggtcacgtcatcatgacatagctttaattacgggtctctgtcagttctacggagtgcctgtcacctccagcaagggcatcaggccccctactaatcgagctttcatcaagaagtactgcgtccccaggcaggcgcagggcgaaacaccacagccgcctggggatggccagcagcgggcaacagacgcaccgccatcacctctagagttcaactcagctcatccacaaaaag

SEQ ID NO: 56235 - DNA, 620 bp, Glycine max
  Peptide Sequence Number=SeqID_147920
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcaccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccagcgtttccccctggcggctccctcgtgcgctctcctgttcctgcctttcggtttaccggtgtcattccgct

SEQ ID NO: 56236 - DNA, 243 bp, Glycine max
  Peptide Sequence Number=SeqID_147921
atgatgacaaaggtgatgacaaaaagctcaaagatcaatcaaagaacaactcaaaacaattcaagagttcaagataagaatcaagaagaattcaagactcaagaagaaagtttagagtcaagaatcaagattcaaggttcaagatctcaagaatcaagatcaagattcaagactcaagattcaagaatcaagagaaggcttaatcatgataagtatgaaaagtttttctccaaaattgagtag

SEQ ID NO: 56237 - DNA, 360 bp, Glycine max
  Peptide Sequence Number=SeqID_147922
ctgaaggtcctaataatgaacgtatgcaacaaccacctaacatggtggtggatgaccatgttgcatcatctacaaaaacaggaggaggggggctcagaagtattgcgtggaaccatattgataagattaaaactactaatgggaaagacaaggcccaatgtaaatacaacaaaaagcttcttgggggagcatcaaagaatggaacaaagcatttgcatgcccatatggagaaatgcattcaaaaaaggttacatgacaaagggaagggacaaacatttcttattcctaaggttacacaaggtagacaagaattaaccgttggaagttataatgaagaaaatgctaagaaggatcttgcat

SEQ ID NO: 56238 - DNA, 786 bp, Glycine max
  Peptide Sequence Number=SeqID_147923
atggaaggaaggaaaggagggagtcttttctcgtgtggggactaccctaatgttccgttgatagggacgaggggttgtatcaactacaatcccgcacttgccataagacaactaggataccccatgagggggacgccaacagaagagagtctttcgcctttccttgtgagagattttggcgcgcaaagtctcaaggttatacaaagagtccacaaggcgtggagaagtccgttgaggaaagacaaagagcttaggggcatccgtaatggcgtcatcggtggttatcatggatggctaagagttcatacgcgagggttagattggctcccgaagttgaaagttatcaatgaggagaacttcgaagctctggaggaagatgaagaagtccaagctctgaaattagagctagggaaggcaagacttgccaaagaaaagttcaagtcagccgctacaaacatccgaaaagagtgcaccgagttacgagaggaaaacgtggccactgcaagagcccttgaacaagaaaccaaaagggcccgcaaggaggaacgtggccgagataaattccgaggagctttgtggggtagcaacaatgagctcgagctccggagagaggaaagagaccagtcacgggtgcatggcatgatcttaaaagaagagttagctgcttgcgcaaggtccaagaggagtttggctcaacacttggaagccatggagcaaagcatgctagctatcatagggcagtacaaggaagagttaaaccagtctgtgacccatgaacaaagctag

SEQ ID NO: 56239 - DNA, 548 bp, Glycine max
  Peptide Sequence Number=SeqID_147924
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattaaccaacgttcagttctcaaagaactacgtaggtctgatttccttatcgcaattgaggaatacgtaggagcaagggaaacacccttacgcacccgtgagccccgcgtcgccctcccgtcgaagggtaggttgcaacagttggcgactccactggggactgtttttagaga

SEQ ID NO: 56240 - DNA, 884 bp, Glycine max
  Peptide Sequence Number=SeqID_147925
atggagcaatttacatgtcgcttaagtgagattgagcagaaagcactcaaccgaattttgaacgagttcgcggcgctgggtgagcttaccgcagctgcatttagcgtggaaaacaatcgccggttgctggaagcaagcatcacgcttgcccaggcccacgcgttgcttaaggcatctctcaatattctaggtgtgatattaggattgggtgcattgattgttgcaggcccacctttattggcgggctatattgtagagcgcgtaacctatgcgcttcactcacgttggctgctgggtgtacctcttgccatagcaggaatggtgattagctttatgtggggacttgatggtaaacatattgcctacgaagcttattcatttgattcaatgaagtttattttaaccgctgcatttgccagtggcctgcttgcagtacctgtacaaaccaaggctattctacaaaacgggcttataccagccgatatcaatgccaaacttaaagagtattattgctgtttttatacgtcttactttttgatggcctgctctgcggctacaccgtttatagcctggcaatataatatctcatcttcactgatgtggtggacaggattgctatactggatagcagccttactgacacagttctatgcggcaaaccaaattcaggaactcaagaagttaactaatgccatcaatacagggttaaatgagcaaaaagcgataaataaccaactttggctgacggaactaaaagaaggaagtaacctctcagcagaattcgtagagactatctatctcaagttggtctcacagcatatttttcagggcgatactcgagagcaggatctggctggtgaaaactggcttttaaatgatgcctg

SEQ ID NO: 56241 - DNA, 234 bp, Glycine max
  Peptide Sequence Number=SeqID_147926
atggaggcggttcaaatcagacctcacaaggaaatgggcccttgcagccgattaggacggatgtgcagaaaaaggcacgggccatctagaaacagaacactgctccccacgttttgtctcgtgggggttatgaatatttggagcagaagcccaagaagaagttgcaggaagctgcatagtcaagaagcattgatggcgtcattgaccctccatcccccatcagacgccacgtga

SEQ ID NO: 56242 - DNA, 765 bp, Glycine max
  Peptide Sequence Number=SeqID_147927
atggaagcatgtttagtggtaggagacctattgcaacaaatgatagaccaaggccggcttgaagtcagtgatgagggggaagaagaaaaacatatatgcatgcaatccgcagataaggaaggtccaagacagcctaaacctttggtattacatttcaccagggacacagctccccaaaagccccgacacccctcggcagtgtcgggtgttagacctatttcgtttccttacaagaacagccacgcagttccatggaggtatgcccctccgagcggtaagaaggaagaagctaccgacatcagctcgctatcggccaaagtaaccaatatcaccgggctaagcggcataacccgcagcagtcgcgtattcgcaccccctgacctgccaacgcagcccgtaaatgctaaagggaaagcaaggatgatggaaggacaaaacgtcaaagtgatccccacactggacgaggatgttccgacgaaggatcttttcgagggaagagaaggctgtggcaagaaagaggtatcactcgaggaggccagcgagttcctccatactatccaacaaagcgagttcaagtgtagacaaaggatcaagctgaaagttttgatgatcccaaaggattacatgaatcatatgcttctcaaagggatcaagctgaaagttttgatgatgccaaaggattacatgaatcatatgcttctcaaagatttactcaagacaaagcaattagagatattcaagatggataatcaagacagtctatag

SEQ ID NO: 56243 - DNA, 428 bp, Glycine max
  Peptide Sequence Number=SeqID_147928
atgggatcaagtcaaaagccttcgcttaaaaagaggttctatcaagtcaaaatcaagagcttagaggtcactagtttacgagagttggggcaattaatgggtcaacttcaacggtgcttcacatttgaggacttccagctagtgccgactgtgaaagagtttgaagaaatcctgggatgcccactgggaggaaggaagccatatcttttctctgggttctatccctccacgataagagttgccaaggtggtgaaaatctcagcacaagagttggaccgtgtaaagcaaaacaggaatggggtagtcggagtaccgaggaagtttgtcctctttccgaatatggaagggttagtggacctagcagcggttgacgctttcctcgcctttcatcatggcaaggaaagcccgatcgtcgccattttggccat

SEQ ID NO: 56244 - DNA, 293 bp, Glycine max
  Peptide Sequence Number=SeqID_147929
atggctacatgtccttgccttcagaggactgcacatccttaccttcagaatactgcacatcctcgccttcagaggactacatgtccttgccttcagagggctgcacgccctcgccttcagaggactacaagtgaggggccagtagtttccctttatcagtcccttggtcacccccctgatctcggaggagggccaactggtgcccgtcccccccaacaaggtcatgccatcgtgacagggatcgcacccgcaagacacctagtggacccggagaagtccaacaggctcttggg

SEQ ID NO: 56245 - DNA, 589 bp, Glycine max
  Peptide Sequence Number=SeqID_147930
ccgctacacatccggaaagaatataccgagttacaagaggaaaacgcggccactacaagagcccttgaacaagaaaccaaaagggcccgcaaggaggaatatggccgagagaaattccgaggagcattgtggggtagcaacaatgagctcaagctccgaagggaggagagacaccggtcacgggtccaaaaggagtttggctcaacacttggaagccacggagcaaagcatgctagctatcatagggaagtacaaggaagagttgaaccagttcgtgacccatgaacaaaagctagtggaggattttgcacaagtatacgctgaaaaagaagcaagagggagggtgattgatgcattgcatcaagaagcgactatgtggatggatagattcgccttgaccttgaatggaagtcaagacctcccgcgtctattagccaaagcaaaagccatggccgaagaacagatgaaggccgatctatcggccttaaaagatcaaatggcttccatcttggaggtcatgttaaaactccagaaaaccatagaggataaagccatgacaacctcgcagcccaagtcgtaccgtccatga

SEQ ID NO: 56246 - DNA, 411 bp, Glycine max
  Peptide Sequence Number=SeqID_147931
atggggacgaggggttgcattaactataaccctgtgttggcccataagacagttagggtatcctatgaaagtgaagctaatacggagatacttcagaagatccataaggcatggaataaagtggaaaggaaagataaggagcttagaggaataagcaacggtgtcataggtggttatcacaaatggctgaaatctagagtgcaagggattgcttggctaaaaaagctagagggtctgaatgggaaagagatagaggtgtctgaggaaagcgaagaggtgcaagtcttgaaggctgagttggaaaagacaaaagtggcgaaggagaagctgaaggtgttagtcactagagttaggaaagaatgtgataggatgaaggatatcaacatgtccacggttgatgcgctagagtag

SEQ ID NO: 56247 - DNA, 114 bp, Glycine max
  Peptide Sequence Number=SeqID_147932
atgagaagaggcaatgttgatgtagataatgatattgagtgtatgtacatggggggtgcagtgaccttgttggctatccctggtgggggagataaagtggttaacaagtattaa

SEQ ID NO: 56248 - DNA, 267 bp, Glycine max
  Peptide Sequence Number=SeqID_147933
atggcttacactcacattccggtttcaacaagcgattctcctcaaatttcagccagcccgtatcaattagaccttgcaccttacgcttcagagccctacaatgctcaatggaacgccccggggcttctccgtgacaagcgcacgttgcgttcgagtcgtattctcggagaaatggaggttgatgaaccttggctagggttatggctaccattgaattatcaagtggtcttcgtcattggaagtgcggtagacatgctttgtggttga

SEQ ID NO: 56249 - DNA, 554 bp, Glycine max
  misc_feature (551)..(551): n is a, c, g, or t
  Peptide Sequence Number=SeqID_147934
agcgcgacctgtccgcgggctggatctcggtcgtcacgctggtgctggtggcggtgctggtgatcacgttccaggtgttcctggcggacgcgccgctgtcggccgcggcggtctggaagctggtggcctacgcggtgttgttcgccttcgtattcggcttcctggtggcggcggcctgcggctacatggccggcctggtgggcacctcgaccagcccgatctcgggcgtgggcatcgttgccatcgtgctggtgtcgctgttgctgctggacctgaagaccggctggctggtcggcgcgaccccgtggcgccagcaagtggcgctattgatcggttgcgtccttggcgcggcggtgatctcgccggtgttggacctgctgtacaacgcctacggcttcgccgatgcgatgccgcgcgaaggcatggacccgtcccaggcgctgtcggcgccgcaggccacgctgatgctggcgatcgcgcgcggcatcttcacgcaccagctgaactggaccatgatcctgatcggcatggcggtgggcgtcggcctgatngtg

SEQ ID NO: 56250 - DNA, 105 bp, Glycine max
  Peptide Sequence Number=SeqID_147935
atggaaattaaaaaaaaggatgaagtgggatgtgaagccttagtggatatagcaagtgtgccggggatgcggctcgggcgtagtaggtctggacgcctagcatga

SEQ ID NO: 56251 - DNA, 240 bp, Glycine max
  Peptide Sequence Number=SeqID_147936
atggtgaaagttggaacctcttacgtgccgatcaacgtctcattttcgccaaaagttggcccagggcttcccgtgtatgatggtgttttcggggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacgcccgccgcgcttaa

SEQ ID NO: 56252 - DNA, 78 bp, Glycine max
  Peptide Sequence Number=SeqID_147937
caaaggttggatagaagactccaagaagattggtagagatgcaagagaaggccctaggattctcatgagccttcaagg

SEQ ID NO: 56253 - DNA, 444 bp, Glycine max
  Peptide Sequence Number=SeqID_147938
atggggagaacccgaggtttaggtcgtgccataggtagagttgtaggcagagatagagctgctgacgaggatgctggtgatgttcccgagaggcgtaggcctactgcctcagcccgtaggctacgcgttcatcagatgactatggagggacgtgatatggctgaggacgtcgctggcatgactgatgatgtccctgagcagcctacggaagcacctgagatgcgtgcggacgcacagggtgctgatagtggtgaggggtcagatgatgatgatgctgcagagggattccctggtggtccacgtgacccgtcagtgctgacatcatttgccgagcatgttgcacatgctgtgtggagtggacaagaacgtcctgatttgaagttagtgtcacatgggagaaaggtgacactgattgggaggccagtgtctgagattgaaggcctg

SEQ ID NO: 56254 - DNA, 609 bp, Glycine max
  Peptide Sequence Number=SeqID_147939
gagaagttcaagttagccgctacacacatccggaaggaatgtgccggattacgggaagagaatgcaactaccgcaaaagcccttgaacaagagaccaagagagctcgcaaggaagagtatggccgtaacaaatttcgcggagctctgtggggtagaaacagtgaactcaagctgcgaagggaagagagggaccggtcgcgagcacatagcatggtcttgaaagaggagttagttgcctgttcgaggtccaaaaaaagcttgtctcagcgtttatgcgagacggagaccaacatgctagctatcatcgccaagtaccaagaagagttaagtctagccacggcccacgagcatagggtcgtggacgagtatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcaatggcggacacttactccgcccccgaagaaattcatgggcttctcggctattgtcagcatatgatagacttaatgacccatataattagaaaccgctag

SEQ ID NO: 56255 - DNA, 828 bp, Glycine max
  Peptide Sequence Number=SeqID_147940
atggatgccggcgcctcgcgcatcaccgaggaaatgaagctggcgtgcgtcaaggccatcgccgagctggcccaggccgagcagaacgatgaagtggcccgcgcctacgccggccaggaactgtcgttcggccccgactacatcatccccaagccgttcgacccgcgcctgatcgtgcagatcgccccggccgtggcccaggctgccgccgactccggcgtggcggcccgtccgatcgaggacatcgaggcctaccgccagaagctgatgggcttcgtctaccactcgggccagctgatgcgcccgctgttcgcccaggccaagaaggcgcccaagcgagtcatctacgccgacggcgaagacgagcgcgtgctgcgcgcggtgcagaccgtggccgacgaaaagctggcgttcccgatcctgatcggccgcccgtcggtgatcgagatgcgcatcaagaagttcggcctgcgcctgatcgccggccagcacttcgagatcgtcgatcccgaggacgacagccgcttcaacgaaacctggagcgcgtactaccagctcaagggccgcgaaggcgtgaccccggccatcgccaaggcgatgatccgcaagcacaacacgctgatcggcgcgatgctgctgcgccgcggcgatgccgacgcgctgctgtgcggcgtggccagcaagtacgacaaccagctcaagtacatcgacgaaatcatcggcaagaaggaaggccagacctacgccgccctgaacgtgctgatgctgcccgaccagacgctgttcgtcaccgacacccacgtcaacgagaacccgtcggccgaggaa

SEQ ID NO: 56256 - DNA, 252 bp, Glycine max
  Peptide Sequence Number=SeqID_147941
atgaaccttagggtaaaggacgccggaaaaaatggcggaagcttggtgacggtaatgaaacgacttccggaagaacagatcttccggaaaactctcggaacacctcttccggaatgtttccggaagatgtacttgttccggaaacattccggaagagggttcttccggatgaccttccagtggttccggaagcactttccggaagagccttcttccgtaattgttccgaagaagtacttcttccggaagtag

SEQ ID NO: 56257 - DNA, 192 bp, Glycine max
  Peptide Sequence Number=SeqID_147942
atgctagtacgaatgacagaaatcaaggaaggatcatcaaccaaaacctcacagtccattccattggagcttgtaggcataggatcttcttcatcaatggattcctttgcttcttggaagatgaatggtagcggaatggagaaaggaagagagaggagacaccacttcaaggagaagatgagtctagaataa

SEQ ID NO: 56258 - DNA, 366 bp, Glycine max
  Peptide Sequence Number=SeqID_147943
atggtagaagtctccacagaggccattgcctccctcgcccagtattatgatcagccgttgaggtgcttcacctttggggacttccagctatcacctatggaattagaccacagaaggcaagttgaaaatggggtggttggaataccgagaaaatatttggaggcaaaagcaagaatcttggaaggtaaaggcgagtgggccccgttcatagatattctcgcactgttgatcttcggaggagtgctctttccgaatgtggatgggttggtggacctagcaacgatcgacgcttttctcgcctatcataaccacaaggaaagcctggttgtcgctatgctagccgacctatatgacacctttgactga

SEQ ID NO: 56259 - DNA, 148 bp, Glycine max
  Peptide Sequence Number=SeqID_147944
atggaggagttgattaacaaaacacaacgctctccccaaaataatcctaacgtcatcacgtcggcgtgggagctcctcaacagaatctcatccctgcaccctactgctgtcattctgctcccacgaacaaggtgcgcgatcatcacag

SEQ ID NO: 56260 - DNA, 447 bp, Glycine max
  Peptide Sequence Number=SeqID_147945
atgatccagcgttttggtgatacgggttacagccaaatcatggttgaaccggtgccggaacaagatgtgtccaaatacggtgtggtagattgcgctggcgcgacgatcgcggcaggagaaagcgcgccgatgactgcggtggttgagaagccggcccgcgaggatgcgccttccaatctggccgtcgtcggccgatatgtgcttgccgccgatatttggccgttacttgagaaaacccctcccggcgcgggcgatgagattcaactgaccgatgcgattgcgatgttgatggatgagcaaacggtggaagcattccatatgagcggcaagtcccacgattgcggcgacaagtttggctatatgaaggcgtttgtgcagtatggtctgcgtcacggtacggaaggtgagaatttcagccgctggttgaagcagacgttaggaaagtaa

SEQ ID NO: 56261 - DNA, 298 bp, Glycine max
  Peptide Sequence Number=SeqID_147946
atgtcaattctggaattgtacatagaaaaggatgtggctggtggttcaatgtttcattctgcaaattcgcttacatcatgtggaaattatttatctaatgatgagacacaaccggcaacaaatttgagcaatttacatattgacgaagacaatgatgatgatgacgatgattatgttgtgtctaacttatacgttgaagagtctttagatgaagatgacagtcttgacggtatatctgatatagacgatgaagccaccgacattcctcaatcaataagaattgttcacccaacaaaag

SEQ ID NO: 56262 - DNA, 240 bp, Glycine max
  Peptide Sequence Number=SeqID_147947
atgacgccgtttcaggaaaactgtataaggctaagacaagaaagagggcttcgaaccattgggcgattcgaactggtgtatactcgagtcgaagtcgaggcagcaagatttctggacttagcgcaatttctgacaaaacttcacaaaatcagttcgatttcgagtaatgtggataaccgttctaaggagcagttatatgcatgcaaggtatacgtagcaggacacttggcattaggatag

SEQ ID NO: 56263 - DNA, 273 bp, Glycine max
  Peptide Sequence Number=SeqID_147948
atggtttctagaggtatcatccccttcgaagaacatactgcagcagtagggactctagcaacatccccagtggagtcgccaactgtcgcaacctacccttcagcgggagggcgatgcgtgactcacgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcgcggggaaggtattag

SEQ ID NO: 56264 - DNA, 342 bp, Glycine max
  Peptide Sequence Number=SeqID_147949
atgggtgaagtagaagaggagcaagagaagatgaaggccgacagggaggccatgaaagagcaaaaggccacaataatggaggccatgatgagcatgaagaagataatggaagccaatgtggttgcagttgccgctaccagcgctgttgctaaggcaaggagttggcaagtatgggcggcccccattgtgtgcaaattcaaaacaaagcacaccttcccgccatatgacttgcctcctaactatacaccacctaatgtggcgtacactcccaatgaggatgtcaataactccactcccatactcattgagagccgacaacctcatcatgtacatgtctcttaa

SEQ ID NO: 56265 - DNA, 474 bp, Glycine max
  Peptide Sequence Number=SeqID_147950
atggttgagagagagatgatcaccatgatggtagacactctgccggtgttctactatgagaagctagtgggttacatgccgtccagctttgcggatctggtgtttgccggggaaagaatcgaggtgggattgaagagaggaaagtttgattacgtttcctccacaaacgtgaacgccaaaagaatcggggcaacaggggcaaaaaggaagggaggagtatgcccattgaatccgataggcctcttcacacgccgcatggtcaagtaccttccaaatactcatggtaccatcataacgcaatcaccctacagcttctcggtcctgcttggggaacgcctcgtgagctcaacacccgtacagtgggtgttgtgccttctaaggcactccacccagaggaagctccgaaagttcgtcaacgtccggaacgcgactcgaccagccttggtcaatcgtcaggcgaggacacgactatag

SEQ ID NO: 56266 - DNA, 483 bp, Glycine max
  Peptide Sequence Number=SeqID_147951
atgcctcctgaagacctagaacagctgacccaacaaatcagagaccaactggaggagtcaatcacagaaaaagtgactcgaaagatgatggcatccttcagccagatgcagtcccagtttcagtctcagatgcaatcacagggacttgcactacctccagagccagaggttggtccctcaggtcctcgtttcagcacaaaggagagttgtgttgctcccttagggaacgatccagggacgggtgactcagacaaatgtgggctatacattgaagaaaatccttcccgcctggttgccctaggaagactttatgagggatctacaacagttcacaacatacctttgttgcatggccaagtcaaggttggtgttgaggaggttaaagatgcagaggctctcgttcctgtacccactgacgagctgtgtctccagcaaaacctccagaaagctcggatgaagaggtcgatgatcccttgtacctga

SEQ ID NO: 56267 - DNA, 372 bp, Glycine max
  Peptide Sequence Number=SeqID_147952
ggtggtccatctaacaggccacaacaacaagggcctaatctctatgatcgaacaacgaagctggaagaaactcttgctcagttcgtgcaagtttcaatgtcaaatcaaaagagcacagagtcaaccattaagaatctggaagtccaggtgggacagttggcaaaacaattggcagaccgtccgtctagcagctttggatctaatactgagaaaaatccaaaggaggaatgtaaagctgtcatgactagaagcaaattgggggccatgaaagacggtgagaatggaataggtgcaaaaaaacaacagctggtgtctggcccaacacttgatcctgtggtagagtctttgagtgagtctgatgaagagttggag

SEQ ID NO: 56268 - DNA, 423 bp, Glycine max
  Peptide Sequence Number=SeqID_147953
atgcatctgactgaaacaagtatgcgagcgcgaaattatgatatctatggattcctcgagccacattccattcagaggtctgggcaatcgcaatttgagactgaaagttatataaagagttggatgcagagttcaaaacacgatgtctaccttggagcctacctaaatggcggacactggcagatggtggtcatcatgtccaaggaacacctagttgtctggttttgttcattgcataacaggccaaacaactaccataaggggataattaacaatgctttaaaaggtcttgatgatgctccacagcctaaatcaaaggctcctgctaggtggattgtcatcaagtattttaacgatcttagaccattggagccaaagagattaaaggcgttgcgaatccactgggcacagtattatctttga

SEQ ID NO: 56269 - DNA, 863 bp, Glycine max
  Peptide Sequence Number=SeqID_147954
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgaacttctttgatggaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 56270 - DNA, 681 bp, Glycine max
  Peptide Sequence Number=SeqID_147955
gctatgaaacttgttacaggtattgttgcatctctggtgataggctccctctcttttggcgcgttcgcggcgaaagagattcaaaaagatgaagtcgcgaagatgaatctgaccaaggtcggtagcatcacgacttcccgtaccacgtcgccgatggacgcgaagcgcgatctgtcgaagaaagcggatgagttgggtggtaagtacttcgtagtgattgccggcgagaagaacgagaagacggttcacgcgaacgccgacgcaggctttcccttccgggcagcttttacagctgccggaaaggcagccatcggtgtcttcggtcatcttgaccgctttccccgtcgcttccaggcggctcaacatggcgtcgatcaacggctgtggcgtatgcaggcgggcgctcatctgatcggcttcaatgcgctcctgcagagccagcatatcgcgaacggaaacatccacccggctacgcgcccgacgcaccaggccaaagaccacgacgttaaacagaattaccgccagaatgcataccaagctgtagcgcgggtgttggctaaagctcacggtctggacgaagatcaggtaggtgtgcgcggcggcggcgctgccgaatttactccccatcacccccatggcgccggtttccatttcgccatcgcctttgcttgcttcaatcgg

SEQ ID NO: 56271 - DNA, 189 bp, Glycine max
  Peptide Sequence Number=SeqID_147956
atgtttgcttgcagtcttttcgctaagcgcacgcctcgcactaagtgcatctctgttcatgcgctaagctgcgagtctcacgcacttcgcgctcaatccttgcatctgaggctgatttggtccgctaagctggccaaggttgagctaagcttcagcctgatcgctaagcgacaacttagccgtggctaa

SEQ ID NO: 56272 - DNA, 756 bp, Glycine max
  Peptide Sequence Number=SeqID_147957
atggtattcttggatgcactgcgtgacttgacacagagtagaggttacgcttggggcgctgctgcacttgtgcacatgtatgataatttaaatgacacatccaagagcactgtgagacagcttgtaggatatatcactctattacagtgttggatctatgagcaattttcgtctgttagtttcactgttcctgccgaggattacgatgagaagagacagcgtgcatgtcgatggacctctggcaaggcactgcccatttccacgtatcggaggcgtatggatagactgacccctgatgcggtgtgctggagtccgtacggtgaccaccgctcatttagagaatttgaggtcatctcattatttttcggccatttcaaatggggccccttggctgtcattcaccgaccagagagggttgtacaacagtttggctacatccagactattccgccacatcctattgcatcttcactctctattgaagaaattaatgatagacggatgcagtttggtgagtacattgcacctgtagggcaattatgtgcaattcctgaccactattctccagattacatggattggttttacatgatctcgcacccattcatgagtctagcacagccaagggatcctcctagagttccgttggttcagcaatatgaagaatttgttgaaccatatatgtatcagcaatcgatggcagcagcggcatctaatgaggcagacgttgatgtgcatcatcttcgacatgcaatg

SEQ ID NO: 56273 - DNA, 186 bp, Glycine max
  Peptide Sequence Number=SeqID_147958
atggccagtctgataactcatgacatggcattgaaactcatgagatcagaggaaggatatcaacggagggagatcaaacggacaaataggaaggcacatcggagaccggcttacaaatcccaggttttcaaaaacgaagaagccaaagtggcggcagagctgcacaggatcgatagagaggaataa

SEQ ID NO: 56274 - DNA, 537 bp, Glycine max
  Peptide Sequence Number=SeqID_147959
atgacgcctaccaggcaccctctggacccagataagtccaacagggccctgggatttcccgccttgatcacaggactctgccagtcgttcagcgtccccgtcacacctagcaaggtgattcggtcgcccatcacccgagcttatattgagaagtactgcacgcagagacaggtccagggtgatgcaccacaggtcgcggacgcgtcgccacctcatcaggctggtccagccggattgtttgatacagagcagtatttgcggcatttggttcgccagcaggcggccaaccaccgggcacatgtacagactcatgattgtctttatcagatgagtctcagcctacagagccagggctttacttcttttccgtgccctactctggaccagttcagggcagaggtcgcatggcctagagattggcctgaggcccaggcaggagaggcaccagcagaggctcccgacgaggcagatgaggcccgcgaggacgaagagatgaccgatttacttgatttcttgggagggagcggtgccacatga

SEQ ID NO: 56275 - DNA, 686 bp, Glycine max
  Peptide Sequence Number=SeqID_147960
ggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 56276 - DNA, 711 bp, Glycine max
  Peptide Sequence Number=SeqID_147961
ccacactgggactgagacacggcccagactcctacgggaggcagcagtggggaattttccgcaatgggcgaaagcctgacggagcaatgccgcgtgaagcatcggctaactctgtgccagcagccgcggtaagacagaggatgcaagcgttatccggaatgattgggcgtaaagcgtctgtagagggaatttccggtggagcggttgaaatgcgtagagatcggaaagaacaccaacggcgaaagcactctgctgggccgacactgaccactgagagacgaaagctaggggagcgaatggggattagataccccagtagtcctagccgtaaacgatggatactaggcgctgtgcgtatcgacccgtgcaatgctgtagctaacgcgttaagtatcccgcctggggagtacgttcgcaagaatgaaactcaaaggaaattgacgggggcccgcacaagcggtggagcatgtggtttaatttcgatgcaaagcgaaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagg

SEQ ID NO: 56277 - DNA, 703 bp, Glycine max
  Peptide Sequence Number=SeqID_147962
agcttcccggtatcaacagggacaccaggatttatttattctgcgaagtgatcttccgtcacaggtgctcccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatagaggaggaaacaaaagcaaagctctagggtcaaaatacattctccaaggatggtttccaagacttcaccataatacacaatctgcatccaattcacttgcggatacaaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 56278 - DNA, 747 bp, Glycine max
  Peptide Sequence Number=SeqID_147963
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatacattagcagagcctgtttatctcttctttacacttatttggcctaagtggctgtacctagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 56279 - DNA, 189 bp, Glycine max
  Peptide Sequence Number=SeqID_147964
atggtagccataaccccagccaaggttcatcaacctctatttctccgagaatatgactcgaacgcaacgtgtgcttgtcatagagaagcctcggggcattccattaagcattgtagggccctgaagcgtaaggattttcaagtttataccattattgtaaaccacggttacatagctaaaaatggataa

SEQ ID NO: 56280 - DNA, 234 bp, Glycine max
  Peptide Sequence Number=SeqID_147965
atgcagaaaggtctttggaccagacaacatctgaacaatatagagttgtcaccaccaaataaggaaggaaaggaaaccatgacccaaggtggtcctctccctttggttgccaaccaaaatcctgtgcgctttcgactttctcgcctcgcactaaacaaaaacagaaaaggaaaagacccaaacatcagagccaaattcctcaccaaaacaccattcccgaaaaagtcctattga

SEQ ID NO: 56281 - DNA, 424 bp, Glycine max
  Peptide Sequence Number=SeqID_147966
gctttcagaattgggcattgagatccggtcaattttgacacgtcgttcccagtggagttcacagccttcaggttctgctcagttaccatcaagggagacattcatttccatgtcagaggcaaagagcatttctgagataaacaacctttgcaaagagtttgtttgtgttactgttggtacaatcacaaggattcttatggacaatcattcatggtgttatccatcttgcattcagtgctataagaaaatagatgtctatccagaaccatttgtgtgcccatgtggcaaacataatgatcgggctgtgcttagatatagagttgtagtcatggtcaattataaagatgaaaacacaaaatttctcctgtggaattgtgaatgcactgaattgattgggcagtcagctgatgaagggatcctctag

SEQ ID NO: 56282 - DNA, 80 bp, Glycine max
  Peptide Sequence Number=SeqID_147967
atggaacttagagttgaagttcatacttcaccatcattgtctcacgctaatgacctaatttggatggagatggagcagaa

SEQ ID NO: 56283 - DNA, 411 bp, Glycine max
  Peptide Sequence Number=SeqID_147968
atggctcccgatcggactcagctgcagaacatggttaaaaaggaaagcgagtcctttaaagagtatgcgttagaaggacttggcagcacaagtagcccctcccatggtcgaaagggaaatgattaccatgatgtgggctacatgccctccaacttcacagacttggtattcaccggggaaagaatcgaagtgggcttgaagagagggaagttcgattacgtctcctccacaagtaccaacgctaggaggattggagcaacaagggcaaagaggaaggaaagagatacccatgctgtcacttcagcgcccgcatggatcaagccgccgcagatctcccacggtacccatcagtatgcgcaacatcactcgagcttctcagctcgcgctggggactcctccaactcagcaccc

SEQ ID NO: 56284 - DNA, 435 bp, Glycine max
  Peptide Sequence Number=SeqID_147969
atggtaacagtaacccctgccaaggttcctcaacctccatttttccgaggatacgactcgaacgcaacatgttcatatcatggaggagttccgggacattccattgagcactgtatgaccttgaagcgttgtgaaaacccccagacaacgattgatacctcaaagccctacactggggcaacaagaggcaccatgcgtaaacctcaagcgaacctaggggtagataagaaattctcacccaataggttctctactacaaggttttcgcaacatgcccttttgcgggcgagcgaggcgaggctcaccggtgcgctttccaaaggaggaaagatgcgcggagtcaccaccaacgtttatttgtggaaaacgttggaaaaaccgaaggaaaccggtcaaaatgaaaatcctaagttcgggagttgtatttacgtttga

SEQ ID NO: 56285 - DNA, 285 bp, Glycine max
  Peptide Sequence Number=SeqID_147970
atgattcccaataatatgctcagtatgatgcatgcacctgacctcaactctcaaatgcaatgtggtaccactcatcaaggaaatagtgtaagcgtgtccgcacgacactctcactttggaaaactaggcacaactccccgcccccccctccatggtgatcagcctaagtctcaagggagttccaaaccgagtgacatgcccccaagtacaagtattcctcctcacgagaaactacaagtacttactgacaaagtttatactatttccatgcaatatgaagtatga

SEQ ID NO: 56286 - DNA, 326 bp, Glycine max
  Peptide Sequence Number=SeqID_147971
ttcttcctatttgacccgaaaccgatcgatctagccatgagcaggttgaagagagctctaacaggccttggaggaccgaacccactagagcgtatgatgtcgatggcccgaggtagagcactcaatgggctaggcccagattcgtacgctaaggtccctaagcaatcacttagtggaaaaggaagtgatcgagcgatgacaccaaggagggctcaagtgattcaccgaagcgacgagaccttgaaagttgctttttcaagtgtcagtagcgggacgttctgtcaatcggggaaggtttttggtgacaacacctggagatatcagaa

SEQ ID NO: 56287 - DNA, 854 bp, Glycine max
  Peptide Sequence Number=SeqID_147972
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatccacatgtcccaacttaagtggacggtcttgccccaaggatttaggaatagccctcatctgtttgatcaggcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 56288 - DNA, 341 bp, Glycine max
  Peptide Sequence Number=SeqID_147973
gcgagtgggccccgttcatagatattctcgcactgttgattttcggaggagtcctctttccgaatgtggatgggttggtggacctggcagcgatcgatgtttttctcacctaccataaccacaaggaaagaccagttgtcgctatgctagccgacctatatgacaccttcgaccgaagatgtgttagtttcacacctttttcgccaagaggatttccaaatgttcccttgatggggacgaggggttgcatcagctacaatcccgttcttgcaataagacaacttggctaccctatgagaggggcaccactagaggatgagctcgcgcctgtcatttcatga

SEQ ID NO: 56289 - DNA, 766 bp, Glycine max
  Peptide Sequence Number=SeqID_147974
caccagcagcgctacgaggccatcaagggatgatcatttcttcgggagcgacgcatccagctcaaggacgacgagtataccgacttccaggaggagatagttcgccggcggtgggcatcactggttacccccatggccaatggatctcgttcaatgcggatgctctcagccagttccagggataccctttagtgttggaggagggccaggaatgcgagtatggccagaggaggaaccggtccgatgggttcgatgaggaggccatcgcccaattgctatgtataccggggcaggattttgcccggactgctgttggaagacgggtgcggatcatgcgcaccaacatgaccaccctgactcagatctggatgactttgctgctcagcaacatccagcccaacgatcataattccgacctccccctgccgaagtgtcagctggtgtacgccatcctgacacggatgagcattcacgtggctcagttaatcactgatgccatctatctatttgcaggtatggcgcctaccaggcaccctctggacccggataagtccaacagggccctgggatttcctgctttgatcacaggactctgccagtcgttcggagtccccgtcgcacctagcaaggttattcggccgcccattacccaagctttcattgagaagtattgcacacagagacaggcccagggggatgctccgcaggccgcagacgcgccgccacctcatcaggctggcccagctggatcgtttgatacggagca

SEQ ID NO: 56290 - DNA, 468 bp, Glycine max
  Peptide Sequence Number=SeqID_147975
ggccctgggatttccctcgctgatcataggactctgccagtcattcggagtccccgttgcacctaccaaggtaattcggccgcccatcaccagagacaggctcagggtgatgctccacaggccgcaagcgcgccaccaccacctcatcaggctggccaggctggggcatttgacatggagcagtatttacggcatttggttcgccaacacgtggccaaccaccgagcacatgtacagacccatgattgtctgtaccagatgagcctcagcatgcagagccagggcttcgcttctttttcatgccctactccagaccagttcagggcagaggttgcatggcccggagattggcccgaggcccaagcgggagaggcgcccccagaagctcccggcgatggagaagaggcccacgaggacgaggagatggccgatttgcttgacttcttgggagggagtggagatacgtga

SEQ ID NO: 56291 - DNA, 423 bp, Glycine max
  Peptide Sequence Number=SeqID_147976
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcttggaatccctcacccttgtattcaaagattcttcataagacaatctgtctcttga

SEQ ID NO: 56292 - DNA, 282 bp, Glycine max
  Peptide Sequence Number=SeqID_147977
atgagcagtgtgctcatgaaaaactctaagtaccaaacctttactgtctctagaatatgtccattggatttaatgatgaaatatgtgcaatttcagtgggttaagcgcgcatccaccgctaagcgcagcttcaatgtgcttagcacgacagaagaatctggcaaggcatcaatatcaaggccacgtgctaagcgcaagatcaatgcgctaagcgcaacagttctcttcagccaggctcagtgcacgactgacgctaagctcaaatccacttactcgcgctga

SEQ ID NO: 56293 - DNA, 231 bp, Glycine max
  Peptide Sequence Number=SeqID_147978
atgcccttttgcgggcgagtgagggcgaggctcacgggtgtgctttccaaaggaggaaagatgcgcggagtcgccaccaacgtttatttgtgggaaacgtcggaaaaaccgaaggaaaccgtcgacaaaagcggggctcttgctcctacgtaccctccatcaaagaggaaatcagacctacgtagttcttctttaaaggtgaatcaagcgattcttttacttgaaaggtga

SEQ ID NO: 56294 - DNA, 621 bp, Glycine max
  Peptide Sequence Number=SeqID_147979
atggtgaattcagttataacagtgttgtatttcaatggaagagtatatgaagagaatgatggtataatatttgaaggcagtaaaaaagcgattcagattaaacgtgaaattagtttcaatgctttgaaaaaaaaattagagataagatttttagtttctagaaaatatgttgctttgcaaatttgtgatgacgaagatgttgaaatcatgctcgaaagttttcaacaacaaaatcaaatgtcagttttggaattgtacatagaaaacgatgtggctggtgattctatgtttcattctgcaaattctcttatatcatgcggaaataatttatctaataatgaggcgcaaccgccaacaaatgtaagcaacttacatggtgatgaaaatgatgatgatgatgatgatgatgatgattttgtgtctaacttatacgttgaagagtctttagacgaagatgataatattgacggtatatctagtacagacgatgaagtcactgacatgattcaaccagtgtacaaggaattaaaaatccattttggaatgatgttttgcattataacaatatcaactggagtcatcctgatgaggaagacatttgtggtttggagatgtcattaa

SEQ ID NO: 56295 - DNA, 327 bp, Glycine max
  Peptide Sequence Number=SeqID_147980
atgtctgagttcctcatcgcacttgaggatacgcaggagcaagggcaacgctcttgtcgaccccaaaaaactgtctctagaatatgtccattggatttaatgatgaaatatgtgcaatttcagttgagcttagctcatctgtgggctaagggggcatccaccgctaagcacagcttcagcgcacttagcgcgacaaaagaatctggcaaggcatcagcaccaaggtcgtgcgctaagcgcaagatcaatgcgctaagcgcagcagttgtcttcagccaggctcaacacacaattggttctaagcctgaatccacttactcgcgctaa

SEQ ID NO: 56296 - DNA, 504 bp, Glycine max
  Peptide Sequence Number=SeqID_147981
atgaatgtattgcctagcgctgttcatgtgtcctcccacaatgactctggagccccgcgaatctactgcctagcgctgttcgccaattctccattctccacttttatgcgagccccccccatgaatttattgcctagcgctgttcatgtgtcctccacccacgactctaggagccccgcgaatttactgtctagcgctgttcgccaattctccattctccacttttttcggagccccatgaatttattgcctagcgttgttcatgtgtcctccacccacaagtctagagcccgcgaattcattgccagcgctgttcgccaattcgcgaatttactgcctagcgttgttcgccaattctcgattctccacttttttctgagccccgtgaatttattgcctagcgctgttcatgtgtcctccaccaacgagtctggagcccctcgaatttactgcctagcactattcgccaattctgcattctccacttttttcgaagccccatga

SEQ ID NO: 56297 - DNA, 393 bp, Glycine max
  Peptide Sequence Number=SeqID_147982
atgcattatctttacacaatacttgcttctttggatcttccacacgagtatctcaagtccaacaatgttctcgttggaccagacaatgaaccaatgcttatagattacgaggccagccatatgatactgacagcgaggttcccttctcagtatgtcagcaatggaaaaggtagggctgatgtggtgcaatgggtggaaactgcaatctctgagggaagggaatcagaagtgcttgatcctaaaattgcaggctctaggaattggcttgctgagatggagcaactcctccacattggtgctgcttgcactgaaagcaaccctcagcagcggttagacttgtcagaagccattagaaggataatggagattaaattcaagtgtggtcatgattaa

SEQ ID NO: 56298 - DNA, 498 bp, Glycine max
  Peptide Sequence Number=SeqID_147983
atgggaacaaatcaaaccagcaagaggttctaccaagtcaaggtcaaaagcccagataccaccagcatcaaggaattagggcggttgatggaacccctccaaatgcaagccttccgcaagacttacggaaagatcttagagttgaccattgcagaggtgtccatagaagccattgcatcactcacccaatactacgaccagcctttgagatgcttcacattcggagacttccaattagtaccaaccattgaagaatttgaagaaattctaggatgtcctctcgggggaagaaaaccatatctttcctccggatgtctcccctctttgagcagaaatgcaactgtggtcaagggattcagcaaggagatctatttgacacatttgaccgaaggtgcgagaagagtagcgcacggatcatctgttgcttacccgccctctgtgtttggttggtttcacacttgttccaacaagacacaagacatccatgtccgctcctga

SEQ ID NO: 56299 - DNA, 439 bp, Glycine max
  Peptide Sequence Number=SeqID_147984
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaacttgtcacaagctggattctcacaattacctgagagttggcctctcctatctagacatcaagcttatcgataccgtcgacctcgagggggggcccg

SEQ ID NO: 56300 - DNA, 390 bp, Glycine max
  Peptide Sequence Number=SeqID_147985
atggaataccagcgacagcacattataaagagagaaagctctagacgaggtataaggcctcttttttactcaaacccgtgggtgcttagaatgcagtgtaaaaatgcggaaaagatagcagttattatatttacacagttcaacaaaatgcacacacgaagcttcacaattccacaattccctaaaaaaggcctaactcacaaaaaacagtccccagtggagtcaccaactgtcgcaacatgccattttgcgggcgagcgaggcgaggctcacgggtgcgctttccaaaggaggaaaatgcgtggagtcgccaccaatgtttatttgtggaaaacgtcggaaaaatcaaaggaaaccggtcaaaacgaaaattctaagttcgggagttaa

SEQ ID NO: 56301 - DNA, 102 bp, Glycine max
  Peptide Sequence Number=SeqID_147986
atgaagctttgtatggtcaagttgatccaagagaagatgaggactgctgagagtaggcagaaaaattatcaggacaagaggaggaaagacctggagtttaag

SEQ ID NO: 56302 - DNA, 724 bp, Glycine max
  Peptide Sequence Number=SeqID_147987
atgaacttaatcattgttatcaaaaggaaagaacatgctttatggcacccttaccgaacccgtgctagagctagagtaatgggtgaagcagaggaggtgcaagagaagatgaaggccgacatggaggccatgaaagagaaaatggccacaatgatggaggccatgatgagcgtgaagaagataatggaagccaatgcggttgcaattgccgctaccagcgttgttgctaaggtgaacctgatgtccccatccggcatcaaccaaatgaatcatccaacctcagatatggtaggcaaagatttgggaagtacgggcagcccccataatgtacaaattcaaaacgagcacgccttcccgccatatggcttgcctcccaactatacaccacccaacgtggcgtacactctcaatgaaaatctcaataactccactccgatactcattgagagccaacaaccccaaactgatcaggcatatatctctcaaaccatgggggagacacaagaaattccccaccacaatctagctgacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggcggatcatctaaaggaaaggctcagggccattgaaggag

SEQ ID NO: 56303 - DNA, 162 bp, Glycine max
  Peptide Sequence Number=SeqID_147988
tgctttaaaaaggtcttgatgatgctccacagcttaaatcaaaaggctcctactaggtggattgtcatcaagtattttaacgatcctagaccattggaggtagagagattaaaggcattgcggatccagtgggcacagttttatctccgagttagagattag

SEQ ID NO: 56304 - DNA, 824 bp, Glycine max
  Peptide Sequence Number=SeqID_147989
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattggtttgaacggctctgacctcatgagtggattaaagtcattaacacaggagaggcttagttaccacaagggtggatttgttataaaagcaagtatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 56305 - DNA, 366 bp, Glycine max
  Peptide Sequence Number=SeqID_147990
atggtctctcgtggcggagacgaaagggacgaaagggacgaatgtttatttcatctcagggaatcgcacgacatggaaacctgtcccgcggtggaagaattgcttcagcggctcatggactgggggcagctcgaagtgtccaaaggagggagggaagaaccacagatttgcatgcagtcagaagaaaagaaggccaaggtgaccaacatcaccggccttagtggcgtaacccgtagtggccgggtgttcgctccccctcattcagcggaatttccctccaaggggaaagcgccccatggtccaagaacccacagacgtagccactccctcgaaagaagtggatcctccggtggtaaaaggagctga

SEQ ID NO: 56306 - DNA, 680 bp, Glycine max
  Peptide Sequence Number=SeqID_147991
gtcgaggggcggttgcgccccccgatgcctctaatcattggctttaccccgatagaactcgccccgcgggctccagctatcctgagggaaacttcggagggaaccagctactagacggttcgattagtctttcgccccctatacccaagtcagacgaacgatttgcacgtcagtatcgctgcgggcctccaccagagtttccttttggcttcgccccgctcaggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaa

SEQ ID NO: 56307 - DNA, 435 bp, Glycine max
  Peptide Sequence Number=SeqID_147992
atggtgaaagttggaacctcttacgtgccgatcaacgtctcattttcgccaaaagttggcccagggcttcccgggcgcgtccgctttccagtcgggaaacctgtcggcaactgtaatgaggccaacgcgcgggcgatcgagtgcggtttcgctattgccggcgctaggcggagtgtcatacggcgattactatgttgggcactgatgcagggtgttccagtgaagtgcttctgtaaaggcaggaattgtaataacaagggcgaattggagctccaccggtgcgtcagcttagaactagtgatacaggatatattccgcttcctcgctcagctgactcgctacgctcggtcgttcactgcggcgagcggaacgatggttacgaacggggcggagatttcctggaagatgccaggaagatacttaacagggaagtga

SEQ ID NO: 56308 - DNA, 345 bp, Glycine max
  Peptide Sequence Number=SeqID_147993
atggagcattttcttgagcaagtagcctggcctgaagctcaacttccattggtgagacccaacgaggctgcttcgcctgagcccacacctgtgcaggttgatccagagccagctgacccacaatctctagtggtgaatccaccttcttcttctgagcttgaagtagctccctcatctccacctttgattgtcatctctgatgcatcatcagatgaagcggctgcccctcctgattcaccagctggagaaacagctgacccctctacttccccagttggaggaattgctgatctttttgattcgtcatctggagaagttgttgctctcactgattccccagtttag

SEQ ID NO: 56309 - DNA, 282 bp, Glycine max
  Peptide Sequence Number=SeqID_147994
atggggatcacacccacagagacacccattggacctgaagaagtccaacagggccctggggtttccagctctggttacgggcctttgtcggccctacagggcgcccgttcccccccagcaagttcatgtcgttgtggcataggtaaggagtgcatgtcgcccccagcgaggtcatcaggcccccccctaccaatcgagctttcatcaagaagtactgcgcccccaggcaggcgcaaggcgaaacaccacatcagcattgggatggccggtagcgggcaatag

SEQ ID NO: 56310 - DNA, 758 bp, Glycine max
  Peptide Sequence Number=SeqID_147995
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggttgccacatgctcatatgggccatcaaggacagtgtttacatatggggtggattgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 56311 - DNA, 309 bp, Glycine max
  Peptide Sequence Number=SeqID_147996
atggtgttgcttcgatgtgtggatgtcaggagggctgagcaaatgctggtagaggtgcatgagggatcctttggaacacatgccaacagacatgccatggtccggaagattctgagagcaggtctgaccgttggcatcttgaaaataaaaacttttggtctcccgctaagcgagaaaggcgtgctaagagcaattccaaccgaggggaattacgctgagcggcctaaagttgtgctaagcccatttccaattgagaggaagtgcgttgagcgcccagaaggcctgctaagtaaaagttgcaagttataa

SEQ ID NO: 56312 - DNA, 375 bp, Glycine max
  Peptide Sequence Number=SeqID_147997
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcggtgaccgctacacttgccagcgctga

SEQ ID NO: 56313 - DNA, 201 bp, Glycine max
  Peptide Sequence Number=SeqID_147998
atgacatgccagagattaaaaggaagtgttagtgcgcaatccgtaaagttccgtaacattccggaaggggttcaaatagcaaccaggcccacttgggccttccaggatgttcctccagaaggcggttgcttctggaggaagcaacctagcttgcctgggcgagctgggtggcaagctcctcccctattttcctataaatag

SEQ ID NO: 56314 - DNA, 420 bp, Glycine max
  Peptide Sequence Number=SeqID_147999
tggtcatgttggtgcgcgtgatccgtactcgtctctttgcagcggcacaggtgaaatcttgccccggtatgcatagtagctgcgtgatagcctccctctctagttgtgctcacacagttggtcgccctccaatatcagggggcaaggacgtgcagccctatgaaggtgaggacgtgcagtcctctgaaggtgaggacgtgcaatcctctgaaggcgaggacatgacgtatagtcctctaaaggtgagggcgtgcagccctctgatggcaaggacatgtggtgttatgaaggtgaggacgtatagtcatttgaaggtgagggcgtgcagccttttgaaggcgaggacgtgtagtcctctgaaggcgagggcgtgtagccctctgaaggcgaggacgtgtagccctctgatggcaaggacgg

SEQ ID NO: 56315 - DNA, 204 bp, Glycine max
  Peptide Sequence Number=SeqID_148000
atgaaggaaataaagagaaattggccgtgttatccagaggatatcgatgtgtggaactggtacgatgttggcaacccattctggataccgagcgacggccagaaatcaagcgtcaaattgcttcttcacttcttttattttcaaggaggtttcgggcttcatccttctcagtttctgttttaccggggaacactcgggatttag

SEQ ID NO: 56316 - DNA, 426 bp, Glycine max
  Peptide Sequence Number=SeqID_148001
atgtggtccttgagatttcttttcaaccttataaattcctttacaagcaaagatccacaagggatgtaccctcccttgttctctttgaacaacctagtggatgtaccctccactagaactgatccacaagagatgtaccctctcttgttcttagtcacaacaacccaagtagatgtaccctctacttgtaccacaaaggatgtactctccaatgtgttaagacaaagttctcaggcggttagtcctttgaaactttgtgaatggggaaacaaaagaattctcaggcggggaagaatcaaaagaattctcagactgtgtcgttttgaattctttgacaagggagaagggagacacaaaaaaattcaggcggttagtcctttgttcttttggaaaagggagaagagagacacaaaaagaattcaggcg

SEQ ID NO: 56317 - DNA, 159 bp, Glycine max
  Peptide Sequence Number=SeqID_148002
atgacgaggacgtgtagtcctcagaaggcgagggcatgtagccctctgaagacgaggacgtgtagtcctttgaaggcgaggacaggtagtcctctggagatgataacaaaagatgatgacaaaggtgatgacaaaaagctcaaagaacaactcaagtga

SEQ ID NO: 56318 - DNA, 579 bp, Glycine max
  Peptide Sequence Number=SeqID_148003
atggcaagcagagaccaagtttggtcattctgcacacatgatacgcggagataccttacggttatccgccccccctttgccattcagacacagtcgtgttcgatggcaagcagagaccaagtttggtcattctgcacacatgatacgcggagataccttacggttatccgccccccctttgccattcagacacagtcgtgtttgatggcaagcagagaccaagtttggtcattctgcacacatgatacgcggagataccttacggttatccgccccccctttgccattcagacacagtcgtgttcgatggcaagcagagaccaagtttggtcattctgcacccatgatacgcggagataccttatggttattcgcacccattcttttgctatctgtaaagacagaacgcttgatagcatgcaggggctgacacagtcttctgcaccttttgttcctccgggaacaacaaagtcatttacatgcggaaatttcatggtcgcccgcgattctcgtcaaccgagaggagcgaaattagtgtcatacactgattttcggggacctttgcttgatgacatgtga

SEQ ID NO: 56319 - DNA, 222 bp, Glycine max
  Peptide Sequence Number=SeqID_148004
atggctaccattgcattatatgggagcaagttagcatatgacatcagaatttggggtgaatcctacaagctttttgctgcaaaattcctctcttggttggtgttttggtttgtgctaaaggtggtgtttgggcattgggtgtgtggtaagcacgaaggccttgtggctgatttggggatggcctttgtggatgattgggtgagagggactgttattagctga

SEQ ID NO: 56320 - DNA, 363 bp, Glycine max
  Peptide Sequence Number=SeqID_148005
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatgttaaagaaaaggggtccgactgggggtcacacggttttactgggggtaaatgtcagctgttcgggttga

SEQ ID NO: 56321 - DNA, 510 bp, Glycine max
  Peptide Sequence Number=SeqID_148006
atggtgaaagttggaacctcttacgtgccgatcaacgtctgcattttcgccaaaagttggcctcagccccgtggcgtatcatggtttctatcagctgttcctcctgttcagctactgacggggaattggtatccgctcacaattcgcacacaagcataccgagccggaacatcagcgcggcaatcaggctgcgcaaacctgttgggaagggcgatcggtgcgggctttgctattaagaatcggccaacgcggcgaaagggggatgtgcgcaagtttgcgattaagttgggtaacgccaggagtgtcccatcactggcttactgttggcgaattggagaaaaaagctccaccgcggtggcgtcagctagaactagtggcccccgggctgaacaggaatattccgcttcctcgtcactgactcagcctacgctcggtcgttcgactgcggcgagcggaaatggcttacgaacggggcggagatttcctggaagatgccaggaagatacttaa

SEQ ID NO: 56322 - DNA, 447 bp, Glycine max
  Peptide Sequence Number=SeqID_148007
atgaatcgagtatgtatgaaggggtcagtcaagcggttcgggttctcggtcggttcccgttcgcccgccccccctcatagtccattagtgggtagggtggtcaacttagagggcgcccgcctcctcttcagacgtgtcttcgacaacctggcggttgttcggtctccgcttttggaggcgggagtgcttggtcgctggggtttccttttcctcaaccaattcggttgtgtcagccctgagattggttggtctaacatttatgagctggctggacaaagatggatggaaggtaagatagattggagttcaagtggcacaggaccttcgatcgaccatggggcgtattctacccttaccgaattcattctattgaagcgtaacgtaaaacttctcatgttgcatttctttggtttggaaagttccaggatgttgtctgtggatttctaa

SEQ ID NO: 56323 - DNA, 246 bp, Glycine max
  Peptide Sequence Number=SeqID_148008
atgctgccgctcaggcgcgctttccattcgggaaaccattcaggctgcgcaactgtaatgacggccaacggggcgatcgagtgcgggcctttcgctattcgccagctggcgctaaagggggatgtgctcatactggcgattactatgttgggcactgtgcaggctgcgcgagcggatggcggccgctctagaacaggggcggagatcccccggaagactgcaggaatgatattcttaacaggttga

SEQ ID NO: 56324 - DNA, 490 bp, Glycine max
  Peptide Sequence Number=SeqID_148009
tggaagggcatttggttatcgtatcaggcgaggaagacatcttggtgagttgcccatcctctatgccatatatggaggccgcagaggagtcattagaaaccgctttcccgaggtggtaagcatttgctccgtgtatttcttctctgggcaaccttgcctgtcagatacggcagtaatggtggcccgggtaatgttggggaatggctacgagcccgtaatgggtttaggcaaggacaacggcggcataactagcctgataagcgccaaaggaaatcgtgggaagtttgggttgggctacaaacccacacaggcagatataaggaaaagcgttgcgggaaggagaagcggaagtcaaggctcacgattaagacaagaagacgaaggaagcccgccctgccatataagtaggagctttataagcgtgggtctaggggacgaaggccaagtcgttgcaatatgcgaagatgatgctccgagtgggtcggatttg

SEQ ID NO: 56325 - DNA, 819 bp, Glycine max
  Peptide Sequence Number=SeqID_148010
atgggtgaagtagaggaggtgcaaaagcagatgaaggccgacatggaggccatgaaagagcaaatggccacaatgatggaggccatgatgagcatgaagaagataatgaaagccaatgcggttgcagttgctgctaccagcgcttttgctaaggtgaacccgatgcccccatctggcctcaaccaaatgaatcatccaacctcagatatggtaggtatggcaggaaaagagttggaaggtccgggcggccctcatttggtgcgagaaaacaagcatgccttcccaccatatggctttcctcccaactatatgccacccaatgtggcgtacactcccaatgagaatgccaataacttcactcctatactcattaagagccaacaacctcaatctgatcatgcacatgtctctcgacccatgggggagacacatgaaatgccccaccacaatctagtcgactttgagcctcgcctcggatatgccactgaagggcaagcagttggtgatatacccttgcaaaacactttggagggccctcagtatcacccacaaccacacctcttgcatttcacagcgggtaaaaaccctcatgctatagaagaaatgggaaagttggatcatctagaggaaagtctcagggccattgaaggaggtgaagattatgcctttgctaacctagaagagttgttcctagtacccaatatcatcacccctccaaagttcaaggtgctggactttgacaaagtacaaggggactacttgccccaagaaccatctaaagatgtattgtcggaagatgggggcatacgcaaaagatga

SEQ ID NO: 56326 - DNA, 326 bp, Glycine max
  Peptide Sequence Number=SeqID_148011
atgccatcaagcagattccaagatatgccaagtttctaaaggagctgtgcacccacaaaaagaagctcaaaggcaatgaaaggattagcatgggcagaaatgtgtcagcattgataggtaaatttgttcctcacattcctgagaaatgtaaggacccaggaaacatccatttttatctgatctacatacttgtcattccttatgcattgaatctgaatctgagtttgaatttgatcctgtatctgatttttatgctgagaatgaatctgaatttgagtctggttcttattttctgggtgttgtacctcttaatgttgattttttag

SEQ ID NO: 56327 - DNA, 318 bp, Glycine max
  Peptide Sequence Number=SeqID_148012
atgcatgatccccaggttgtacggcggggcttgttactcgtctttatgacactgttcctcgacattatcggcattgcgatcatcatgccggttctgccgacttttctcgaagagctgaccggtgcggatatcagcaccgcagccgtcgatggtggctggcttttgctggtctatgccggaatgcagttcctgttcgcgccgatgatcggcaatctgagcgaccgtttcgggcgacggccggtgctgctcgcctcgattttcacctttcgcgctcgacaatctgatctgtgcgctcgcaccacctattggatgctgttt

SEQ ID NO: 56328 - DNA, 353 bp, Glycine max
  Peptide Sequence Number=SeqID_148013
cttggctaccccatgaaaggagagcaccatcagaggaaagcatcacgtctttcatcgcacggggttttagtgaccccaacgcgagggtacttcaaggagttcgcaaggcatgggatgtggtgcgaagaaaggataaagagcttaggggaagtagtaatgggatcatcggcaactatcgtaaatggctgagagtccggacacaaggattggattggctccgaaagctaagggctgcgagagacgaagaggctaaagctccagaagaaagcgaggaggtacaagccctaaaggcagagcttgaaagagcctgggaagtcaaagagaagttcaagtcaatggccatcaaagtatga

SEQ ID NO: 56329 - DNA, 90 bp, Glycine max
  Peptide Sequence Number=SeqID_148014
ggaacaaaagctggtaccgggccccccctcgaggtcgacggtatcgataagcttgataagacaaagtactttgagtcctatgaaagataa

SEQ ID NO: 56330 - DNA, 640 bp, Glycine max
  Peptide Sequence Number=SeqID_148015
acatgtcctcgccatcagagggcttcacgccctcaccttcagaggactacacgtccttgccatcagagggctgcacgccctcaccttcagaggactacaagtcctcgccatcagaggactgcacgtcctcaccttcagaagactgcacgtcctcaccttcagagggctgcacgccctcgccttcagagggctacacgccctcgccttcagaggactgcacgtcctcgtctttagagggtcacacaccttctccttcagagggctgcacgccctcgccttcaaagggcgacacgtcctcaactttagagggttgcacgccctcgcctttagagggctacgcgtcctcactttcagtgggctccatatccacaccttaagagaatttaagggatcacgcccacaagacacccagtggacccggagaagtccaatagggccctggggtttccagctctggttacgggcctccgttagtcctacagggtgcccgtttccccccaacaaggggttgcgcctgcaagacacccagtgcacccagagaagtccaacagggtcctggggttccagctctgattacgggcctctatcagttctacagactgcccgtcgcccccagcaaggtcatcaggccccctattaa

SEQ ID NO: 56331 - DNA, 291 bp, Glycine max
  Peptide Sequence Number=SeqID_148016
atggcctccaactcccagcagtttagcgccagaaatgatgccatagtcattagaggagtgcatgaggtagctacaaacccatatgcatcatctgaaactaagaagcttgaaggcaaactggatgcgttggtcaacttgaatatggcacaacctccacctgagaggactctaagggaaatggctgcacctgatttcacctacgaaagcttgatccaataccctgatgaggagtcccactatgtccactctaaaactgaagcacctgactcctttgcttccaaagtttcatga

SEQ ID NO: 56332 - DNA, 360 bp, Glycine max
  Peptide Sequence Number=SeqID_148017
atgaactcaagctccagagagaggaaagagaccagtcacgggaagcttcaagacctccccgacactccaaagcaaaggccaccttcgcaggggcagctccctcctcatacctactatcctctgcaagaagatgatgaaggagatgcccatttaggccctctacttcccctcaaggatccggccccccatgagttgccccaaccaaacatagtccgctacgtcccgtctccatctgcacccattacggaactcgttccctttgccaaagacaagggaaagattgatttacttgaagagaggctgagagtggtagaaagcctcggcaactacccgttctcggatttagcggatctgtgtctg

SEQ ID NO: 56333 - DNA, 156 bp, Glycine max
  Peptide Sequence Number=SeqID_148018
atggcagaaatcaaccaaggaacggatgcaagtggggatggggtcacaaccgaccaatcgttgtcctttcccggcgctaaacgagcagagaacgtcactgcaaagcagcccagtatcctttgtggttgcagtttcttttactattgttcattttaa

SEQ ID NO: 56334 - DNA, 687 bp, Glycine max
  Peptide Sequence Number=SeqID_148019
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaagcacgcacggtattctttgtgcatgtgagctttttaggtatactgttggcagcatcccagtggagtcagtccatattttctggaggagactttgcttttcagaccaagggttatgtgagacggaagtcagcatcaaggaagagatagataccatatctaaaaggtttgatgaacttgatgtgtctggcaaagtaactctgaagagtaaacttcgagaaattgcataccctgatcataactctatgtgtccttcttcgtcaaagtatgttgatgcttttcattctgttcaaagcagcaactctccagtcaaacgtagtgcatcatgttctgaatcgcctcagccaactaaggatcatcccgatgttggatcaatttgcgccattctttcaaggttcattcgtgacgttgtggatgtgcaaagcggactgtggtcgcatgagtacatgaacctcttcggtggcacagagagatttgaacaattaaagttgtccctacttgttgatggcttttcaaag

SEQ ID NO: 56335 - DNA, 225 bp, Glycine max
  Peptide Sequence Number=SeqID_148020
atggaccctaagagaataaaggtcattcttgagtggcctactccaccaagtgttgaggaaagaatccatgagtttcaagaacctctggattttaggtcaaatccttttcaagggggagggaatgatgcaatcctacccccccaagggcattggatagaatactctaagaagattgggccaaagatacaagagaaggccctacgattctcaggagccatagggtag

SEQ ID NO: 56336 - DNA, 168 bp, Glycine max
  Peptide Sequence Number=SeqID_148021
atgtgcgagatgcatatgcgaaaggcgcaacacgagaatgtacatgtgaaaaatggcacgcagcgtgtccgctccgtgcccctattgaagggacctatgtgggagggagctaacaaggcttttagtgataattcccaaggtggtcatatctctcttgaaggtctttag

SEQ ID NO: 56337 - DNA, 231 bp, Glycine max
  Peptide Sequence Number=SeqID_148022
atggcagcggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctcaaaaagagctctgaaatctgaacccactaatccaagatcaattccaagattctccactaagagtgcttag

SEQ ID NO: 56338 - DNA, 289 bp, Glycine max
  Peptide Sequence Number=SeqID_148023
gtcgactctagaggatcctgagaatgagcctgagggatttccgggtggtccgagcgacccatccgtgctgaccgagtattcggatcacgttgcaggcagcgtatggacaggagaggagcatcctgagttgaagttatcctctcacgggaggaaggtgcatagtttaggcaggcctgtccctgccattgaggggctagttgctgggataggactaagtcctcggattgcgtgtttgatagacactggcgatcggggacttttgtcatcctttctcgagcgatggcactag

SEQ ID NO: 56339 - DNA, 537 bp, Glycine max
  Peptide Sequence Number=SeqID_148024
ccagagaggacagcaactgccgatgatgctgagatagatcgattggctagtgatgggacaactgatgatgatgaggggttccccggtgggccacgcgatccatctgttttgataggatttgctgatcatgtggcacacaacatatggagtggacaggagcaagccgatctcaagttggtctcccatggtaggaaagtagataaatttgggagaccggctgctgagatcgaaggtatgattgcggccaccggattggatccattgatcaggtgttctgtgatcaccactgatcctggactcatatccgcctttgttgagaggtggcatagggagacgagcagcttccacctcccagtaggggaggtgacgatcactctatacgacatttcgtcactgctgcacattccgattactggcgcactgcattcattcgagccgctggctacatctgacgcagtcgccctgttgacggagctacttgaggtcaccctagacgaggctacagctgaaacacgtcaggcaggtgggccacattga

SEQ ID NO: 56340 - DNA, 249 bp, Glycine max
  Peptide Sequence Number=SeqID_148025
atgctagccgacgtcgacgaggaaagatctgatgagaatcatcaaactggccaaatacaggctaaaggcccaagtggagaaggacgaaggccccgagtggagaaggatgaaggcccagaggcagagacactatcaagactattaattacttatcaaggtaatccttgtggcgtctacccggacttatcttccttcaccggaagtggcgtctaccctgacttatcttccttcaccggaagtggactctaa

SEQ ID NO: 56341 - DNA, 279 bp, Glycine max
  Peptide Sequence Number=SeqID_148026
atgctcacatacaagaggctagatcagtgggagatcattgggtattctaactcagtttatgcagaaaccctagatagtttgagatccacttcagtgccaagcacacccttactacttcatccactattggcggcagaatttgtgacatgctatgaggcatcaaatcatggcacaaactccatggtagcagatcctcttattaagggacttccacccaaggtctttcatgagcatgttgctcacatgtgtgttttacagttcgaagaatctttggtttag

SEQ ID NO: 56342 - DNA, 306 bp, Glycine max
  Peptide Sequence Number=SeqID_148027
atgggttctccacctgcctccactcctcatcctcctcctcctcctccttcggacgcatcggcttcgccgtctgtagtgaagcggacacgcaaaacctcacatctacgatcgttgtccactagaccacctggtgttgagagaccagtggtgcatgttgatcctgctaccaggaaggccgacgatccccacaggaagaaattaagaacatatttggggattatggcacgtgataaggtgaacgtcacctacaagaattggaaggaggtccctactgctcagaaggacctgatttgggaggatattcag

SEQ ID NO: 56343 - DNA, 213 bp, Glycine max
  Peptide Sequence Number=SeqID_148028
atgacaagcgaatttggaagaccacaaggatcaagaccgcgccctaagcgtgagatcagctcgctaagcgagtcaattagggtgacgaattttggagaccagagctgcatacttttgcccagaattcgaggtagtgctctagaggcaatagagaggcagaagctaagcaaggaagctagggttcatcactttgagagattaaagagtgtttga

SEQ ID NO: 56344 - DNA, 714 bp, Glycine max
  Peptide Sequence Number=SeqID_148029
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccccgacggctgcacctaccgtgagggcttgtcggccgtgcgcatcgacggcggggtggcgggcaacgtcattcccgatgcggccgcggtgacggtcaacttccgcttcgccccggaccgctcggtgcccgacgcgctgcaacacgtgcacgacgtgctcgccgggctggacgtgcagatcgaacagaccgacgcggcggccggcgcgatgccgggtctttcccaacccgccgccaaggggtaccgagctcgaattcgtaatcatggtcatagctgtttcctgtgtgaaattgttatccgctcacaattccacacaacatacgagccggaagcataa

SEQ ID NO: 56345 - DNA, 426 bp, Glycine max
  Peptide Sequence Number=SeqID_148030
atgtattttatgaagatggcttctaggaaatgtaaaagtattggttcaagacccacagcgcggtatgacacaaggagattctcttccttagatgcatggacccgatacacagataatgtcgtggggagaaacattttaccagagaggaaagtagagatatatcacactgaggtagatgagtttgaggctgaattggagaggcataatttccataaacgcctcaccaatttagtcgatgggagcatagacctggctttggtgaaagagttctatgcaaatttatacagttctgaggaccgtccaccaaagcagtacagagtcagaggtcatttggtgaagattgatgctgacagtctcaacacattcctggagacacctgtggtattagcagatggggagaccttacccgtatactccagatactga

SEQ ID NO: 56346 - DNA, 255 bp, Glycine max
  Peptide Sequence Number=SeqID_148031
atggttaaggaggagtgtaaggaggtaagtgtctcctccaagagattagctaagaaggaaagtcatttttcaacaaaaacaaaaattaaagaaactttccttcttagacaacttccacactttctcctttgtaaaaagacacttgttagcattgtcacacctcttgggcttgaggttattcctcaagtaaaggagttgttggatgatgatttggtttgcaagagcttaaatccttgtgctttggggatcctctag

SEQ ID NO: 56347 - DNA, 219 bp, Glycine max
  Peptide Sequence Number=SeqID_148032
atgacagatcttgtgagcgtggaagatgaccaaaagaatgtttatacggataaccactcgggtatttccgcccgtcagcgtgactcaaatgtgaatatgacagatcttgtgagcgcggaagatgacggtgcagaagacgatgttagtctctgcatgctatcaggctttctgtcttacagataccaaaagaatgttttgaaagtgcggacaaccacttgg

SEQ ID NO: 56348 - DNA, 372 bp, Glycine max
  Peptide Sequence Number=SeqID_148033
tggtcccttcgacgcttcaccagaaattgaaattcgcggttggtggactcttggtgatagtgtcaggcgaagaagatatgttggtgagctgcccctcctccgcgccaaatgtggaagcagcggaggaatcattggaaacaactttccaatccttcgaggtggcacggttatgagcccggaatgggtctgggcaaggacagccacgggaatgccgatgtggtcgacattagggggaacccatacaaatatgggttggggaagaggtggcggcaataggagaggaatctccacaagattcgccaagtttcgtgcaaccatgccatctccacaagatcctccgagccagttagaagtctataccgctgattcaat

SEQ ID NO: 56349 - DNA, 960 bp, Glycine max
  Peptide Sequence Number=SeqID_148034
atgagccggatccgcattgagaaaggcacgggtggctggggcggcccgctggagttcgacgccaccgaaggcaaaaaaatcgtctatatcaccgcaggcacacgcccggcgattgtcgacaaactacgcgggctgaccggctgggaagcggtcgacggtttcaaagaaggcgaaccaccggaggcggaaatcggcgtggcagttatcgactgcggtggcaccctgcgctgcggcctctatccgaagcgtcgcattccgacggtgaatattcactccaccggaaaatcaggcccgctggcgcagtacatcctcgaagacatttatgtctcaggcgtgaaggaggacaacatcacgctggtgaatggcacttccgcgccgcaaaaagccgcaccgcgtgattacgacaccagtaagaagatcaccgagcagagcgacggcctgctggcgaaggtcgggatgggaatgggctccgccgtggcggtgctgttccagtccgggcgcgacaccatcgacacggtactgaaaaccattctgccgtttatggcgttcgtctcggcgctgatcggcatcatcatggcgtccggcctgggcgactggattgcccacggcctcgccccgctcgccagccacccgctcgggctggtgacgctggcactgatctgctccttcccgctgctgtcgccgttcctcggcccgggcgcggtgatcgctcaggtcatcggcgtactgattggcgtgcagattggcctcggcaatattccgccacacctcgccctgcccgccctgtttgccattaacgcccaggccgcgtgcgacttcatccccgtcggactgtcactggccgaagcgcgccaggacaccgtgcgcgtaggcgtgccgtccgtattggtcagccgcttcctgacgggcgcgccgacggtgctgattgcctggtttgtctccggctttatctatcaataa

SEQ ID NO: 56350 - DNA, 410 bp, Glycine max
  Peptide Sequence Number=SeqID_148035
atgtcgacaactccgcacccatacccattgagagccaccaaccccaatctaatcatgcacatgtctctcaatccatgggggagacacatgaagcacctcgagaccacagtttagccgacttcgagcctcacctcagatatgtcactgaggggcaggcattttgcagcgtacccctgccaaacactttggggggccctcagtatcgcccacaaccacaacccttgcattttgcagtgggaagagtccctcctatcatggtggaaagggagaaatttgatcatatggaggaaaggctaagggtcattgaaggaggcgaaaattatgcctttgttgatatggcagagttgtgcctattgcttgacatggtcattcctccgaagttcaaggtgtcgaatttcgataagtactag

SEQ ID NO: 56351 - DNA, 933 bp, Glycine max
  Peptide Sequence Number=SeqID_148036
atggaaggtaaaaacagccagttgcaacaacgcaaagatgacgcgctgccgcgcggcaccggtaatctttgtcagtggtatgtcgatcaggccgaaaacgccaccctgcgtgacgttgagggcaatagctggattgatttcgctggcggcatcgcggtgctcaacaccggccaccgtcatccgcgtatcgtgcaggccattgccgatcagttagcaaaattcacccataccgcattccaggtcacgccgtatgagagctatgtggcgctggcggaacgcatcaaccagcgggtgccaattgccggtaaagccaaaaccgcctttttcaccaccggcgctgaagcggtagagaatgcggttaaagtggcgcgcgccgccacccgtcgtcacggcatcatcaccttcggtaacgcctttcacggccgtactttcatgaccatggcgatgaccggcaaagtggccccttacaagcgcgattttggcccgatgccggcctcggtgtttcacgcccgctaccctaacgcggtgaccggcatcagcgttgaggacgctatcgccagcctgcacgacctgttcagccacgacatcgcgccgcaggatgtggccgccatcgtactggaaccggtgcagggcgaaggcggtttccacatcgcgccggcagagtttcttacgcagctgcgcgcactggccgatgagcacggcatcctgctgattgccgatgaggtacagagcggatttggccgcaccggcaagctgttcgccatggaacactacagcgtgcagcccgatctcatcaccatggcgaaaagcctggcgggcggtatgccgctgtcggcggtgagcggtcgtgctgacatcatggatgcgcccggtccgggtgggctgggcggtacttacgccggcaatccgctgtcgattgccgccgcgcatgcg

SEQ ID NO: 56352 - DNA, 327 bp, Glycine max
  Peptide Sequence Number=SeqID_148037
gagattgtgagactccatgatttgccaaggagcattgttagtgatagggactctgtgacatcctggaaatttctatccggaattttatttttagaagctttttcctcatctcccacgttgcttttcttctccctttctcctccaccattgttgcccattaaagctccaaactttgctcatcatttctactccaaattgcaaagggaagccattttcggagtcgtgaagcgcacctctacgttgtgggacttcgaatttcaggtatgggtggacttcttctcacatgaaattcgtggatattcggtctttgggagatatgatgggtag

SEQ ID NO: 56353 - DNA, 882 bp, Glycine max
  Peptide Sequence Number=SeqID_148038
atgctgttccacctgggccgcgcgcgacacgttctcgaagcgcgccgcgccgaacaggtcgaggtcgtacttggcctggacctggccggtgaagacgttgtagagcgccgtgggttgcggcaggttcggcatggtctgcggccggcgcgaacgctcgggctccaccgagggcagcagcgccgaatgaccgtccgcctgccagttgcgccagggtgtcggccacgtcgcggaaggcgtcagcaggtctgcttgtattgcagcaccgccgcctctacctccccatggcggcgctgcgttcggccagcagcgcgtccgccggaagatgggcgttcagcgacgcgccattgcccagatcgaccccgcgcccgacagcgccgtgcgccagcgaagccgccctgtgcccatcgagccgcagcacaggctggcgggaacaatgcgccgttggccacgccgacgtcggctgccgccgcgcgcagcacggcctatcgggaggatgtcgggccgcgccgccacagttcggacggcaccagcaccggcacctcctcgggcactggcgatcatggcgaaggccaggtcgggcggcgcctggacatcggggctgcaggcccatcagcaccgccagcgcgtggcgcgtggcctgccattgcgcgcgcaggcccggcagcgaggcttccagcgtggcggcgtcctggtcggcctgcagcgcgtcgattctgcgaggccgagcccagttcgtaccggcgctgggtgtcgcagcgcacaccgtggcgcgccagcaccacctgcttttcggtcaacgccacccgctcggccagcgacgccgaggtgatggcgccggtgacgatgttgccggccagggaacggcgcgccgattcgagctga

SEQ ID NO: 56354 - DNA, 591 bp, Glycine max
  Peptide Sequence Number=SeqID_148039
atgtcagttctagaattgtacatagaaaaggatgtggctagtggttcaatgtttcattctgcaaattcccttacatcatgtggaaattatttatctaatgatgacacacaatcgccaacaaatatgagcaatttaaatcttgacgaagatgatgatcatgatgatgatgattatcttgtgtctaactcatacgttgaagagtcgttagacgaagatgacagtgttgatggtatatcagatacagacaatgaagtccccgacatgattccaccagtaagaattgttcatccagcagaaggtgtacaaggaattcagaatccattttggaatgatgctttgcattataataatatcaactggagtcatcttgatgaggaggacatttatggtttggagatgccatccagttttaatgttggccaagaattatatgttggcatggaatttgatagtaaagatgcggtaaagaatgaggtcaaacaatatgttatgaaggtgcatcaaagtatcaaagtggttgaaagcaaatgggacaagcatgatcagagaagatccatccataaaagtttcattgattcaagagaggattaa

SEQ ID NO: 56355 - DNA, 2994 bp, Glycine max
  Peptide Sequence Number=SeqID_148040
atgtggcgattaagggatattaaactcatatctccccgggtggaaacaaagtacaacaagaatgagaatttaggcaaagttgagtggcgcagttgtagaaagggtgaacgaagatgtttcctcaggagaaatcatagtaacggctatcagcaggggcagggggtgggttacagtcacagagagcgagtccgtcgtggcactcgcaggtcacgtgcctccacttcctccgttagggtttacgaccagcaccaaccgcaacatcgacctccttggactgatttcgacgtcgcctattaccattcttacgctcaccttggcatccaccaagagatgatcaaggatcgtgtgcgtacggaaacttacagggatgcaatcatgcagcatcagagttccattgcaggcaaacagttgcaccaccgttaccgttgtagcattagcatgcttctacgctgctttccaataaagtcgaagctgttgcagtctcaattcaccaatacacgcctcttgtcgtgtgctacaatcccaatcacagctctgaaagaatgcaactccttagcccatgcgaaactgttgcatcagcaaagcatcatgcaaggtcttcttttccatttggcgacaaacctcatcggcacatacatagcttccaattctactgcgtatgcgattctgcttctggagcgcctcccgccgtccccttcatcggttttctggtggaaccaactcataaggcgcgcccttcatctcggaagccctcgtgacgttttcactctctaccgtcagatgaaatcacttggctggacccctgaccactacaccttcccttttgtcttcaaagcttgtgccaacctttcctctctctccctcggtgcttccctccatgctactgtttcacgatctggctttgcctctaacgtatttgtctgtaatgccgtggtctccatgtatggaaagtgtggcgctctccgtcacgcacacaacatgttcgatgatttgtgtcaccgaggcattcaggacttggtttcttggaattctgttgtgtctgcttatatgtgggcttccgatgcaaatactgctctcgcattgtttcataaaatgactacacgtcatttgatgtccccggacgttatcagcctcgttaacatacttcctgcttgtgcttccctggctgcctcactgcgcggaagacaggttcatgggttttctattagaagcggattggtggatgatgttttcgtgggaaatgcagtggttgatatgtatgccaagtgtggcaagatggaggaagcaaataaggttttccagaggatgaagtttaaagatgttgtttcttggaatgccatggtcaccggctattctcaagctggcagattggaacacgctctttctttgtttgagaggatgacggaggaaaatattgagttagatgttgtgacatggacagctgttatcactgggtatgcacagagagggcaaggttgtgaggctctggatgtgtttaggcagatgtgcgactgtggttctcgtccgaatgtggtcactctcgtctccttactttcggcttgtgtgtctgttggagcactgcttcatgggaaagaaactcattgttacgccatcaaatttattctcaacttagatggacctgatcctggggccgatgatttgaaggtgattaatggtctcattgacatgtatgctaaatgccaaagcacagaagtggctcgaaaaatgtttgattcagtatcgccaaaagacagggacgtggttacctggactgtgatgattggtgggtatgcccaacatggtgatgctaataatgctcttcaacttttctccggaatgttcaaaatggacaagtctataaagcctaatgattttactttatcatgtgcccttgtggcctgtgctcgtttggcagcactgaggtttggtaggcaagttcatgcttatgtgttacgcaatttctatggttctgttatgctatttgtggctaattgtcttatagacatgtattccaaatctggagatgtagataccgctcaaattgtttttgacaacatgccacagagaaatgccgtctcttggacatctttaatgaccgggtatggcatgcatggacgtggtgaagatgctctccgtgtttttgatgagatgaggaaagtgcctctggtgcctgatggcataacctttctggttgtgctttatgcttgtagtcactcaggaatggtggatcatggaatcaatttctttaatagaatgagcaaggattttggggtagatcctggaccagagcattatgcttgcatggttgatctctggggtcgcgctggtcgtttaggtgaagctatgaagctcataaatgaaatgcctatggaaccaaccccagtagtttgggtggccttacttagtgcttgtcggttacattcaaacgtggaacttggggaatttgctgcaaaccgtttgttagaattggaatctggaaatgacgggtcatacacattgctttcaaacatatatgctaatgccagacgctggaaagatgtggctaggattagatatacgatgaaacggactggaatcaagaagagacctggttgcagctggatacaaggaaggaaaggtgttgcaaccttttatgtgggagacagatctcacccacagtctcagcagatatatgaaacacttgcagacttgattcaacgcattaaagccattgggtatgttcctcagacaagctttgctcttcatgatgtagatgatgaagaaaagggtgacctgctttttgaacatagtgagaagttggctcttgcctatggcatcctaacattacatccacgtgcacctattcgaataaccaagaatttacgcatctgtggtgattgccacagtgctattacctacatatccaagattattgaacatgaaatcatactgagagattcaagtcgcttccatcatttcaaaaatggatcctgctcatgcaaaggatactggtga

SEQ ID NO: 56356 - DNA, 957 bp, Glycine max
  Peptide Sequence Number=SeqID_148041
atggagaagacaggagtgttatcggcgaaggaggcattcgagaagcttgaaaaggtgggagaagggacatatgggaaggtgtacagagcaagagagaaggcaactgggaagatcgtggctctgaagaagactcgtctccacgaggacgaagaaggtgtccctcccaccactctccgtgaggtttccattctgcgaatgctctctcgcgatccccatgtcgttaggttaatggatgtcaaacaaggtcagaacaaggaagggaagacagtgctctacttggtatttgagtacatggacaccgatctcaagaaattcatacgctctttccgtcaatctggggaaaccattcctccccatatcatcaaaagcttgatgtaccagctttgcaagggcgttgctttctgccacggtcatgggatcttgcacagggacttgaagcctcacaatctcttgatggaccgaaaaaccatgatgcttaaaattgctgatcttggactcgctcgagcatttaccgtgccaattaagaaatatacacatgagatactaaccctgtggtatagagctcctgaagtcctcttgggtgctacccattactcaatggcggtggacatgtggtccgttggctgcatatttgtgtatgtgagactgagggtttactactgttatttgccatctctggtgtatgtgagactgagggtttactactgttatttgccatctctagtgctattgggtactcccaatgaagatgtgtggccaggcgtgagtaaactaatgaactggcacgaatatcctcaatggaaccctcaaagtctatcaacggctgttccaagtttagatgagcttggactggatttgctatctcaaatgttgaaatatgaaccttccaagaggatttctgccaagaaagcaatggaacatgtatactttgatgacctggacaagaggcacctttag

SEQ ID NO: 56357 - DNA, 1344 bp, Glycine max
  Peptide Sequence Number=SeqID_148042
atgatctctgcatcaaaccctaaccctaaaaatgtgtaccacatcggcggtctgcaagtggagtttccctatcagccatacgggtctcaatttgcctttatgggtagagtaatttccacccttaatcgagctcagaaagaaggccattgtcacgcgttgcttgagtctccaaccggcactggcaagtccctgtcgcttctctgttcctctctcgcttggcagcaccattataaatctcaacaccaccacctcaagtccgcacatgaggcaaccgccgatcctctggcttatggcggcggttttgttcccgacgaagttccactttcttctgaaagtctggaccgtacgcaatctgagggcaacaacaagaagcagaagaaaaaggaagcacccactatatattatgcctcgagaacacactcacaaatttctcaagtggttcgtgaattgcggaaaactgcatacagggttcctatggctgtgttggcatcgcggaaacattactgcacaaataaaaatataatgggcaaagagaacatcaacgatgaatgtaaactattattgaaagatcaggcaacggggtgtccagaattcaaaaatgctcataaagtcaaaggtcatccatcccttcataaaggaggatgcaatgaggtacatgacatagaagatcttgtaaaagttggacaattggtaaaaggttgttcttattatgctgctcgttctatgtcagatgatgcacagttggtattttgtccatataactacatcattaatccagtcattcgggcagcaatggatgtggatattaaaggagccatagtgattcttgatgaagctcacaacatagaggacattgctcgtgatgctggcagtgtggatattgaagaggatgttgtggatagtatgcttaactatatggtcatacctttgaaagaactacaaatggagcttcaacaactttgttctattaaggctgaaatttaccaaccgctatatgaaatgacacagggccttactagttggatggaacagaagaagaacaagctagaaaaacgtgattttcagcactatgtgtcttgttggactggtgataaggctttaagagagcttgaagaagcaaatatttcaaaacagtgtttccctatcttgctagaatgtgctaccaaggcaatcaaagttgctacagacttggagacagatgcaccgcatataagtgccatgtcagtgataacattggaaggcttattctcatcgctaacttatttcttctcgagaaatggatctcacatgttggattaccagcttgctcttcagcgatgtatcagagaagatactggtaaatag

SEQ ID NO: 56358 - DNA, 2949 bp, Glycine max
  Peptide Sequence Number=SeqID_148043
atgtcggccaagttcctgaccgtgccgccatttgagtgcgcctggagagaggatttgaaattccgggaggcaggccggggttgcgtcgcctttgaagcattcgcctgcaacgatgtcacactggttttccgggagaatgtgggaagccagggctaccattataaaagagatagcagtcctcactacacaatcatattggggagtcacaggaatcggcgactcagaattgaggtcaatggaaaagctgttgtcgatgtggcaggggttggcctctgctgctcttcctcctttcagagttattggatcagcatctatgatggcttgattagtataggcaatgggaaataccctttccaggatgttgttttccagtggttggattcttatcccaattgtaatgttcagtatattggcctcagcagctgggataaacatgttaagtatagaaatgttaatgtcttgtctctaacacacactcatgtgcccctctcgaagcatgtcgtttttggtgattatcaagttgaggacgaggttgatgcagcagactgttacaattacaaaaacatggattatgacaaatgggggctcaaaaaattcctcgagagttgggacttgtctgatgtgttattcatcgttggtaaagaggaaaaacccgttcccgctcacaaggcaattttagctgcatctggaaagttttctctgtgctcctcctcctttgtcatcaacctacccactgtatcttatctacttttccgtgcactgcttcactacatctatgttggctggacccaggaacaactcggttctttgagggatttaagtctacagtttgaagtgacaccactggtgaagcagtgtgaagagactatggaacggtttaagctagataagaagttgtttgacacgggcaagaatgtggagttaacatatccatctatccgacctcattgttcaactttgccctcacttcctgtcagcactcagcaactgaaacaattgaaattaacaggccagtacagtgatgtaaacatctacattgagggttatgggctcattgcacgagctcataaaattgttcttagcttatggagtatcccctttgctcggatgttcacaaatggaatgagtgaaagcatgtcctcggaggttactttaagggatgtcccaccggaagctttcaaggctatgcttaactttttatatgatgggcaattgaatgacaaagttatagattctggtgctttgttgctccaactccttctattagctgatcaatttggagtgacttttcttcaacaagaatgctgcaaaatgcttttagaatgtctctcagaggactcagtatgtccactcctccaagtggtttcttcaatgccatcatgtagacttattaaagaatcattgcagaggagaatttccatgaactttgactattatatcagtgcgagtactgactttgtgttattagatgagacaactttaatcaatatcattaagcatccagatctgacagtaacgtctgaagagaaagtccttaatgcaattctaatgtttggcatgaatgcaaaacagttgtttgggtgggaagtggtggatcagttaatggaaaattcaaaaccagaactcctttttggtgagaggcttcagttaatctatgacttgttgccatttgtgcgatttccactactacaatattccttacttgagaagttgcagcatagcagcattggccggcatattcctgttttccaaaatcttgttaacgaggctatcaattttgttaaatgtgggctggcagagtcagaaaatgaagagaaggaactccagtacatctgtgatggggatgaccatggagttctgtactttgctggaacatcctatggtgaacacccgtgggttaatcctcttttggcagagccaaggaaaattaccatcacagctagcagcccccactcaagatacactgatcccaaggttttggtctcaagaacctaccagggaacatgttttgctgggcctcgattggaaaatggacagaactgtagctggtggatggtggatcttggccaagatcatcagcttatgtgcaactactataccctgaggcaggacggttctaaggccttcccgagatgttggaatgttcaggaaccaccaccgatgccaccaatccctggaatttctgcatttgttacttggaattgtatggctacttcctttaaaagcctagccatgccaataccataccttcctaaaatacaattccagctccttcatgcccaggcccaagacaaaggaagtggaatgggagaagatgaaatggaatcaaagacagtcatactccagggaagtctaatccatttctctcaaaatctcacctccacagctggtcgtgaatttacggaatttgcaacagaaccgtctatgcagaggcaagttgtggaggcactccactcgggtgacagaaagaaggcttcagacttactttcggattttggttccagaagccgccactcattaacagctgaccattttgttcacatttttgagtactgtgctcgctctcctgatcctttgtttgttatggagattttgagattcatggagttaaaaggtgttagcatgaacaatatatgctcatctcttatgatgcaggccctttgtaatgggggttacttggaagaggcctttgatatcgttgattatcttggaggaagtcaacgtctctatccagttctcccactgtacaatagtctcttaagatcctgcacaacaatgcagaatataattcaagcaagcagatgtttggacttaatggaaaagaagatggtagggaagaatgaagttacatatattgagcttctcaagactgataatgtaaggcttagagatcatttcaatcccttttccaactgtggcatgagtttgcatatttaccttactgcttaa

SEQ ID NO: 56359 - DNA, 570 bp, Glycine max
  Peptide Sequence Number=SeqID_148044
atggataatgttctcgtggcttcagaaattatccattgcttgaagagcaaaagaagtggagggtttgaggagttgtctctaaaggtggatatcaataaagccaaagataggattaactggggatatctaagagttgtcatgatcaagatcatggaatccaatcttgtttgggtgaaaaagattatgttttcaaatactgatgatgcaaggcgcaatttgctttcaaatatccttggggttcacgctagaattggtgctgagaaatacctaggaatgcctttaattattggcaagaatagaaggagtacctttgggtttgttaaagataaggccattctcacctatgttatgagtgcctatctcttgccgaagtcaactatggaggaatttcaaggaaacaagggtggaggtttatctctcagccccactgatatggtggcactcagaaggaggatcggagatggtgttaatattaatgtttggtctcagcactggattaataatgagacttcgggtcctattggtgatgttcctcactcgcagtcaaagagctggtggttaaagatttga

SEQ ID NO: 56360 - DNA, 1149 bp, Glycine max
  Peptide Sequence Number=SeqID_148045
atggagaaggaagccgaattgggtgaaaaggagtttgaacaaatggtgcgggctttgccttccgatgctgtcaaggagttattgtcgcacggggtatgcactcgctgcatctttcgcctcttcggcctccaaggccccgtctatgcttctcctccctccctctcttccctcttcgatgcaacacaacaagattgcctttgcacactttgcttagggattctgcagttcacatattctaatgttcaaaacgacaatctccctcttctcattgctgacatggttaaacgacaagcctatcagttcgataccttttcccttgaagtttccattccacctatcattatcgatgatctcctatatgaaaaccaaatatggatcccaaccttggttccaagaaaacttgcacagtggatgcatctctacaaaggacgccttaaaattttctcttatctatcctcttcaaaatcttctggtgagccaagcatagttggagaaagatcttttagcagtacacttgaaaatgattcctctgactgctgtaaattcttgctagaaaaggcaaatgagccttgccattttacttacagttgctacaggacgcctttctattttggtggaagatacctaaagtattcacggaatgtgagtcaaacacgctggatcattgatgatgaaagaatgggagaagcatcagttgaggaaataattggtggaaacatcctccaagcctgccaaggtgatagttttaagtttcatgctgcaggcagagaagatattgatgtccggatgttgggtccaggcaggccatttcttgttgaggtgcaaaatggaagacatatcccgtctgaactgtttgtaaaagatatagagaaaacgataaataaaatggagaataaactggttagggtgaaaaatctgaaacttgttggtagtgatggatggaaccttatgcgtgaaggtgaagcagagaagcagaaacaatatgctgctttggtgtggatttctcgtcctctaaaggatgaagatattcaatgtgtttcttcactcaaggatttgcttgagcaagtttctttggtgggaatcaacaccaacgaacatttgcaacctggtcattctgttatacccatcgtgctccttcctaagtcctaa

SEQ ID NO: 56361 - DNA, 1215 bp, Glycine max
  Peptide Sequence Number=SeqID_148046
atgcagcagaagaatttgaagccatatgattcaactctagcgtcactttcaatcacttgcagcaaagcactacaactagatttagctgaggcttttctgaatcaaatttctgaatgtctatatccaaatccttataatgctttgctagcatcatgcgatcaactgaatcaacttgaacgtgctattcgagtgtttgccaagatggagcagaaaaaagttttacctaatatcaggacatgcgagcttctgttttcgttatttggagttgtaaatggccattacgaagacagtgatgcgctgtcaaaggacaggaatggtatattgttcatttacattgcttatgacttagccatgttctttgggtcttttcagatgagagcccttggagaagaagggatgataaaagagttgatccagtatttacatgtggcagaaaatcttttcatttatagaaacccttcattgggaacacatatgtacaacacagtgttacattatcttgttgaagccaaggaaagtgacacggtgattgcaattttcaagaagatgaagttatgtggctgccaccctgattctgaaacatacaatataatgattgactgttgtaccatcctaaaaagttacagatctgcttgtttgctgctttcaatgatgatacggaaagggtttcatccagtgatttgtacatataacgctatcattgagattttgttggaagatgagaactttaatgaagccctgaatcttttgaaacaagtcatattggatggcattcaacctgatgtactgctgtttaatacagttcttaaagaagcatgctacaagggaaggattgatgtaattgagtttattgtggagtgtatgcgccgagagaaagttcccccagatacaagaacatgtggctatgtcttctctgcatatgtagattctggttttcacaatacagcaattgaagcattgcaggttttaagtttgcgtatgatgtctgaagatggcaacatacttagagagaatacaaattttgtgaatgaattcatcctatctgaagatgtggctgttgttgagtcacagatacttaaattatttgaagattctgaagatgaacttgcaattgggttgttgaatttaagatggtgtgcaatagctgggttcccaatctgcaagtcagctgatcaaagtctatgggctaaaagactggaaggaatgcaattgtga

SEQ ID NO: 56362 - DNA, 201 bp, Glycine max
  Peptide Sequence Number=SeqID_148047
atggctcccttgcaaactgcactgttgcacatggttgcagctgaggattatcaagatcttccaacttgttgtacctctatgtcattggctccctcctttccttctgtcaaacacagggtggaggaaaggaaggagaggacgggatactcagactcggagagggaacaggagagagaggaggagggtggaggaaactattga

SEQ ID NO: 56363 - DNA, 948 bp, Glycine max
  Peptide Sequence Number=SeqID_148048
atggctcccttgcaaactgcactgttgctcatggttgcagctgaggattatcaagatcttccaacttgttgtacctctgtgggtggaggaaaggaaggagagggcgggatactcagagtccgagagggaacaggagagagaggaggagggggtcacggtggagttgtccacgatgtaaacggtgatggtggttttgttgttgatttcgagagacaggataccacactttctctgcctccttcattctctcactattctgtctcttgcaccagcttctctcaccattctcgttctgatcttcttcctctgcttctgcaagaagcggaacctggcggcgaaacagagctcagggagcatccctctggtgtccaaggagatcaccatggtcaaggcctcagatccgaagaagatggaggaggcggagggtggggctgctggtacaccatttgggatgtggaactcgccacgcgcgagtttgtggaagggaatgttattggggaaggaggctatgccgttgtgtatagaggtgttttgcacgatgcttctgtcgtgaatattctcaacaacaaagagattgagatggcttcgacgaagaagatcacactgaagagttcggacggcgagaccttcgaggtggaggaggcggtggcggtggcggtggagtcccagacgatcaagctcatgatcgaggacaactgcgccgacagcggaattcctctccccaatgttaccagcaagattctggccaaggttatcgactattgcaagaagcacgttgaggccaattgcgctgatgagaagcccagtgaggatgaactcaaggcttgggacgctgatttcgtcaaggttgatcaggccaccctctttgatctcattctggaaccagatttttacactgtgcttgtggaaccgcaagaatcatttgggataaatgaggccccagtgtga

SEQ ID NO: 56364 - DNA, 336 bp, Glycine max
  Peptide Sequence Number=SeqID_148049
atgaattggtcaacttcagaaaccgaaaaaggcatgtttgatgctattttggaaggaatgttagatatggacaacgagccatggccctctatttcagaatctgcaaaagatttggttagaaaaatgctgacttgtgaccctaaggaatgcattacaactgctgatgcccttggtggtgaagcatcagacaagcatccagacagtgctgttttaattaggatgaaatggtttagagcaatgaaccagatgaagaagcttgctttgaagggtagtagcagaaaatctttcaaaggaagaaacaaagggcctgagacatatgttcaacttcatctatag

SEQ ID NO: 56365 - DNA, 2148 bp, Glycine max
  Peptide Sequence Number=SeqID_148050
atgggactggggatgtttaaggcattgttttgctgcagcaagccccatgaaattgacattgcagactcctgggactcatctcctgatcatacccccaaacaacattctaaaccaaagccaaagccaaatgctgcacctactcattccaataataaacaaaccaccacatctacacaaataggagcaattctagggaaaccatacgtgaacatacaccaaatgtacgagatgaagaaggaactgggaagcgggcagtctggtgtaacatatctgtgtgtggagaagacgacgaagcgagagtatgcatgcaaatccatctctcggtcgaagctgctgagcacgcaggagattgaggatgtgagaagagaggttatgattctgcagcatctttcggggcagcccaacatagtggagttcagaggggcttatgaggacaagcagaacgtgcatctggtgatggagctgtgcagtgggggcgaactcttcgaccgcatcattgccaaagggaactactccgagcgtgaagctgccactgtcatgaggcagattgtcaatgtggttcacgtctgccatttcatgggcgtcatgcatcgagacctcaagcccgagaatttcttgttggccaccaaccaccccgatgcagccgtaaaagccactgattttggactctccatttttattgaggaagactcaaggagaacacaacaacctcaacttcaacctcaacctggttaccccaatcgaactccaaaatcagacccatctccatcatcatcatcatttggtgatcaagtagcagcacgaatattagacaaaccatactttgacatcaaatctctttacaacctcgagagggaactcgggaggggtcaattcgggatcactcgtctttgcaccgagaagaccacgggaaggaaatacgcttgcaagtccattccaaagcggaagctaagtaaaaaaaagcatactgatgatgtcaagagggaagttctcatccttcagcacctctcgggacagcccaacatcgttgagttcaagggtgcttatgaggattggcaacacgtgcatttggtgatggagttgtgtttgggtggtgagctcttcgaccgcatcactgcaaagggtagttactccgagagtgaagctgcttctatattcagacaaattgttaatgtggttcatgcttgtcattttatgggggtcatgcatagggaccttaagcctgaaaatttcttgcttgctaataaggatcctaaggcacctctcaaagccaccgattttggattgtccgtcttcattgaagaagaaattgttggaagtgcatactatgtagctccggaggtgttaaagcgaaattatggaaaggagatagatgtgtggagcgcaggaatcattttatacatccttctaagtggggtgcctccattttggggcggcaagcttgatctggagagcgcaccatggccttcaatttcagctgctgcaaaagatttgatcaggaaaatgttgaataatgaccctaagaaacgcattacagctgccgaagcccttgaacacccgtggatgaaggaaggtggtgaagcatctgacaagcctttagacaatgctgttttgactagaatgaaacagttcagagcaatgaacaagatgaagaaacttgctttaaaggttatagcagaaaacctttcagaggaagaaataaagggtttgaaacaaatgttcaacaatatggatactgatcgcagtggcacaatcacattcgaggaactcaaatctggattgaccaaattgggatccaagcttagtgaatcagaaataaagcagctaatggacgctgctgatgttgacaaaagtggtactattgactatcaagaattcatcactgccaccattaaccggcataaactagagaaggaagagaatttgtttaaggcttttcaatactttgacaaggatagcagtggatatataacaagagatgagcttagacaagctttgactgagtatcaaatgggagatgaagcgactatagatgaagtcatcgacgatgttgacactgataacgacgggaaaattaattaccaggagtttgtggctatgatgagaaaggggatcctggatattgatgagaaagagaaaccacaataa

SEQ ID NO: 56366 - DNA, 822 bp, Glycine max
  Peptide Sequence Number=SeqID_148051
atgaaaaaaggaactagcgttggggcaccttgtctgcttgaaaataccttagctgaaatggtcatctctgcagttcccagcatagaaatgatccggtctgttaattcaggcacagaagcatgcatgggggcgctccgtctggcacgtgcttttacagggaagcagaagatcatcaagtttgaggggtgttcccatgccatgctgatccttttcttgttaagacagcttacatccaacaccctcactgccctcttcaacgatattttagccattgagaagctttttgaaaatcacaagggagagattgcagcactcatccttgaacctgctgtaggaaactcaggtttcattgttcctaaacttgagtttcttgataccatacgtaaaatcatcaaggagaacaatgcacttctcatctttgatgaagttatgaccggattccagttgtcatatggaggagctcaagagtattttggcattgttcctgacttgaaaacattaggaaatataattgttagcggtcttccggctgacactttgagtgggaaccccttggctatggctgcaggaatagaggctcagaagcttattaaggaagcaggaacttatgagtacttagatgaagtcacaggagaacttgttcaagggattcttcaaagtgacttggccaagtttgctagtttctaccggggaatgttggagcaaggtgtatattttgcatcttcacaatttgaggctgggttcaccagtttggcacatactactgaagacatcaaaatgacaatagcagctgctgagagggttttgcggcagataggatag

SEQ ID NO: 56367 - DNA, 423 bp, Glycine max
  Peptide Sequence Number=SeqID_148052
atggaggctggtgcaacccaccactcaagcattttgatatggcccaacccgcttgggaaaagattggtatttacagaggagggatcgtccccgtgctattccaaaggtttgaacatggttccatgcaaaaagcatgggggggttaggttcagtgtgaatgggagggactacttcgagctagtgttgatcagcaatgtgggtggtgctggatccatccaatctgtgtccattaaaggctcaaaaactggatggatggctatgtctcgaaattggggttctaattggcaatccaatgcgtatttgaatggtcaatctttgtccttcagggtcaccaccactgacggagaaaccagagttttccaagatattgttccagcaagttggacattcggccaaactttctctagcccagttcagttctaa

SEQ ID NO: 56368 - DNA, 951 bp, Glycine max
  Peptide Sequence Number=SeqID_148053
atggcaactattgctacagttatgcttataactatgtccctggcttctcttgtgagtgcactaaatgtaaattactatgaaaatgcgtgcccccataatgtagattccattgtagctgctgctgttcacaaagcaaccatgaatgacaaaactgtcccagctgctcttcttcggatgcattttcatgattgcttcataaggggttgtgatgcctctgttcttctcgaatcaaaaggtaagaaaaaagcagaaaaggatggacctcctaacatttctttacatgcattctatgtcattgacaacgctaagaaagcagtggaagccgtttgccccggggtagtatcttgtgctgatattttggctcttgctgctagggatgctgttgctctgtcgggaggacccacttgggatgtgccaaaaggaagaaaggatggaaggatatcaaaggccacagaaaccagacaattgccggctcccaccttcaacatctcccaattacaacaaagcttctcccaaagaggcctttccttggaagatcttgtagccctctcaggaggtcacaccctggggtttgctcattgttcatctttccaaaacagaatccataagttcagccagaaactagagattgacccatctctgaacccttcattcgcaagaagcctccgaggcatatgcccctctcacaacaaggttaaaaatgcaggaagctcattggattctagttccaccttgtttgacaatgcttattacaagctactcctccaaggaaagagcttattctcctctgatcaagctctgctcactcatcccaccactaaagctttggtttccaactttgctgattcgcaagaggaatttgaaagggccttcgtcaagtccatgatcaagatgagcagcatcaccaacggtggacaagaaatcaggctcaattgtaaactcgttagatga

SEQ ID NO: 56369 - DNA, 1026 bp, Glycine max
  Peptide Sequence Number=SeqID_148054
atggctgttaacggaacaattccagcattgttttcatttggagactcaatccttgatacaggaaataataacaaccttcagacattaaccaagtgcaattttcctccatatggaattgatttccaaggaggaatacctacaggaagatgctgcaatggaaaaactcccacagatttgatagcgacggctttgggtataaaagaaacagtggcagcatatcttagtgggaacttgagccctcaagacctcgtcaccggggtatgctttgcttctgctggttcaggaattgatgatctcactgctcaaatacagggagttctttcactgccaacacaactgggaatgtttcgagaatacataggaaagctgacagcacttgttggacaacaacgagccgctaacatcatatccaacagtgtgtatcttgtttctgccggcaacaatgacattgccattacctattctcagatattagccacaacacagcctttccccttatatgccacacgtttaattgacaccacttcaaatttcctcaagagtctatatgaacttggagcaagacgagtgtgggtactaagtacattgccacttggatgcttgcctggaggtagaactgtggcagggggaccattaaggatttgtgcaccctttgcgaatctatttgcgcagacattcaatggccaattatcatcagcagttaattctatcagaaccacccttcccaattatgacattaggttcatcgatgtctatactcctctctttaatctcataaataatcctcagccagaagggtttgtagatgtctcagaagggtgttgtgggactgcgccatttggagtttcaggaatatgtagccttttcagcttgtgcccaaatccttcctcatacgttttctgggattctgcccatccaactgagagagcttataagtttgttgtgtctactatactacaatcacatactaataatgtttcgagctcttttgcttttgctccatttaattcttcactctcaaattaa

SEQ ID NO: 56370 - DNA, 435 bp, Glycine max
  Peptide Sequence Number=SeqID_148055
atgaagcttttattgaagctatgtttggagcaaattactaaaggggaacgccttggttctagctttactaaggatgagacaatatcaggaacactattgatgcaccaaatgaatggtgggagaccaaacaactggtacaagggacttccaattgctcatcaactaactatactttttaaggatgtagtgactaccagagattttatgtgggcaccatcatcagggatattgccaagtacacttggtggtgatgttaatgatgtgtatcgcccatatcttgatggtattaacataaatatgggagaaggatcaagagacagtgatgatgttagtgtaggagtaacaaatgaatttggagacattaatataaatgcttcacaagtaactggtagtcaagcaattggtagccaaaagagtggagagaagtgcaagtga

SEQ ID NO: 56371 - DNA, 1473 bp, Glycine max
  Peptide Sequence Number=SeqID_148056
atggagaaagcagagaaggaccggagggagaagaaggagaagaaaagggaaaagaaagagaggaaaagagagaagaaggagaagaaagagagaaggaaagcggagaaagaaaggaaacttaaagacggagcaagtgcctgccctggcactgatgatggcaaaaagtttaagctcatcaacgaactaaaggaaaccaaagcagatggaaaattgcaaaagggtgaagacagtgagaatgaacaacatgagaggagtggaattacagaggaacttgacctacctgtcacttctgtggagccttgctgcctttctgactgtactcaaagcagtaagagaaaaaggagctccccagaatcaactcatgatcatggtgaggaaggatctgctattaaaattcgacttccgttgaggaagcatagagaacctgaagaattgaaatccaaatcaaaatttcaagcggggtgttcttctggaagtgtgggggaaactgcaaattccttcactaaaactacacttggaagtgatcgtcagtcacaatgtctcaggattacagagctgaatcgggtacttggaaactctgattcaagacatggcaaagcaatgcagaattcagttcatggagatgttgtggtcactaagaataccattggaagtaatcgtcagtcacaatgtcacaggactacagagcccaaacatgttattggaaactccggcaaagtgatgcagaattcagttcatggagatgctgcggtcattaagaataccattggaagtgatcgtcagtcacaatgtctcaggaccacagagcccaaacgggttcttggaaactctggcaaagtgatgcagaattcagttcatggagatgctgcggtcattaagaattccattggaagtgattgtcagtcacaatgtctcgggaccacagtgcccaaacgggttcttgggaactctgtcaaagcgatgcaggcagttcatggagatgctgtggtcactaaaaagaaccttggaagtgatcaatacctcagggttacagaaccgaaacgggttcttggaaattctgattctagaaatggcaaagcaaagcagaatccagttcatggagatgccgttgtcactaaaaatacctttggaagtgatcatcagttgaaaagtctcgagattacagagcccaaacggattcttggaaactctgattctaaacattgcaaagcgttgcagaatttggttcctggaagtcaaaaagttgaatctttgtacgaatctttgttacagattccaccactaacgtatgatggattggactcggtatatgatgattggttatttagttctgaaccgaaagagtcaaggcccgtctcgaagaaacagaagtgtgattctgatgtctttcagctttcaaattctatgtggcctcgtgcacaatacttgcctgaggtcgaagtatatgcgttgccatacgcagttccgttttga

SEQ ID NO: 56372 - DNA, 2664 bp, Glycine max
  Peptide Sequence Number=SeqID_148057
atgaggaagtggacggttgcttccgctctccttcttctctctctcctctttctctttgcagatcaaggtatgccacttcacaattcactcttcttttacacattacgcatgttgttgttcgaattcctttacgcacccgcgtttggttttctaggtcgaaagtttcaggcgaatgccgagggagattccgacgagcttgtagatccacccaaggtggaggacaagatcggtgctgtgcctcatggcctttcaaccgattcagatgtcgtcaagagggaggcggagtcgatctcgaagagatctctccggagcaacgcggagaagtttgagttccaagcggaagtgtcgcggcttatggatatcatcatcaattctctctacagtaacaaggatatcttcctcagagagttgatttccaatgcttctgatgctttggacaagattaggttcctctccctcacggataaggaggtgttgggagaaggtgataacaccaagcttgatattcagattaagttggacaaggaaaagaaaattctctcaattcgagacagaggtatcggtatgacgaaggaggatttgataaagaatttggggacaatagcgaaatctggaacttctgcatttgttgagaagatgcaaacaagtggagatctcaatctgattgggcagtttggagtcggcttctactctgtttatcttgtggccgactatgtcgaagttattagcaagaataacgatgataagcagtatgtatgggaatcaaaagctgatggagcattcgctatttcagaagatacatggaatgaaccacttggacgaggaactgagattagattacacctcaaggaagaggctggggaatacttggaggagtctaaactgaaatctccttcacatagtttacacttaggggtcatttactttgaagtttacttaatctatggtcatgcttgtatctgttactttattttgacaagtgttcacagatgctatgttattgattttcaacgggaattggtgaagagatactctgaatttattaacttccctatctatatttgggcaagcaaagaagttgatgtggaggttcccgctgatgaagatgattccagtgatgaagaggattcatctgaaagcagctccaaggaggaaagcgaagatgaagatgctgataaaagtgaagatgaagaaaaaaagcctaagacaaagacagtgaaggaaacaacttatgagtgggaacttttaaatgatgtgaaagctatatggctgaggaatccaaaagaggttacagaagaagaatacaccaaattctaccactctcttgccaaggatttcagtgatgagaaacctttagcatggagtcatttcactgctgagggtgatgttgagttcaaggcagtcctgtttgtaccacctaaggcacctcaagatttatatgagagctattataacgcaaacaaatcgaacctgaagttgtatgttagacgtgtgttcatttcagatgaatttaatgaactgttgcccaagtacctaaactttttgctgggtcttgttgattctgacactttgccacttaatgtatcacgagaaatgcttcaacaacatagtagtctgaagacaatcaagaagaaacttattaggaaagcccttgatatgatccgcaggattgctgatgaggatcctgacgagtcaactgacaaagaaaagaaagaagatgcatcctctgacaatgatgagaagaaaggtcaatattctaagttctggaatgagtttggtaaatccattaaacttggtatcatcgaggatgccaccaacagaaatcgtttggcaaaactgctcagatttgagagcaccaagtctgagggtaaattgacatctctggatcagtacatatctagaatgaaaactgggcagaaggatatcttttacataactggaaccagcaaagaacaactggaaaactctcccttccttgagcggcttaagaagaaaaattttgaggttattttcttcacggatccagttgatgagtacttgatgcaatacctgatggattatgaagacaagaagttccaaaatgtgtccaaggagggtttgaaacttgggaaagattcaaaagacaaggaactgaaggaatcttttaaggatcttaccaagtggtggaaaactgctctttccaaagacaatgttgatgatgtgaagatttccaaccgattagataacactccttgtgtagtggtgacatcaaaatttggttggagtgctaacatggagagaatcatgcagtctcaaactttgtcagatgctagcaagcaagcatacatgcgcggcaagagggttcttgagatcaatcctaggcaccctattatcaaggagctccgagagagagtagtaaagaaccctgaggatgagggtgtgaagcatacagcacagctgatgtaccagactgcactctttgaaagcggcttcctgcttgatgatcccaaggattttgcttcccggatttatgattcagtgaagactagcctggacatcagtcctgaagcaacagttgaggaggaagatgacactgaagtagaggctgaaagtgacgcgaaagaagattcaaagcctgaaactgatgctgttaacgatgataatgatgtcaaggacgagttgtag

SEQ ID NO: 56373 - DNA, 378 bp, Glycine max
  Peptide Sequence Number=SeqID_148058
atggctgtgtctgatgctgtgatgagtaacctaacggtgctctatgtggcggtgatcgcgtgtattaaggcctacggcttcctgtgcggacgcagcttcagcggctggtttgtgctcgttgtgtccaccgccgcggtggcgctgattctcgttgccacgctcacgtgggacgtgtctcgcaaggccacgtatgcattcgccaccgatcagcctcctccgccgccgcaccacacccacgaagcgtgtaaaggaggcatctgctggcacggcgtggcggtgcgatcgccggcgtcgcagctagcacagaggtctaatgtggcttttggttttagcttgttaggtgttgaattggtccattccaaaagggaacatgtttga

SEQ ID NO: 56374 - DNA, 957 bp, Glycine max
  Peptide Sequence Number=SeqID_148059
atggacatgaaagaaacattgaagttgaacgttagcttggtcagtgtgctgtctccaccacaaagggtaatttcaacaacattcactctagttaacaaatgtgactacaccgtgtggccgggaattctttccaatgcgggtgttcctcctctttcaaccaccggcttggttctccaaaccggcgcctccaccacaatcgccgcacccgcgtcttggggtggccgtttctggggcagaacactctgctccgaagactccaccggcaaattctcctgcgtcaccggcgactgcggctccggcaagctcgagtgctccggaaacggcgccgcgcctcctgccaccctcgccgagttcaccctcgacggagccggaggcctcgacttcttcgacgtgagtttagtcgacggctacaacgtgccgatgctggtggtgccgcagggtggctccggcgagaagtgcaccgcgacggggtgcgtgggagatctgaacggcgcgtgtccttcggagcttaaagtgatgggcgcggatgggagagagggcgtggtggcgtgcaagagcgcctgcgaggcgttcaactcgccgcagtattgctgcagcggcgcgtacggcacgcccgacacgtgcaagccatcggcttactcagcgatattcaagagcgcttgcccacgcgcttatagctacgcgtacgacgacaagaccagcaccttcacttgcgcttccgcggattataccataaccttttgcccttcccctaccaccagtcagaaggcatcacaggggcaagatggttcttcaacctctccctttcttaacaacaacagcacaatggtgtatgaaggtgcatttgatcagagtgaaatgtcgtgggccacgtgcagacacgtgttccaatcccaagccattgccggcattgtcagtatcacgatggctatgtggcggttgtgccagctcttctaa

SEQ ID NO: 56375 - DNA, 1779 bp, Glycine max
  Peptide Sequence Number=SeqID_148060
atggggtctgtttgctcggctgagaaaaataaaaacaaagaggttggagggaaaaccttggggaagaagcttaagaagttaaaaagcattgcaaagggaaaaggagattgttattcaaattcaaggactagtgatcgtggtagaaagcaaaaggagcgaaactctggattttccagtgaattcaacttatccaatcctagtcgaaaagaaggaaaagaggacttccagagaggctccttttggggaagagctagtgagagggcagtagaagttctcgacacacttggaagtagcgtgccgaagttaagcaatagtaatgggtttgggtttggctctggcatggctcctagagggaatagaatatctatattggcatttgaagtagctaatacaataaacaaaggagcaatcttgtttcaatcactgtctgaagaaaacattcagttccttaagaaggagattttacaatcagaaggggtgctacaattagtttcaactgatacaaaggagttaataggtcttgttgaaactgacaaaagggaagaattcaatgtcttctcccgggaagtagttagatttggaaatttatgtaaggaccctcagtggcatagcctagaacaatatttctcaagattacatttggatatctgggacaacatgcaaccaacggtagaggcagaaatgacaatgcaagaattgaccactatagctcagaatactgctgaactatatcacgagctaacttcgttagaacattttgaacaagattatcagcacaagcttaaggaaatggaatccttaaatcttcctctcaacggggacagtctcacagcttttcagattgaaataaagcatcaaaggaagcttgtgaggagcttgaaaaagaaatctctttggtccagaaatttggaggagattgttgagaagcttgttgagatcgtaacccatatagatcaagcaattttggagttcctcagaaatcatggtgcaaccgctgtcaagcattgtaatggttctgaaagacttggtgaagctggtctctcactgcactatgctaacattatcaatcagataagcatgattgcatctcgcccaaccgttcttcccccaaatttaagagacacattgtatcatggattgccaaattatatcaagagtgctcttccttcacggttacaaaacattgatgctatgaaagagctctccatcactcaggtcaaagctgaaatggacaagactctgcagtggctcactccatttgccacaaatacaatcaaagcacatcaaggttttggatgggttggtgaatgggcaaatacaagtaacgagtttggcgaaaacacaaccaaagaaagtaacctgattcgcctccaaacactttactatgctgagaagcataaaatagatttttacatcatcgaattgttgactcagattcactatttggttacctttgtaagatacagacataataccatgaagccaatgcccaaaagaacttctcctaggcgacttgattttcaatcaaagtttatatctatagacagtattaacaagcctttgggatctaaactttctcaagaggataaaagattattagaagaggtaactatgaggagaagaagcccaggagttagcaaaagcgaggatcttgcagtgaccaagaaaagaagtgccaaagtttggcatcatagcaatagtgtaggaagttcacctgtcacacgagaagggttggaccaccaaagatctaatgttttggatattatagatgggctataa

SEQ ID NO: 56376 - DNA, 300 bp, Glycine max
  Peptide Sequence Number=SeqID_148061
atggggttacttgcaaaaattagggttagacgaatgaggtttcagaccaaagaagaaaaggttcaagcagctaatgactcattgagtgaggcagatccgcttagcgagtggcatccatttagcaaggcatccagctcgcttagtggatgggaaactctagaaaacaaagagtcagagatctacgcactcagcaggcagctaacccgcccagcgaggacgttgtctcttctagcgctcaccgcgccctatctcgctatgccaaaattcactaacttgcgcttagtgagccctgctcgctaa

SEQ ID NO: 56377 - DNA, 330 bp, Glycine max
  Peptide Sequence Number=SeqID_148062
atgagaaaaaagacggataataaggaagagaaaaagactaagagtgagttggccagagagaaaaataaggaggctattcccagtacagggaagtatgatgagtaccaaaaggagcttgagaggaggaggtggcataaggccttgaccaggcagcctgataaccacatagatatggccttggtcaaggagttctatgtgaatttatatgatcctgaagacaagtcccctaggcaagtgcggggaaaattgattaagtttgatgttaagacgcttaacacattcctggagacccccgtggttttggagctaggggagaagtattcagcttag

SEQ ID NO: 56378 - DNA, 399 bp, Glycine max
  Peptide Sequence Number=SeqID_148063
atgtcaaggcttgatacgggtggagtgacaaaagctttagttcactggttcaagttgggcacgctatgcttccaaaggaaaacactttgcctaaaagttactatcaggcgaagaagatattgtgtccgatgggtatggagtatcagaagattcatgcttgccctaatgattgcatattatagagacatgaatttcaagaaatgccaaaatgccctaggtgtggggtatcactgtacaaagtcaaggatgatgacgagtgtagtagtgacgacactcaaagaagggccccccagtgaaggtgttatgatgactcaaaggaccttacatggcatgcaaatgggagaaactgcgatggaatgctccgtcatccggtcgattcctcccagtggaagaacatag

SEQ ID NO: 56379 - DNA, 408 bp, Glycine max
  Peptide Sequence Number=SeqID_148064
atggctacaccacccagctctcctcctcctcctcctcctactggtgcagcatcacagttgccatctaccttgaagtgcataagaaacaccacacggctaagatcattggtgactagatcagttagggcagagaggccactgctccatgttgatccttcgaccgggaaggtcgacagtcctcacagtaagaagttaagaacatatttggggatcatcgctcgtgataaggtcaatgtcacatatgagaattggaagcaagtccctgctgctcagaaggatttgatatgggaggatattcaggctgaatttgatatccctgaagcatcttatcagaggacaaagaagaaaatacttcagactatgggggagcggtggagacaattcaagtctgatttggcattgaaatag

SEQ ID NO: 56380 - DNA, 258 bp, Glycine max
  Peptide Sequence Number=SeqID_148065
atgttcaagaaggaatcaagaacaattcaagattcaagaggaaagttgaattcaagaatcaagattcaaggatcaagcttcaagatcaagattcaagattcaaggttcaagaactcaagagaagacttaatcaagataagtatgaaaaggatttttcaaaaactgagtagcacatggatttttctcaaaacatgtttaccaaagagtttttactctctggtaatcgattaccagattgttgtaatcgattaccagtag

SEQ ID NO: 56381 - DNA, 525 bp, Glycine max
  Peptide Sequence Number=SeqID_148066
atggtcaacattccctctgacataacaaacagaaaaagtgatgattatcaaagagtgtttgtcagaggaaagtgtgttagattctcccctgctgtgatcaacaaatacctgggcagaccaacagatggagtggtggatattactgtctctgagcatcaaattgccaaggaaatcactgccaaacaagtccagcattggccaaagaaagggaagctgtctgcagggaagctaagtgtgaaatatgcaatcctgcacaggattggagctgcaaactgggtacccccaatcatcacttccactgttgcacagctgatagaagatgctgcagtgaactgcttcacagcagtaagagccgatgaagacagggggagcaaaaagctgatgtcacgtaagatgattcctgacatcctggaaacgacttgcaacttgtctaaactacagattccgctgtgcttgatgactctgataatggaagttgctgatcccacttgcataactgctcgtacctgctcaggaagtgtctaa

SEQ ID NO: 56382 - DNA, 372 bp, Glycine max
  Peptide Sequence Number=SeqID_148067
atgtcagttctggaattgtacacagaaaaggatgtggctggtggttctatgtttcattctgcaaattctcttacatcatgtgaaaataatttatctaataatgaggcgcaatcgccaagaaatgtgagcaatttacatggtgatgaagatgatgatgatgatgatcttgtgtctaactcatacgttgaagagtctttagacgaagatgatagtgttgacggtatatctgatacagacgatgaagtcaccgacatgattcaaccagtgtacaaggaattcaaaattcattttggaatgatgctttgcattataacaatatcaattgaagtcatcctaatgaggaggacatttgtggtttggagatgtcattga

SEQ ID NO: 56383 - DNA, 393 bp, Glycine max
  Peptide Sequence Number=SeqID_148068
atgccactgaaagactctactgagacaaagacgggctgtcaagaacgtagaggaggtaggatgggcagttggtcagatctaggtttcctcatttgggatcctggggaagaggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccagggtcgcggaccgaccatagaaccctgttcaaaaagcgacgcattagctatccgctctcaggttggacactctccgttcccggttctcctgtagctggatcctccggaaccacaagaatccttagttag

SEQ ID NO: 56384 - DNA, 627 bp, Glycine max
  Peptide Sequence Number=SeqID_148069
atggtggttcgtgccttcgacgacacccgccgagagctgtctgtggatccaatcagtgggagttgttccctctacactccaccaaaagttgaaattcatagtggaagggcatctggtcatcgtatcaggcgaggaagacatcttggtgagcttcccgtcctctatgccttatgtggaggccacataggagtcattagaaaccgcttttcagtctttcgaggtgcaataatgatggcccgagttatgttggggagcggttacgaacccggaatgggtttaggcaaagacaacggcggcataactagcctgataaatgccaaaggaaaccgtgggaagtatgggttaggctataagcccactcaggcaaatataaagaggagcgttgccggaaggaagagcggaagtcaaggctcgcggttgagacaagaaggtgaaggaaacccaccctgccaaataagtaagagctttataagcgcgggtctgggggacgaaggtcaagtcgtcactatatatgaagatgatgttccgagtacgctggatttggtacgaccatgccctcctgatttccaactgggaaattggcgagtggaggaacgccccgacatttacgcgacgagcataatgtaa

SEQ ID NO: 56385 - DNA, 55 bp, Glycine max
  Peptide Sequence Number=SeqID_148070
atggtttttatcaaatcttctttgaggatactggagaagatgatagagaaaggag

SEQ ID NO: 56386 - DNA, 144 bp, Glycine max
  Peptide Sequence Number=SeqID_148071
atgggtagaaatgtctccgcattgattggtaaatctgttccccaaatccctgaaaaatgtaaagatctaggtccagggattattctcacaggatcagttcccatcattctaggacagaccttttactgctcaaaatctgtctag

SEQ ID NO: 56387 - DNA, 564 bp, Glycine max
  Peptide Sequence Number=SeqID_148072
atggctcacaaattctgttttgaggcacttgatcacagtcgtagagatatcatcaaacacaactcaaaggacaataaaatctttggaggtaaagtcatggtctttggtggagatttccggcagatcctgccagccattccaagaggcagccgctctgatattgttaacgcaacaattgattcctcttatctatgggttcactgtcaaatcttgagactgacaaaaaacatgtgtttacaaaacaacatggaagcaacagatcaagaagaaattgcagcttttgcacaatggattatagatattggtgatggtattattggagatgaaaatgatggctatgctactattgaaattccacaggaactattaatcacagaatataatgatcctattcatagtataattagctctacatttccagatctatcttgtcatcacaatgatcctgaatacttccaaaccagagcaatattagcttccacaaatgaaacagtgcaacgagttaatgattatatgcttacaatgataccgggtaatcatatagtgaacaaatggaatatctaa

SEQ ID NO: 56388 - DNA, 246 bp, Glycine max
  Peptide Sequence Number=SeqID_148073
atgggacatcctaatcagggtattggatgcacaagctttcgtaggagaaatcaggtgcaaccattccccttagagtcctatcacggggtggaggttgtgccatgttctcagaatgttcaaaatcagaatgttcaaaactataatgctcaaaatcaggatgttcaaaattaccaaccacaaaatgctccgaatgctcaggatgctcaaaaggatcaaagggttgtaagtcagatggattgcccctag

SEQ ID NO: 56389 - DNA, 480 bp, Glycine max
  Peptide Sequence Number=SeqID_148074
atgacattgctacttagcaacattctgcccagcgaccgcattgccaatctccccctgcaaaagtatcagttggtctgtgtcgtcccgacatggggatcgcacccacaaagacacccagtggacctgaagaagtccaacagggccctggggtttccagctctggttacgggcctctatcggccctatagggcgctcgtccccccagcaagctcatgccatcatgacataggtaaggattgtgcccgcaagacacctagtggacccgaagaaggccaacagtgtcttggagttgccagctctaaatacgggtctctatcagttcaagggagtgcctgttgcccccagcagggtcatcaggcccccctaccaatcgagttttcatctagaagtgctgcgtctccaggcaggcgcagggcgaaacaccacagcagcctggggatggccggcagcgggcaacagacgcaccgccatcacctctag

SEQ ID NO: 56390 - DNA, 609 bp, Glycine max
  Peptide Sequence Number=SeqID_148075
atgttaaccaacatatcaattttactcccaacaccagaacagaacgtaaacaatggtcagacacttataagtgataacaaatcgactaagaagacagttgaaaacaatggctcggtgacccaagaaactattttcaatttttttcttcctatacaaacagtacctgcagatccaaatagcaatagggtttatgattccgagaaaaattccattgatgagctgaagaagttcctgaaagaggaattaaaggatgaggaggtttccatctggggcgtccctctcttgaaggatgacaggactgacgtcattctcctcaagtttgttaaagcgcgggagctccaaacactctccgatggaggaaggacttcaacatcaacgcccttctggatgaagatctgggcgacgacttggagaaggtggtgttcatgcacgtacacgacagagagggccatcctgtctgttacaacgtctatggcgagttttagaacaaggacctctatcacaaggccttgtgctctcaggataattgaaacaagtttcttcgatggcgtattcagttgttggagcgcagtattcggcacctcgaggataatgaagaagaagctatag

SEQ ID NO: 56391 - DNA, 696 bp, Glycine max
  misc_feature (14)..(14): n is a, c, g, or t
  Peptide Sequence Number=SeqID_148076
gggcgtccattagntgggttcccatggtggaaagaaggaggggcaggagtgctatgcttatgtgaaggatttccaaatatccctttgataggaacgagaggttgtattaatgataatctcgtgttggccataagacagttgggttaccctatgagaggtgcgccatcggaggagaccatcgtgcctttcatcgcgcgaggtttcaatgaagctaatacaaagacacttcagaagatccggataacttggctcccaaagctaaaaagtctgagtggggaagagattgaaatgcctgaagagagtgaagaggtgcaagctttgaaagctgagctcgaaaagacaagagtggtgaatgagaagctgaaggtggcagtcattagggttaggaaagaatgtgatgagctgaaagatatcaacatgagcgcggctgaagcgctagagcgggaaatgaagaaggccagaaaggaagagtggagtagaaacaagtttcgaggggctttgctaggaagtagtaatgagctcaaacttagaaagatcgagagggataaatcaaggatggaaagcctgatgttagaggataagttaaagagttgtcagaggtcgaagagaaatgctggaagacaaataggcaaaggtgtcagccttgcggaatcaagagcttccaaggttgttagccagagccaaggcgatggctga

SEQ ID NO: 56392 - DNA, 272 bp, Glycine max
  Peptide Sequence Number=SeqID_148077
gagacttatcaaggtaatccttgtggcgtctacccagacttatcttccttcattggaagtggcgtctacccagacttatcttccttaaccggaagtggcgtctaccctgacttatcttccttcactggaagtggcgtctaccctgacttatcttccttctccggaagtggcgtctaccatgacttatcttccttcaccggaagtggcgtctaccctgacttatcttccttcactggaagtggcgtcatccaaatcttcgtagcctgtatcaa

SEQ ID NO: 56393 - DNA, 435 bp, Glycine max
  Peptide Sequence Number=SeqID_148078
atggaactccaacgactaaatcaaaatgaagaaactgacaagaggaaacgaagcatagcactcaaagcctcctcctcaatacaagaggaagaagaagatgaagaagacttctcactctttgtgaagaagtttcacaaatttgtcaagaagagaagaatcgagaggcgtcaaaatttcaaccatggaaaaagattccaagaagattctccaactattagatgctacaagtgcaaccaacttggtcacatcaaagcaaatttcccctcaaacgagcaatggcctaagaagaatgagaagaaaagtcatgaagaaagaagatccaagaaggcgtatattgcatgggatgacaatgactcatccgatggttcggagaaggagattaaccttctatccaaggactatgagagcgatgagaacatctctcaagaagactaa

SEQ ID NO: 56394 - DNA, 593 bp, Glycine max
  Peptide Sequence Number=SeqID_148079
atggaagcagcggaggaatcattggaaacaactttccaatccttcgaggtggtgagttgtgcctctgtggaaacgagtccgttgctgccttgtctctctaatgcggccctaatggtggcatgggtgatgctcaggcacggttatgagcccggaatgggtatgggcaaggacagccacgggaatgccgatgtggtcgacattagggggaacccgtacaaatatgggttggggtatgaacccggaaaaccgggaagaaggaatgtgccgtcaagactccgggcagatagggcatggcccggctatgttagccagtgtttcacaagtgccgggatgatgttcgaggaagaggtggcggcaataggagaggagtctccacaagatccgccaagtttcgtgcgaccatgccatcccaattcccaagtgggaaactggcgcgtgatgagccagtcggaagtctataccactgattcaatatatgagggtcgattctttgaggatcctaacgagggtttgataatcgattttgaccgagaagtaagtcaaacaataaacgaagaagaggaagatgaggtcctttcaccagagtcggagag

SEQ ID NO: 56395 - DNA, 144 bp, Glycine max
  Peptide Sequence Number=SeqID_148080
atgtggaccaccacgggggaggagcttaccacccagctcgcccaggcgagcaaggttgcttcctccagaagcaacagccttcaggaggaaggatctggaaggcccaagtgggctagattgctatttgtaccccctctttactaa

SEQ ID NO: 56396 - DNA, 322 bp, Glycine max
  Peptide Sequence Number=SeqID_148081
cctggacatctgagggttgattgcccaatattcaagaaaagaatagagaaatctaaaaagaaagtctttaatgaaaagaagactaagaaggcctacattacatgggatgacaatgatatggacttatctgaagattcagaaaacgaagttgtaaacctgagtctgatggccaagaattatgaaagcgatgaagaggattccttgaagaagagttggtacatagatagcggatgctctaaacatatgacgggagatgcatcgaaattcactcatatttctcccaagaaaagcggacatatgacttatggcaacaataataaag

SEQ ID NO: 56397 - DNA, 351 bp, Glycine max
  Peptide Sequence Number=SeqID_148082
atggcgacttaccttctcaatattcttcctcataagttattgacctataaatctcctcttagggttctttatcataaggatctgacctattctcatcttcggacttatgatttcttagatgatggcccaaacccatacgtggtccaccatttagtgtctcaatccactactcctaatgctcaaactcttggtctagttccattcgggcccaactcctctaatattgcaaccggcccaaccattgagccaaagaagaatattgttaattgtatgaattattcagcgactgcttctcctcctcttagtccagcccacctcctcgggctgttacacgcagccagcatgggatag

SEQ ID NO: 56398 - DNA, 765 bp, Glycine max
  Peptide Sequence Number=SeqID_148083
atgaggggagcgccaatcgaagaaagtctctcgccttgccttgtgagggatctaggcgcgcaaggtctcaaggttatacaaagaatccacaaggcgtggaggaatccattgaagaaagacaaggagcttaggggcatccgaaatggcgtcattggaggttatcatggatggctaagaattcatgcgcgagggttagattggctctccaaattgaaagttatcgatgaggagaatttcgaagcttcggaggaagatgaagaagtccgagctctaaagttagagttagggaaggcaagactcgccaaggagaagttcaagtcagctactacacacatccggaaagagtgcaccgagttacaagaggaaaacgcggccactgcaaaagcccttgaacaagaaaccaaaagggcccgcaaggaggaatatggccgagagaaattccaaggagcattgtggggtagtaacaatgggctcaagctccgaagagaggaaagagatcggtcacgggtacatggcatgatattaaaagaagagttagttgcttgcgcgaggttcaaaaggagtttggctcaacacttggaagccatggagcaaaacatgctagctaccatagggcaatacaaggaagaattgaaccagtccatggcccatgaacaaaagctagtggaggattttgcacaagtgtatgccgaaaaagaagcaagagggagggtgattgatgcgttgcatcaagaagcgactatgtggatggataggttcgcctga

SEQ ID NO: 56399 - DNA, 744 bp, Glycine max
  Peptide Sequence Number=SeqID_148084
atgagccacagtcgacagcttggcggttacatcacactgctgcagtgctggatttacgagcacttttcctcagttgcggagtccaccgctgatcaggactacgacgagacttctccgcgtgcgtgcaagtggattgcgacgaagaagaccgtgaagagcattcgcacgccgtcgtatagggagcgcctggaccgactccggattccggatgtctgttggatcccgtatggggagcattgggaggtccgagacttccacgtcagatcatgctactccggtctcttgcgctgggggcctgttgctgtgtattaccgaccggagagggtcgtgcggcagtttggttacacacagaccattcctgctcctcctgtcgattcatgggtcttgtatgatgatatacacgacaggtggatgcactacgaggatcatatcgtacctgcaggtgaggtgtacgtggtgccaggggcgtgttccagtgactacatcgactggttcttccgcatctcccatcctttcatgacaccaggccacacaatagatcctctgcctcatggtcacgccccgcagccccgagtcgtccctcaggccccgcagacagatatccctcgtgtgccggagtcaggagcatcgtcgacatctgcggaggagcccagacatgcagtggaagtttgtgatgacattgttaagcggttggagcgccatctgagtctaggggtggtcacgcttggctcatcgacacatgag

SEQ ID NO: 56400 - DNA, 198 bp, Glycine max
  Peptide Sequence Number=SeqID_148085
atggatgcttattgtacaattaaaatattgatgttcccaactagtggtaatgcaaatgtattgaaaaacaacactgacctgttaattattcctttgagatctttgtatggactgtggctcgaggaacccatacacatcggcattccctgctcacatacttgtctcagtcatatgcctattgctgttaatataaagtaa

SEQ ID NO: 56401 - DNA, 312 bp, Glycine max
  Peptide Sequence Number=SeqID_148086
atgaattgcgttttcgttcatgtgtcctccaccatcgagtttggggctatgcgtagtgatttcttagtgcaattctccattctcaatcttttttggagcccattgaattgcgtttttgttcatgtgtcctccaccttcgagtttggagctatgcgtagtgattgcttagtgcaattctccattctcaatcttttcggagccccaagaattgcgttttcgttcatgtgtccctccaccttcgactttagagccatgcgtagtgattgcttagtgcaattctccattctcaacccttttttcggaaccccatga

SEQ ID NO: 56402 - DNA, 375 bp, Glycine max
  Peptide Sequence Number=SeqID_148087
atgtccaaatcttgtggatttgggatgaccggccctctcgatgagtcgatctcttgctttctcataagggtggacccttgggtactagttaccctcaccgttgagaggactacacgtcctcaccatcagaggactacatgtcctcgccatcagaggactacatgtcctcgccatcagaggacttcatgtccttgccatcagagggctgcacgccctcacctccagaggactacctgtcctcgccttcagagggctacacgccctcaccatcagaggactataagtcctcgccttcagagggctgcacgccctcacctccagaggactacatgtcctcgccgtgagagggctacacgccctcaccttgggtactag

SEQ ID NO: 56403 - DNA, 155 bp, Glycine max
  Peptide Sequence Number=SeqID_148088
gggagagaatcgaagtaggtttgaagagagggaagttcgattacgtctcctacacaagtaccaatgctaggaggatcggagcaactggggaaaaaaggaaggaaggagatacctatgccatcacttcgacgcctgcatgggtcaagccaccgtag

SEQ ID NO: 56404 - DNA, 414 bp, Glycine max
  Peptide Sequence Number=SeqID_148089
atgttgccttttgccttgcatggataccgaacttcaggtacgaactatgcatactggggcaatgcaccgtattccttggtttatggaacggaagcggtactccatttgagagtaggtcagatgcccttcccagaggatcgaactgaaggcagaaaccaatcaggcttagaaatcagagtgcgcggctcaaacacgttgcctacgaccaatgtcttcaatcctattttcgaagatattggatgcttaatcaccctgagggagtcgaggcgaacccgaactacgaagccgactttcattgtgacaaaaagggtttttccggagggagcaaccctggtgcttacaacatgggggttaaaaaggggagggagctctctgaccctgaactctgatgttgtcaagcgatactacgcttaa

SEQ ID NO: 56405 - DNA, 411 bp, Glycine max
  Peptide Sequence Number=SeqID_148090
atgtttaacagcctgagatctttgtctcaacacattggagggtacatcctttgtggtacaagtagagggtacatctacttgggtttgactgagaacaagagagggtacatctcttgtggatcagttctagtggagggtacatccactaggttcaaagagaacaagggagggccactcgatccaacagtaaccaactcacctgggcgagcaaggttacttcaggttgaagcaatagctcgcctgagcgagctgttgttcaacctcctcccctcatatcctataaataagcttgagggggttgaagtaatgggttcaaactttcaaacattgaaagatttagtgaaattaaggagaagaaggagaaagaagaagaaaaaacgaggccgaggcacttccgaattgcattcgtga

SEQ ID NO: 56406 - DNA, 402 bp, Glycine max
  Peptide Sequence Number=SeqID_148091
atgggtgaaggtgtccatctggatcgggcgtggttatcgcaggccgatgatcgccggataagcttcctcaacgttgcgaacggtacgatcctcaaccgccatgaaggtcagcgcgtcggaaatcacacatctttaccggcagcacctgaccgccgcagctgtaggctgtacgcggtcacggtgtttcgggtggtgtggcctgagatcttaaacacgaacgctgaacttctcctctttgcttctgactttggcgggtatggctggcgcggcatggagccggcgcctttaggcaaccggaccggatcggtcatggatcgaccaagttgcgcggtaccgaagaacaccggcagtgactttttcgcgctcgaattggagctctttgtcgaatcgggtgcgagatga

SEQ ID NO: 56407 - DNA, 537 bp, Glycine max
  Peptide Sequence Number=SeqID_148092
atggcgaggacgtgtagtcctctaaaggtgaggacatgtagtcctctgaaggtgagggcgtgtagccctacaaaggtgaaggcacatgaccctttgacggcgaggacgtgtagtccactgaagttgaaggtacatgaccctttgaaggcgaggacgtgtagtcctctgaaggtgaaggcgaggacttatagtcctctggaggtgagggcgtgcagccctctggtggtgaggacgtgtagtcctctcaaggcgaggacgtgtagtcctctgacggtgagggcgaggacttatagtcctctggaggtaagggcgtgcagccctctgatggtgaggacgtgtagtcctctcaaggcgaggacgtgtagtcctctgacggtgagggtaagggcgtgcagccctctgatggtgaggacgtgtagtcctctcaaggcgaggacgtgtagtcctctgacggtgagggcgaggacttatagtcctctggaggtgagggcgtgcagccctctggtgctgaggacatgtagtcctctcaaggcgagg

SEQ ID NO: 56408 - DNA, 159 bp, Glycine max
  Peptide Sequence Number=SeqID_148093
atgttcgagttgggtttggcatccagggcgaaaaccggaagtgatgatgatgatacattagacatggtttggctttcggatgttgagggcaatttcaattcctatcaagaagacattgacgtccaggagaaccctgatgccttggaaataattgaataa

SEQ ID NO: 56409 - DNA, 471 bp, Glycine max
  Peptide Sequence Number=SeqID_148094
atggccccgaggaagcttgcctcaaagaggtccaggaaagacaaggcagccgaaggaactagttccgctccggagtatgacagtcaccgctttaggagcgctgtacaccagcagcgcttcgaggccatcaagggatggtcgtttctccgggagcgacgcgtccagctcagggacgacgagtatactgatttccaggaggaaatagggcgccggcggtgggcatcactggttactcccatggccaagtttgatccagaaatagtccttgagttttatgccaatgcttggccaacagaggagggcgtgcgtgacatgagatcctggagggccaggaatgtgagtatggccagaggaggaaccggtctgatgggttcgatgaggaggccatcgcccagctgctatgtataccggggcaggattttgcccggacagctgcagggaggcgagtgcgaatcatgcgcaccaacatga

SEQ ID NO: 56410 - DNA, 1185 bp, Glycine max
  Peptide Sequence Number=SeqID_148095
aataacggacaagccgccgccccacaagttcccccggggcaacggcaagccgaatcggacccagcgcaatcaggccaggcgcacgccctcgtgcagggccgcgatgccggccgtcaggttgaagtactgcacccgctccaggccggcggtgcgcagcatgtccgccagggtttcctggtcgggatgcatgcggatggattcggccaggtagcggtagctggcctcgtccttggccaccgtcttgcccagccagggcagcacgttgaaggaataccagtcgtaggccggcgccagcggcttggcgatgcgggagaactccagcaccagcagcttgccgcccggcttgagcacgcgggtcatctcggccagggcgcgatccttgtgggtcatgttgcgcaacccgaaagccacgctgacgcggtcgaaatagcccgtcgggaacggcaggcgctcggcgtcacagacggcggtgggcaccagctggccggcgtcggccaggcggtcgcggccgacgcgcagcatggaatcgttgatatcggtcagccagacctcgccggtggggcccgcgcgcttggcgaaagccttggccaggtcgccggtgccgcccgcgatgtccagcaccttcatgccggggcggatggcggcgcggccgatggtgaaggccttccagacgcggtgcaggccggccgacatgaaatcgttcatgatgtcgtagcgctgcgccaccgagtggaagacttcggcgaccttgcgggctttttcgctttccggcaccgattggaagccgaaatgcgtcgattgggacgcggaatccgcggaatgttgcgattcggagggcctatcggggcccgccggatgccgcccgcgggcgcgggaaggcgccgtgcggtcacatacctgaaatattgcggccatactatcgcaatgttcgcgccgcgccggcgctccgaagcgtgccctattcgccatgtccagcaccatcctcgtcgtcgaagacgaacccgcaatccaggaactgatcgccgtcaacctgtccttcgccggccacaaggtgctgcgcgccttcgacgccgaccaggcccagaccctgatccgcgccgaactgcccgacctgatcctgctggactggatgctgcccggcacctccggcctggccatggcgcgcaagctgcgcaaccccgatag

SEQ ID NO: 56411 - DNA, 373 bp, Glycine max
  Peptide Sequence Number=SeqID_148096
aaaccgacaagaggaaacgaagcatagcactaaaagcctcctcatcaatgcaagaggaaaatgaagatgaagaattggaagatgaagaagacttctcactttttgtgaagaagtttcacaaatttgtcaagaatagaataagcgagaggcgtcaaaatttcaaccatggaaaaagatcccatgaaggctctctaactcttagatgctacaatcatgaagaaagaaagaccaagaaggcttacatcgtttgggatgacaacgattcattcgaagaatctgaaaaggaggatgatcgaggccgtacccgaatcaaaaaaacattaaaaatgcagtatctaggaagtgatcctaggtcatctcccaacgagcaatg

SEQ ID NO: 56412 - DNA, 252 bp, Glycine max
  Peptide Sequence Number=SeqID_148097
atgttaggatttacacgcgattctcctcaaatttcagccagcccgcatcaattggaccttgcaccttacgctttgaggtcatacagtgctcaatggaatgccccagggattcttcatgacaagcacacgttgcgttcgagtcgtatcctcggaaaaatggaggttgaggaaaccttgcaggggttatggctaccattgcattatcgagtggatatgggagcaagtcagcataggacaccagaattggggtga

SEQ ID NO: 56413 - DNA, 687 bp, Glycine max
  Peptide Sequence Number=SeqID_148098
atggaggtcgaaactccggaagaagacgaagaggtacaggccctcaagacagaacttgagaaagcccaaacagtcaaagaaaagttcaagtcagcagttgttaggatccgaaaagagaacgccgaactgagagacgtcaatatagccaccaccaaggccttggggcaagagaccaagagggcccgtaaggaagaacatggccggaacaagttccgaggggctttgtggggcagtaacagtgagcttaagctccgaagagaggaaagggaccaatcgcgagtagacggcttgattctgaatgatgaattgagggtttgcctaaggtccaagaggagtttgtctcagcgattatgcgagaccgaaacaaacatgttagccatcatcagcaagtacaaggaagaattaaatctagcgacagcccacgagcacaaagtggcggacgaatacgcccgagtgtacgcggaaaaggaggccagaagaagggtgattgactcgttacatcaagaagcaacgatgtggatggaccgatttgctcttactttgaatgggagtcaagaacttccccgattgctggcaaagggcaaagctatggcagacacctactccgcccacaaggagatccatgggctcctccgctattgtcaacacatgatagacttgatggcccatataattaggagctgttag

SEQ ID NO: 56414 - DNA, 330 bp, Glycine max
  Peptide Sequence Number=SeqID_148099
atgaattcattgcctagcgttgttcatgtgtcctccaccatcgagtctggagcaccgagaattgattgcctatcgctgttcgcctatcctccatcctccaatcttattcggagacccatgaattcattgcctagcgctgttcatgtgtcctccaccaacgagtctggagccccacgaattgattgcctagcgctgttcgccaattctccattctccaatcttattcggagacccatgaattcattgcctagccttgttcatgtgccctccgttatcaagcgtggagcctctgagaaagaagaaggagagacgagagtcgttatagactaa

SEQ ID NO: 56415 - DNA, 627 bp, Glycine max
  Peptide Sequence Number=SeqID_148100
atgaccggctctctcgatgagtcaatctcatgctttctcataagggaggacccttgggtgcacgccctcgccttcaaaggactggacgccctcaccttcagagggctacacaccctcacctttagaggactatacgtcctcctcttgagaggactacatgtcctcaccatcatagggctaaatggcctcaccttcagaggactgcacgtcctcaccttcagagggtttcacgccctcgccttcaaagggcggcatgtcctgaacttcagagggctgcacgctctcgccttcagagggctgcacaccctcgccttcaaagggacccgtaatttcccttcaaccattctttttcccgggccaccccttgatctcaaaggagggccaactgtgcgagcacaaccagaggaaggctatcgcgcagctactgtgcataccggggcaaggggtcgcacccacaagacacccagtggacccggagaagtccaacagggccctggggtttccaactctggttacgggcctctatcagtcctacagggtgcccgttcccccaacaagggatcacgcccgcaagacacccagtggacctggagaagtccaacagggtcctggggtttccagctctga

SEQ ID NO: 56416 - DNA, 229 bp, Glycine max
  Peptide Sequence Number=SeqID_148101
ccctgtactatcaaggactttagagtcagaccaatttccactgttgaatgaccctaacaaaacatgcatctacgtgatcaaggtggcccttgttcgtgctcgtgcgcttagcgcacttatggaccgctttagtgcaccggtgcgcttagcaaacctgtacaactcatcttcttctggattcatcctcgcggttagcccaggagtgttgcgcttagcggacgctcgctaa

SEQ ID NO: 56417 - DNA, 363 bp, Glycine max
  Peptide Sequence Number=SeqID_148102
atgtctcctccttccttatgggtgtcgattacttatttaaaacaaacaatagtaaaagaaactgcgaatgcaaaggatactgggctgccttgcagcgacgttctctgcttgtttagcatcgggaaggggcaacgatcggttggtcgtgaccctagccccacttgcatccgtccctatgtacctgtaagtaggaaacaaaaaatccaatggccaatcgtgtccggtcatcgtcttacctcggttgatttccgcagtcaacttgtctcgacttctaaccgtgacctaagaaggccctgcccctgttaccacaaaatatgcatgaatgttcctaatgcgatgaccttcttagtgaaggatggttag

SEQ ID NO: 56418 - DNA, 240 bp, Glycine max
  Peptide Sequence Number=SeqID_148103
atggccctatttgatacaggggctgattcaaactgtattttagaaggattaattcctacaaaattctttgaaaaaatttcagagaaacttagtacagcgagtggatctaaattaaaaatcaattacaagttatccaatgcaatcattgaaaaccaaggtcttaggattaatacaaactttctccaggaggtatcttttaataacatccaaatacaactagaaaaaccccaactaaaataa

SEQ ID NO: 56419 - DNA, 436 bp, Glycine max
  Peptide Sequence Number=SeqID_148104
gaacgaggataagggctacatgggagtacgtgagctcagttggaggtgggcaacaggggatggtgggtttgtacgtgattttgtggatgtggagaacttgttttgcaccattgcccgaccgccacctagtaccacatgtgatggagtggtacctggagatatgtcgcgggggtcaggagaccttggggacgtcaggcgagctcctggcagtcaacagataaaaggaacaaagaccacaaagcaaggaggcttgtgtggtggttggccagctgagactaagatggtctctggtaatcgattacaaagggagtgtaatcgattaccaggcttgaaaggtcaggaagctaggagagctgctagtaatcgattaccaagggggtgtaatcgattaccaggcttagaaatgaaggcagcaggttgtggaggcctctggtaa

SEQ ID NO: 56420 - DNA, 297 bp, Glycine max
  Peptide Sequence Number=SeqID_148105
atggaggctcatggcaagatcgaggttgagctatccttaaatggcagagtgctcgaaggacttggaggcaatggtgtcgcatgccaacttaaggaagaatgggtcaagatccgggattgggtggagattcagaggggttgggcaccacacttgttttgcacgcacaaagagagccagtcacgagtaataacaataggtgatagcgacgaacacgggggcttaaggtgcagtcgcaagggttttagagaagagaatttgagaaagagagggttaaaaaattgtgactttgagaggtaa

SEQ ID NO: 56421 - DNA, 1096 bp, Glycine max
  Peptide Sequence Number=SeqID_148106
atggccccgaggaagctcgcctcaaagagatctaggaaggataaagcggctgaaggaaccagttccgctcccgagtatgacagtcaccgctttaggagcgctgaacaccagcagcgcttcgaggccatcaagggatggtcatttctccaagagcgacgcgtccagcttggggatgacgagtatactgatttccaggaagagataggtcaccagcggtgggcatcactgtggatcccatttgatgcaaatgctatcggccagctcctgggatatcctttagtgctggaagagggccaggagtgcgagaatggccagaggaggaaccagtttgatgggttcgatgaggaggccatcgcccagttgctatgtataccggggcaagatttttcccggacggctgccgggagacgggtgcggatcatgcgcaccaacatgaccaccttgactcagatatggatgactttgctgctcagcaacatcctgcccaccgatcataattccgacctccccctgccgaagtgtcagctggtgtacgccatcttgacgcggatgagcatccatgtggctcagttaatcgctgatgccatctatatttttgcaggtatggcgcctaccaggcaccctctagacccagataagtccaacagggccctgggatttcccgccttgatcacaggactttgccagtcgttcggcgtccccgtcacacctagcaaggtgattcggccgcccatcacccgagcttttatcgagaagtactgcacgcagagacagatccagggtgatgcaccacaggctgcggacgcgccgccaccccatcaggctggtccagccggatcatttgacacggagcagtatttgcggcatttggttcgccagcaggcggccaaccaccgggcacatagccagggctttacttctttttcgtgccctactccagaccagttcagggcagaggtcgcatggcctggagattggcctgaggcccaggcaggagaggaaccagcaggggcacccgcagaggctcccgacgaggcagatgaggcccgcgaggatgaagagatgactgatttacttgatttcttaggagggagcg

SEQ ID NO: 56422 - DNA, 396 bp, Glycine max
  Peptide Sequence Number=SeqID_148107
atgaacgcactaagcgcgcctgttgcgcttagcttgttcatcgcaactgttaaaattttggatttccagatgatcgcgctaagcggaccatgtcgcgctaggcgcgaattttatgcaaacctctacgacccggaagacaagtcacctaagcaggtgagggtcagaggtcatctgatcaaatttgatgaagatactttgaatacttttctgaagacccttgtgattgtggaagagggggagaatctctgtgtttattctaagtttgcactcctgaggcttgatcctcaggagttggctgctaagctttgtatcccagggaggggattcgagctaaacactgatggtcagcctttgaagattttaaggaagaacattaccactttagctcagacatag

SEQ ID NO: 56423 - DNA, 191 bp, Glycine max
  Peptide Sequence Number=SeqID_148108
gtggagatggtactaaggaggaggaaccaacagatttgaggccaaatccacttcaaaggggaggggatgatgtaatcctccctaggaagggaccagtcactaaagctataagcaagaagctccaagaggattgggctaaagttggtgaagaaggccctaaggttctcatgaacttcagggtagatttctga

SEQ ID NO: 56424 - DNA, 345 bp, Glycine max
  Peptide Sequence Number=SeqID_148109
atgaatatcgaaagaattgatcccgatcagcgctggtccgaagccgtggtgcacaacgagaccgtttactacaccagcgtgccggagaacctggacgacgacgcgaccgcgcagaccgccaacgccctcgccgccatcgacgtgctgctggcgcgcgtaggttcggacaaaagccgcattctggacgccaccatcttcctggccaacagcgccgacttcgccgcgatgaacgctgcctgggacgcctgggtggtcgccggcagcgcgccggtgcgctgcaccgtgcaggcgcagctgatgaatccgaagtacaaggtggaaatcaaaatcatcgccgcgctgtaa

SEQ ID NO: 56425 - DNA, 453 bp, Glycine max
  Peptide Sequence Number=SeqID_148110
atgggggcatattctacggacgaaaagctgttggtccatttctttcaagaccctaccccatggtggtatgacccgggtgcatgtgagtaccatagtggagctcccggacacgacattggaaagactacctgccgcccgttcagcccaagtggtctgcccatgacggagagggagatgatccacatggtagatacgttgcctacgttctactatgaaaagctgataggctacatgccagtatttgcggatctcgtcttcgctggagaaagaattgaatctggactgagaaaaggcaagtcatggaatatgcctccaacacggcccccaataacacagaagagccccagtggattgggcacgcttgaagtgaaaaggaaggagatacccacgcggtcaccaccgcccaacatggatgaaagcaccccaaaatatccaaatctcataccagcctaa

SEQ ID NO: 56426 - DNA, 274 bp, Glycine max
  Peptide Sequence Number=SeqID_148111
atgacaagcagagaccaagtttggtcattctgcacccatgatacgcggagataccttatggttattcgcacccttttgtcatccagaggcggcgggcccgatgacaagcagagaccaaagaccaagtttggtcattctgcacccatgatacgcggagataccttatggttattcgcacccttttgtcatccagaggcggcgggcccgatgacaagcagagaccaagtttggtcattctgcacccttgtatcatccagaggcggcgggcccgatg

SEQ ID NO: 56427 - DNA, 363 bp, Glycine max
  Peptide Sequence Number=SeqID_148112
atgaagctggaagaaactctagctcaatttatgcaggtatctatgtcaaaccataagagcacagagtcagccattaagaatctggaagtccaagtgggacagctggcaaaacaattggtggataggccgtcaagcagctttagtgctaacactaagaagaattcgaaggaagaatgtaaagctgtaatggcaaggagcagaatggcaattcaggctaatgaaggtagagctgaagagaaggtggagggatataaacaacagtcggcaattgagccggcactggaaccagtttttgattttgttaaacttgaggaagttgtggaagatgaagatgaccaacaggagagagagagacaccaataa

SEQ ID NO: 56428 - DNA, 238 bp, Glycine max
  Peptide Sequence Number=SeqID_148113
gtcgactctagaggatcccaccttcctccctcattctccattgaagctccacacaaagcttcaacctttggtgctcatttctgctccaaatcgtggaaggagagcattttcggggtcgtgaagtgcgtggctacgagtgggacttcgaaaatccaggattttgcacaagtgcagaaaaatactaggcatttgctggttgtggaaagagcagtgcagaatgagttctggatgtttgcta

SEQ ID NO: 56429 - DNA, 525 bp, Glycine max
  Peptide Sequence Number=SeqID_148114
atggaaggatttttagtttcaagaaagtatgttgcgttgcaaatctgtgacgacgaagatgttgaaactatgatcaaaagttttcaacaagatcaaatgtcagttctggaattgtacatagaaaaggatgtggctggtggttctatgtttcattctgcaaattctcttacatcatgtgaaaataatttatctaataatgaggcggaaccaccaagaaatgtaagcaatttacatggtgatgaagatgatgatgattatcttgtgtctaactcatacgttgaagagtctttagacgaagatgatagtgttgacggtatatctgatacagacaatgaagtgaccgatgtgattcaaccagtgtacaaggaattcaaaatccattttggaatgatgctttgcattataacaatatcaattggagtcatcctgatgaggaggacatttgcggtttggagatgccatcgagttttaatgttgggcaagaattatgtgtgggcatggattttgatagtaaagatgcggtaa

SEQ ID NO: 56430 - DNA, 270 bp, Glycine max
  Peptide Sequence Number=SeqID_148115
atgaacccaggcctaactcacaaaaacagtccccaatggagtcgccaacagtcgcaacctaccctttggtgggcgagcgaggcgagactcacgggtgcgtcttccaaaggaggaaaatgcgcggagtcgccaccaacgtttatttgtggaaaacgtcggaaaaaccgaaggaaatcggtcatgaagaatattccagattcgggagttgtatttacgtttgaggaaggtattagcacctctcacgtttgtcccagaggacaacagccttaa

SEQ ID NO: 56431 - DNA, 468 bp, Glycine max
  Peptide Sequence Number=SeqID_148116
atgtcgcgctatgcacattcatccctgctgatgaacatggcatctaagaagaggaaagctccttctacacctacccaagccagatttgatagatccagattcacatccctagaggcttgggagagatacactgacattgtggtgcctcgaaagctactactagagaggaatgtggtagtctattacacagagtttgacgagttcaaggaggaactcgagagaagagattgggatgagaagttgactgatatttctgacagtagcatagacattgctattgtgaaggagttttatgcgaacctctatgacctcgaggataaattacctaagcaggtgagggtgagaggtcatctagtgaaatttgttgaagatactcttaacacatttctgaagaccccaataattttggaggagggggagaatttgtgtacatattccagatttgcacttctgaggtctgatccttag

SEQ ID NO: 56432 - DNA, 504 bp, Glycine max
  Peptide Sequence Number=SeqID_148117
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatcccccctcaacacaggcccctataaggcctcagatcctaagcaaagcacatcaaaaccacatacattatgtgcacggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 56433 - DNA, 238 bp, Glycine max
  Peptide Sequence Number=SeqID_148118
atgggttcctcatacagaattctacctctgtctaggtcaatgaggtcacctggagcagggtctccatctgtgcttgatcatcttcctctgttgagaagcttctctctttgctgggggaagagagtacttcagcatttgggccggaagatgtttggaacatctttctcaacatcaggcacagaaacattcggggggcaagttgggaatcttcatcagcttcatctgttggtctgcccag

SEQ ID NO: 56434 - DNA, 601 bp, Glycine max
  Peptide Sequence Number=SeqID_148119
atgcatgagaggggtgcatctgtagtgaagcaagtgacgaaagattttcgtcgcggtcaaacattctcggctgctcctccgtgtagggagacttcacctccggtagaagctccggagacaccgctgactacagcacctttgttcgcacggacgccgttgtcgtccctgagcttcccgatgaagaaaaattcagagacagaaacttcatccatcacacaatcccagcccctcagttacggaaagaccctagtttccccaagtggaatcttcgaactcggtttcttcaatcttggaaatccgaacaaaatctaccttgggatttggtacaagaatattccacttcagaacatggtttgggttgcaaacagtagcatcccaataaaggattcttctccaattttgaagctagacagttctggcaatttggtccttacacacaacaacactattgtttggagcacaagttctccagaaagggtgtggaatccggtggcagagctcttggattctggcaatcttgtgataagagatgagaatggagcaaaggaagatgcatatctgtggcaaagttttgattaccattctaatactatgctgccag

SEQ ID NO: 56435 - DNA, 156 bp, Glycine max
  Peptide Sequence Number=SeqID_148120
atggactcccttggttttggtggtgttggtgatgaaaaggaatccaaggtcttagatccatttcatctctttgactggtcagcagacatcaacaacaacaccaacagcaacacaagtagttcatttgaaaatcctaataataagataaggttataa

SEQ ID NO: 56436 - DNA, 432 bp, Glycine max
  Peptide Sequence Number=SeqID_148121
atgccaccgaggaagctatccgcaaagagatctaggagggatgccgcggccgaaggaaccagcgccgctcctgagtttgacagccatcgtttcaggagcgtagagcaccagcagcatttcgaggccatcaaaggatggtcattccaccgagagagacgcgtccagctcaaggacgatgagtacacagattttcaggaagagatagctcgccggcgttggacgtcgctggagggcgtgcgggacatgcggtcatgggtaaggggccaatggattccttttgatgcagacgccctcagccagttcctgggtgacctgctagtgttagaggagggccaggagtgcgagtttagtcagagaaggaaccgggccgatggatttgacgaggaggccatcgcccaactgttatgcatactgggtcaggattttgcctga

SEQ ID NO: 56437 - DNA, 543 bp, Glycine max
  Peptide Sequence Number=SeqID_148122
atggctccggaaaagctttcctcgaagaggtctaggagaggcgccgcggcagaagggtccagtgccgcccccgagtttgatagccaccgtttccggagcgccgagcaccagcagtgctttgaggccatcaaaggatggtcgttccacagagagaggtgcatccaacttagggaggatgagtatacaaattttcaggaggagatagctcgcaaacattggacgtcgcgggtgactcccatggctaagtttgaccttgagatagtcctggagttctatgccaatgcttggcctatagaggagggagtgcgagacatgtgttcatgggtaaggggtcaatggattgcctttgatgcagatgccctcagccagttcctgggtgacccgctagtgttggaggaaggccagcagtgcgagttcagccagaggaggaacagggccgacgggttcgacgaggaggccattgcccagttgttatgcacattggggcaggatttcgcccggaccgttgcaggaggcgggtgcggatcttgtgcaccagcatga

SEQ ID NO: 56438 - DNA, 547 bp, Glycine max
  Peptide Sequence Number=SeqID_148123
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccaagttcttggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 56439 - DNA, 246 bp, Glycine max
  Peptide Sequence Number=SeqID_148124
atgcagctcccgggagacggtcacagcttgtctgtaagcggatgccgggagcagacaagcccgtcagggcgcatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 56440 - DNA, 195 bp, Glycine max
  Peptide Sequence Number=SeqID_148125
atggcttgcactcacattccaggggaagcaaagatcgattctcctcaaatttcagccagcccgcatcaattaggccttgcaccttacgcttcagagccctacaatgctcaatggaacgccccggggcttctccatgacaagcacacgttgcgttcgagtcgtatcctcgaaaaaatggagattgaggaaacctag

SEQ ID NO: 56441 - DNA, 934 bp, Glycine max
  Peptide Sequence Number=SeqID_148126
gagcgaggcgggccgctacaacctaggagcatccctaggccgatccagtcttggaaaaagggaaaaagcttgcggaggaaaggctgccgaagaacggcagagagatgcgccccgccggaaccggcggagggtacgtcctggcacgggccccggagatgcctgcgccggctcaggaagccttgggcttgccgccgcggcggcgcttggcgggaagcggcggcaacggctcgccggccagctcggccaggaagcgttcgtcggccagcgacaaccatccctgggcgcgggccgactcgatcagttcggggcgacgcgcagcggtcagcgccagcgagcgctcccggcgccagcgcgagatgttggcatggtggccgctgagcagcggcgccggcacgggcgcgccctcgtagacttcggggcgcgtgtaatgcgggctgtccagcaggccggacagcgtgtcgttgaaggagtcctgcagcgcggagtcgccgtcgttcagcacgcccggcaacaggcgcaccgcggcgtcgatgacggcgagcgcggcgatttccccgccggacaacacaaagtcgcccagcgagatttcatgcgtgacacagcgctcgatgaaacgctggtcgacgccttcgtagcgaccacagatcaggatcagaccgtcgctggcggccagcgcctcggcgccggcctggtcgtagcgcttgcccacgggcgcgagcagcgccaccggggccggccccaggccttgggccgcgcgcgccgcctgggcggcattgacggcggcctccagcggggccgccatcatcaccatgccggggccgccgccataggggcggtcgtccacggtacggtgaggatcattggtgaaatcgcgcggattccacgcatgcagggcccaccggccctgggcgtgggcccggccggtgacgcccag

SEQ ID NO: 56442 - DNA, 675 bp, Glycine max
  Peptide Sequence Number=SeqID_148127
atgtggctcaccgatcataattctgacctccccctaccgaagtgtcagctggtgtacgctatcctaacgcggatgagcatccatgtggctcagttaatcgctgatgccatctatatttttgcaggtatggcgcctaccaggcaccctctggacccagataagtccaacagggccctgggatttcccgccttgatcacaggactctgccagtcgttcggcgtccccgtcacacctagcaaggtgattcggccacccatcacccgagcttttattgagaagtactgcacgcagagacaggtccagggtgatgcaccacaggccgcggacgcgccgccacctcatcaggctggtccagccggatcatttgacacggagcagtatttgtggcatttggttcgccagcaggcggccaaccaccgggcacatgtacagacctatgattgtctttatcagatgagtctcagcctgcagagtcaaggctttacttcttttccgtgccctactccggaccagttcagggcagaggtcgcatggcctggagattggcctgaggcccaggcaggagaggcaccagcaagggcaccagcagaggctcccgacgaggcagatggggcccgcgaggatgaagagatgaccgatttacttgatttcttaggagggagcagggccacatga

SEQ ID NO: 56443 - DNA, 1550 bp, Glycine max
  Peptide Sequence Number=SeqID_148128
atggggacaaatcaaaatggcaaaaggttttatcaagtcaaggttaaaagtctagatgtcaccagcctcaaggaattgggacgattgatgggacctctccaaaggcaagccttccgcaaagtgtacgggaagattctagatttgaccgcagcggaggtatttacggaagctgtcgtatcccttgcccaatactatgaccagccgttgaggtgtttcacgtttggggacttccaaatggtaccgactattgaagagtttgaggaaatattaggatgccctcttggggggagaaaaccgtatcttttctccggctttcttccctccttgagcaagattgcagctgtggttggagattcgacaaaagagatggatcgcatgaagcaaactcggaacggcgtagtgggcctgcctcggaaatacttggaaggcaaggcaagggatatggcgagccaagagaagtgggacctgtttgcggatatattagctttgttgatttttggggttgtcctctttccgaatgttgacagtttggtggacttagccgccattgacgctttcctcgcatatcaccatagcaaggagactccagtggtggctatcttggcagatttgtttgacacccttgatcggaggtgtgagaaaaacagtgcacggattgaaggcaaggaaggagttcctttcttgtgtggggactaccctaatgttccattaatagggactaggggttgtattaattataatcccgcactcgccataagacagctagggtaccccatgagaggagcgccaacagaagaaagtctctcgcctttccttgtgagggatctaggcgcgcaaagtctcaaggtgatacaaagagtccacaaggcatggagaaatccattgaggaaagacaaggagcttagaggcatccaaaatggcgtcatccgtggttatcatggatggctaagagttcacacgcgagggttagattggctctccaaattgaaagttatcaatgaggagaactccgaagctccggaggaagatgaagaagtccaagctctaaaattagagctagggaatgcgagactcgccaaggagaagttcaaatcagccgctacccacatctggaaagagtgcaccgagttacaagaggaaaacgcggccactgcaagagcccttgaacaagaaactaaaagggcccgcaaggaggaatatggccgagagaaattccggggagcattatggggtagcaacaatgagctcaagctccgaagagaggaaagagaccggtcacgggtgtatggcatgatcttaaaagaagagttagctgcttgcgcaaggtccaagaagagtttggctcaacacttggaagccacggagcaaagcatgctagctatcatagggcaatacaaggaagagttgaaccagtttgtggcccatgaaccaaagctagcggaggattttgcacaagtgtacgccgaaaaagaagaaagagggagggtgattgatgcattgcatcaagaagcgactatgtggataatcagttcggttgaccttgaatggaa

SEQ ID NO: 56444 - DNA, 294 bp, Glycine max
  Peptide Sequence Number=SeqID_148129
atggaaaaacgccagcaacgcggcctttttacggttcctggccttttgctggcttttgctcacatgttctttctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatgaaacagctatgaccatgattacgaattcgagctcggtaccccctgtaaaaactttcctgtatggggtgtga

SEQ ID NO: 56445 - DNA, 78 bp, Glycine max
  Peptide Sequence Number=SeqID_148130
gaagattgggccaaagatacaagagaaggccctagggttcccatgagccttaggatagatttcgagcccatgggccaa

SEQ ID NO: 56446 - DNA, 210 bp, Glycine max
  Peptide Sequence Number=SeqID_148131
gtgtcataccctaatttcgtccgggggttattatttgatgatatacaacctttgattggccgcttcgagatacttgtgatgcaagctcaattggagcttgtaggcctaggatcttcttcatcaatggattcctttgcttcttggaagatgaatggcagcggaatggagaaaggaagagagagaggagacgccacttcaaggagaagatga

SEQ ID NO: 56447 - DNA, 672 bp, Glycine max
  Peptide Sequence Number=SeqID_148132
tgctggatttacgagcactttccctcagtcgcggactcaactgctgatcaagaatacgatgaggattccccgcgtgcatgtaggtggattgcgaagaagaagaccatgaagagcattcgtacaccggcgtacagggagcacctggaccaactccggattctggatgtgtgttggatcccgtatggggaacatcgatcggtccgggacttccatgtcatatcatgttattccggtctcttgcactgggggcctgttgctatttattaccgaccagagagggtcgtgcggcagtttggatacacgcagaccattcctgctcctcctgtcgattcatgggtgtcgtacgatgatatacacgacaggtggatgcactactcgaatcatatcgttccagcaggtgaggtgtgcgttgtgccaggtcagtgtgccagtgactacatggactggttcttccgcatctcgcatcatttcatgacaccaggccatgcatcagatcctctgcctgatggtcatgccccacagacggatatccctcacgtgtcggagccaggaacatcgtcgacatctgtggaggagcctggacatgcagtggaagtttctgatgacattgctgagaggttggagcgccatctaagtttaggggtagtcacgccagactcatcgacacatgag

SEQ ID NO: 56448 - DNA, 240 bp, Glycine max
  Peptide Sequence Number=SeqID_148133
atggcaaaatcaagtagaaaacaagacattatggtggacgaaatacctttagatagtgaatggaggagaaagggaaaccaaaaaccaaagagcacaagagatcaagaaagaacaagaaagcaaggaagcaagaagacaatgaacagtgacccgaatcaaatgtctaatccatttcaagaggagacaaactcttcggttttcaccaatgagatggaagcttccactagtgctccttcctaa

SEQ ID NO: 56449 - DNA, 570 bp, Glycine max
  Peptide Sequence Number=SeqID_148134
atggagagaagtatgatagatgctgccagtggtggagcccttggagacatgacccctgctgaagccaaaaatttaattgagaagatggcttcaaacttccagcaatttagtgccagaagtgatgctattgtcattagaggagtgcatgaagtagccacgaattcatcaggtgagactaagaagcttgaagactctgtggtttatgctcctctgccgaccaccacacagacctttgcccctttgtgcaacaatctgaagcaattgaatagtctgaagcttatgctgcaaacatctacaagagacctcctcaacctcaacagcaaaatcagccacaatagaataattatgacctctccagcaacagttgcaatcccggatggaggaatcatcccaaccttagatggtcgaatcctttacaacagcaacagcaacaacaaacttattttcaaaatgctgctggcccaagcagaccatacgtccctccaccaatccagcagcaacaacaacaacaaccccagaaacagcaaacagttgaggcccctccgcaaccttcccttgaagaacttgtga

SEQ ID NO: 56450 - DNA, 336 bp, Glycine max
  Peptide Sequence Number=SeqID_148135
atggtaaccataacccctgccagggttcctcaacctccatttttccgaggatacaactcaaacgcaacatgtgcatatcatggaggagttcttggacattccattgagcattgtagggccctgaagtataaggtgcaaggtctaattgatgcgggctggttgaaatttgaggagaaccgcttgttgaatcctaacattaacaagcgacaccacacatggggcaattttcaaagctgttgtagtgaaaacaaaacaacaatggatacctatgagccctacactggggcaatgaaaggcaccatgcataaacctcaagcgaacctaggggcagattag

SEQ ID NO: 56451 - DNA, 279 bp, Glycine max
  Peptide Sequence Number=SeqID_148136
atgttggtgcgcatgatccacactcgtctttttgcagcggcacgggtgcaatcttgctccggtatgcatagtagatacgtgatagcctccttctctggatgtgctcgcacagttggtcaccctccaatatcagggggtagcccaggaaccgttgaaaggaaaccgtggccccccacactgaaaatgaggacgcatagccctctaaaggcgagggcgtgcagccctctgcaggcgaggatgtgcagtcctctgatgtcgaggacatatggtcctctaaag

SEQ ID NO: 56452 - DNA, 288 bp, Glycine max
  Peptide Sequence Number=SeqID_148137
atggacccaatcaagactgcacataatgatgcatgcacctggctcaacactcaaatgcaatgtgctagtgccaaagaccctggaaggtcagtgcacagtgccccccacaatcatacacaacatccaacgtgtgaacgtggccaaaagctagtgccaaagaccctggaaggtcagtgcatagtgccccccacgaacatacacaatatgcacatgccaatgcatttccaacatcaatcaacattccatttccatgtcattcacaacataaatatcatctcatctcaatga

SEQ ID NO: 56453 - DNA, 231 bp, Glycine max
  Peptide Sequence Number=SeqID_148138
atggctaaatatgacccggaaatagtcgtggaattctacagtaacgcatggcccatagaggaagcagttagggataagcactcctgggtgcagggccaacaggcctcctttgatgatgatgacattaatcagttcttggggcatctgttggtcctagaggaggggcaacgttgcgagtttagcgaaagaaggagtcaggcttcggggtttaatgaggaggccatcggctag

SEQ ID NO: 56454 - DNA, 210 bp, Glycine max
  Peptide Sequence Number=SeqID_148139
atggcctcatccaagtttccatttcctgagggaaattctattaataggccttttatgttcaatggcgagggttatcactattggaaaacccgaatgcagatccttattgaagccatagatttaaatatatgggaagccattgaagttggtccctttgttcctacaaaggtagtgggaaatgcaactatagaaaaaccaagagaagaatga

SEQ ID NO: 56455 - DNA, 573 bp, Glycine max
  Peptide Sequence Number=SeqID_148140
atggcagagccatcgaagaagagaaagggatcatcctccaccgccgctgctgctgcccatcgccgccacggaccatccgaaacacccacaacatctattcttccctatttatcatctccaagatcatccacattgttttcatctgatgatcagcgtctacggtacctttctcaattttcttctaggatcatcttagaccctaagtacctagacgtagaattctttaatgatgaaacgtttgattgctatcaagtgtttcaaaattctggccttgttgatttcatgtcattaaaattgccatattatcctgaacttgtaaaggtcttctactgcaatttaaaaattcaggatggcgttattatctctgaggtgcatggtattcctatggtcattgatcagtcattgttcttttcattaactaatttacccagtcaaggtgcaccttttgagggcaccattgttgatgactggaagtttgattattctagtcatgatgctcgccgtatggtctgcaatgaccaggttgaaatgaccgatcgactgggcccatttggttcggtaccgcatgcataa

SEQ ID NO: 56456 - DNA, 713 bp, Glycine max
  Peptide Sequence Number=SeqID_148141
gacagtacggactggccgatgcgcaggctgatgcgctgcaggcgccagcccatcaggatggcggcggcggtcagtccgacgatcaggccgatccacatgccctgcgggcccatgcccagccccaggccgagcccggcgccgagcggcatgcccaggccccagtacgcgaacatggcgatgaacatcggcacgcgggtgtccttcaggccgcgcagtgcgccggcggacagtacctggatgccatccgggaaggggaaggtggccgcgtacagcagcagggtggaggccaggccggccaccgccaggtcgttggtgtagacaccgacgatggcatcgtggccgaacagcagcaccgccgccgacaacgtctgcgtgcccatgatgatcgcgtagccagcccacgccgcacggcgcacgccgaagccatcgccacggccgactgcatggccgacccgcacggtggtggcttcggccacgcccatcgggatcatgaagcacagctgcgccacgttgatcgcgatctggtgcgcggccgcttcattggcaccgaggcggccgatcagcagcgcggtgacgatgaacaggccgccctccatcagcacggtgatgccgatcggcaggccggtgcgcagcagatcccagatcgccttccagcgcggcccttcgaagtgcgagaacagctgcaggtgggcgaagcgcttggtgaaccacag

SEQ ID NO: 56457 - DNA, 165 bp, Glycine max
  Peptide Sequence Number=SeqID_148142
atggaggatgaagagaacgaagatgtaggacttcccctggagttggaaaagatagtcgtccatgaggaccaagaaatggggcctcatcaagaagagacaaaaatagtggacttaggaaccagcaatgggaaaaaggaagtaaagataggcacgaattacctctaa

SEQ ID NO: 56458 - DNA, 108 bp, Glycine max
  Peptide Sequence Number=SeqID_148143
atgaagatgctcttgataccacatgatgtagcttcgtgtggagcttatgaatggcagcggaatggagaaacaagagatagaggagacaccacttcaaggagaagatga

SEQ ID NO: 56459 - DNA, 417 bp, Glycine max
  Peptide Sequence Number=SeqID_148144
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatctcaacactcagatgcaatgtgggaactgtgctgagtttgtcgagaccactcggttgtgcacgtaacagcccccctcccataggtgatcagcctgggagcccgaaggtcttccctaccaggtga

SEQ ID NO: 56460 - DNA, 339 bp, Glycine max
  Peptide Sequence Number=SeqID_148145
atgtctgggcgctcctccactcgccaatttcctagttggaaaccaggagggcatggtcgtaccaaattcgacccactcggagagtcatcctcgcatatcataatgacttggccttcatgtcctagactcgcgcttataaagctcctactgatgtggcagggcgggccccctttgacctttcgtcccaattacgagccttggcttccgctcttccttcccgcaacactctttcttatgtccgcctgtattggggcctatctgtacagggaggttgatctcccccctaacctctcggcgggtgccgtcgaaggcacggaccaccatggaacttggctttag

SEQ ID NO: 56461 - DNA, 549 bp, Glycine max
  Peptide Sequence Number=SeqID_148146
ggtgaacccttgggtactagtactttcacctttagaggactacacgtccttgcctttagagggctacacgccttcaccttcagagggctacacgccctcaccttcagaggactacacgcccttgccttcagagggttgcatgccctctccttcagagggctgcacactgttgcctttagagggctacatgccctcgccttcagagggctacacgtccacaccttcagaaggctacacgccctctccttcagagggctacacgccctcgccttcagagcactacacgccctcaccttcagagggctgcacgtccttgctttcagagggctccacatctgtgcctttagagaactcaagggcgaactatgcgagcacaaccagaggaggaggcaggtctccagctttgacgaggaggccatcgcacaactactatgcataccagggcatgattttgctcagaccgctgcagggagacgagctggagcgttgcctacgacacatggccgaccagtaggcaaccaaccactcgagcaggtactgtgctcgtga

SEQ ID NO: 56462 - DNA, 447 bp, Glycine max
  Peptide Sequence Number=SeqID_148147
ggtatgacactgacgaaaggtgaggataaccataatgtgtgtccgcgtgctaccggaccgttgggtcacaatagtagaattgagactttttcgcggtcttggccgaaagacgttgacatctccgggaagggtgcagatgaccacattggtggcgactctgcggattttcctttcttggaagatgcacccacgagccccgcatcccccacccgccgaagggtaggttgcgacaacgctgacacctccgagaagggtgcagatgaccacattggtctctacaagacgctgacatctccaggaagggtgcagatgaccgcattagtctctgcgtgtcaacgggctcgctcgcctctagctgacgaaaggtcagaggacgcttgtcataccctaatttcgtccggggaccagttttttggtggaatgcaaccttcgcttgaccacttcgag

SEQ ID NO: 56463 - DNA, 393 bp, Glycine max
  Peptide Sequence Number=SeqID_148148
atggaagaagatgatgattttagtctcttcgtaaaaagattcaataagtttctaagaaacaaaggaaataaaagaaaaacaaacttcaatccaaagaagaagggagaagattcctcttatgttccaaagtgttgtgaatgtgatcatcctggacatttaagagttgattgtcttagtttcaaaataagaatggaaaaatctgacaagaaaaccttcaaagacaagaaaggaaagaaagtatacatcagttgggaagataacaacatggattcatcaggagatttagaaaatgaagtcgtgaatctaagtctcatggccaaaaattatgaaagtgaagaagaggattctttgaaaagaagttgctcattgatagcggatgctctaaacacatga

SEQ ID NO: 56464 - DNA, 471 bp, Glycine max
  Peptide Sequence Number=SeqID_148149
atggcgagggcgtgtagccctctaaaggtgaggacgtgtggtcctctgatggcgagggcgtgtagccctctgaaggtgaggacatgcagtcctctgagggcgagggcatgtagccctctgaaggtgaggacgtgtggtcctctaaaggtgagggcgtgtagccctacgaaggtgaggacgtgtggtcctctgatggcgagggcgtgtagccctctgaaggtgaggacatgcagtcctctgatggcgagggcgtgtagccctcttaaggtgaggacgtgtggtcctctaaaggtgagggcgtgtagccctacgaaggtgaggacgtgtggtcctctgatggcgagggcgtgtagccctctgaaggtgaggacatgcagtcctctgatggcgagggcgtgtagccctctgaaggtgaggacgtgtggtcctctaaaggtgagggtactagtacccaagggttcacccttatga

SEQ ID NO: 56465 - DNA, 317 bp, Glycine max
  Peptide Sequence Number=SeqID_148150
atggacatagactatgctataaggaaagacgaaccacctgcaatcactgatgaaagtagcccagctgacgttgcgctatatgagcggtgggagcgatccaaccggctcaacgtgatgttcattaagaccaaaatctcggctgggatacgtggttctgttgaccagcatgaaaaggaagaagaaaggcttgtgatggagatgggtaagattgcattgctgactactgcttatgggaagaacaaagcaattaagtctcaagctaatcagaaagggaatggtaaaataccacctcaagctgatattaagaaggtggcaaa

SEQ ID NO: 56466 - DNA, 462 bp, Glycine max
  Peptide Sequence Number=SeqID_148151
cattgcctccgtagattccttctctgggcaaccttgcctgtccgatacagcagtgatggtggcccgggtgcccgggtgatgttggggaaaggttatgaactcggaatgggtttaggcaggaacaacgacggcagaaccagcctaataagcaccagaggaaaccatgggaagtttgggttaggctataaacccatgcaagcggacataaggaaaagtgtcgcaggaaggaagagcggaagccaaggttcgcaattgggacaaaaagtcgaagggggcccgccctgccacattagtaggagctttataagcgagggtctaggacacaaaggccaagtcgttgtgatatgtgaggatgactctccaagtgggtcggatttggtacgaccatgccctcctggtttccgacttggaaattggcgagtagagcagtgcccagacatttacgagacaagcataatgtaa

SEQ ID NO: 56467 - DNA, 738 bp, Glycine max
  Peptide Sequence Number=SeqID_148152
atggttagaacacgaggtttaggtcgtgctataggtaaagttataggcagagatagacaggatgaacatgatgcagttgatgttccggagaggcgtaggcctaatgcatcagcccgtaggcaacgggttcatcagatgactgaggatgttcctcacatgactgaggatgtccctgatatggctgaggatgcacctgagatgactgcggacgtacagggtgatgatggtgctgaggggtcacatgctgatgatgttgagggattcccaggtgggccacgtgacccatcagtgctgacatcatttgcggaccatgttgcacacgccatttggagtggacatgaacgttgtgagttgaagttggtgtcgcacgggaggacagtgacattaattgggaggtcagtgcctaagattgaaggactggttggtgccacaggattaagtccattgatcgggtgttcagttgtaactggttatcctggacttatatccgcatttgtggagaggtggcacagcgagaccagtaccttccacctttcagtaggagagttgacgatcacactggatgatgtgtcgtcactcctccatttgcctatcagtggcacgttccacagctttcatgctctttctgtggacggggcgatatttttgttgaccgagttgcttgaggtgtctgccgaggagactagagccgagacaacacgatcacgaggggcatatgtacggctgggatgggtttga

SEQ ID NO: 56468 - DNA, 495 bp, Glycine max
  Peptide Sequence Number=SeqID_148153
cgtgactcaaatgtcagtgtgacagatcttgtgagcgtggaagatgacacatcaaaaaagaatatttgtacggataaccactcgggtatttccgcccgtcagcgtgactcaaatgtcagtatgacagatcttgtgagcgcggaagatgacacagcaaaaaagaatgtttatacggataaccactcgggtatttccgcccgtcagcgtgactcaaatgtgagtatgacagaacttgtgagcgcggatgatgacggaaatctacgcgtgtcaacgtgcttgacggccgcgattgacgaagggcgcagaagacgacggtatttcccccgtctgcgtgactcaaatgtcagtatgacagatcttgtgagcgcggaagatgacggcgcaaagacgacgttagtctctgcgtgctatcagcttttcgtcttacagacagcaaaaaagaatgtttatacggataaccactcgggtatttccgcccgtcagcgtgactcaaat

SEQ ID NO: 56469 - DNA, 186 bp, Glycine max
  Peptide Sequence Number=SeqID_148154
atggaaaagagtgggggcaaacagaataaatttgggtcaatgaaagaaagggaatggaaaatcttcagatcagataaattctcggcaagcttctcaaagaagcctcttgagaaagcttctcaaagaagccacgaggaagcttctggaggaagcctcttaatgaagcttctagagaaagctacatga

SEQ ID NO: 56470 - DNA, 168 bp, Glycine max
  Peptide Sequence Number=SeqID_148155
atgccaaaagatagggggatttgtcttgatttcagggattgtcatcatcaaaaagggggagattgtagacaaaggatcaagctgaatgttttgatgatgccaaagttttcacatgcgtctcaaagctttattcaagacaaaggaattaaagatattcaagatggataa

SEQ ID NO: 56471 - DNA, 258 bp, Glycine max
  Peptide Sequence Number=SeqID_148156
atgagcccagtgagaaggacgaaggccaagtggagaaggacaaagcccccgaacttatcttccttcactggaagtggcgtctacccagacttatcttccttcaccggaagtggcgtctacccagacttatcttccttcaccggaagtggcgtctaccctgacttatcttccttcaccggaagtggcgtcatccaaaatcttcgtagcctgtatcaaacgatccgctcctactcaggttcacatcagggctttagttag

SEQ ID NO: 56472 - DNA, 501 bp, Glycine max
  Peptide Sequence Number=SeqID_148157
atggagagaagtatgatagatgctgccagtggtggagcccttggagacatgacccctgctgaagccaggaatttaattgagaagatggcttccaactcccaacagtttagcgccaaaaatgatgctatagtcattagaggagtgcatgaggtagctacaaactcatttgcatcatctgaaactaagaagcttgaagacctttgcccttctgtgcagcaatctggagcaattgaacagcctgaagcttatgctgcaaacatcaacaatagacctcctcaacctcaacaacaaaatctgccacaacagaaaaattatgacctctccagcaataggtacaatcccaggtggaggaatcattccaaccttagatggtcgagtcctccacaacaacaacaacaacaacaacaaccttattttcagaatgctgctggccaaagcaggccatatgttcctccaccaatccaacagcaacaacaacaacagcaacagccccagaaatag

SEQ ID NO: 56473 - DNA, 71 bp, Glycine max
  Peptide Sequence Number=SeqID_148158
aatcaagaagattcaagtgaagattcaagagaagactcaagatatgcaagaacttcaagaaaaacatcaag

SEQ ID NO: 56474 - DNA, 243 bp, Glycine max
  Peptide Sequence Number=SeqID_148159
atgaggatgggcctatttgctcttactttgaacaggagtcaagaacttccccgattgctagccaaggccaaagcaatggcggacacctactccgcccccaaggagatccacggacttcccagctattcatgcattgcccgcccccccccctcctttgtcacgggaagtcggaaagaccatatcaccttcttaattgtacacatggggcactgcgcccccaaatgcgcaagtaagaagagataa

SEQ ID NO: 56475 - DNA, 261 bp, Glycine max
  Peptide Sequence Number=SeqID_148160
atgggggtgcaaatagcacccaggcccacttgggccctccagaaggctgttgcttctggaggaagcaacctggctcgcctgggcgagctgggcggcaaccacctcccctattttgctataaataggggaggaagtgaagaagaaaaggccgaggcgcttccgaaacgtttccgtaacgttttccgtgaagaatttcgcgaaggtttcgaccgttcttcgacgttcttcattcgttcttcatcgttcttcgatcttcaacgg

SEQ ID NO: 56476 - DNA, 452 bp, Glycine max
  Peptide Sequence Number=SeqID_148161
gtcgactctagaggatccccctgttgcacaacaactacatgatccacgcacagcaattacccataatgttacagggctaggtgttgaacaaacacattttgaaattccacatccttggtccatgtattctactccttcacctgttcatcaaacttttggccacactagcgagtcagtcaccgcaaccacccatgaatggatgaccgatttatttggcgtcgatttcaatacaccaaattcagtggcatcatatttagctactttacaacagtttgatgcaccacatttatttggagaacaaggtcaaagttcttcaactgcaacaaccaacattgaaaatactaacacagaacaacaacatcatcatgacgtgggagaaccagtcatactggaaagaagaaatctgcgacgtaatcgtcgtccaccaccttgtgggactggtcatcgtcttg

SEQ ID NO: 56477 - DNA, 867 bp, Glycine max
  Peptide Sequence Number=SeqID_148162
atgacttttcaagtcatattttcgggtggctttagagtgacttttcaagtcatacaagagggtgtaattctagaaaagtgctggatttacgagcactttccctcggtcacggagtctaccgctgatcaggactacgacgaggcttccccgtgtgcgtgtaggtggattgcgacgaagaagaccgtgaagagctttcgcacgccggcgtatagggagcgcctggaccgactccgaatttcggatgtctgttggatcccatatggggagcatcgggaggtccgagacttccacgtcagatcatgctactccggtctcttgcgttgggggcctgttgctgtgtattaccgaccggagagggtcgtgcgacagtttggttacacgcagaccattcctactcctcctgtcgattcatgggtctcgtatgatgatatacatgacaggtggatgcactacaaggatcatatcgtacctgcaggtgaggtgtgcgtggtgccaggggcgtgttccagtgactacatcgactggttcttccgcatctcccatcctttcatgacaccaggccacgcagtggatcctctacctcatggtcacgccccgcagccccgagttgtccctcaggccccgcagacggatatccctcacgtgtcggagccaggagcatcatcgacatctacggaggagcccagacatgaagtttgtgatgatattgctgagcggttggagcaccatctgagtctaggggtgctcacgcctggctcatcgacacatgaggtgatcgaagaatgcctcagattggccaggagtgtcacacaggaccatctagtatacgttaggtgtagacgcaggcggcgcactgatcaggcttag

SEQ ID NO: 56478 - DNA, 240 bp, Glycine max
  Peptide Sequence Number=SeqID_148163
aatatatcaagggcacctcaaattcattacctgactaccttacccgtgaattcttacagaaaagtggtaatgcctcctaaggcattaggaatctccctaaggggaggacgaagtacaggcaaaggatccagactggcacttccagagccaaccactaagaaatcatcaacctcttatgggtcaccaacccaggctgggtcatctatccggaaaaccaatttagaagggtcatcgacctag

SEQ ID NO: 56479 - DNA, 339 bp, Glycine max
  Peptide Sequence Number=SeqID_148164
atgtcatctattgtttgcagggatcacgcccatgagagacctagtggacccggagaagtccaacaaggccctggggtttccagctctagttacgggcctctgtccgtcctacagggtgcccatcccccagcaaggacatgccatcgtgacatagggatcacgcccacgagacacctagtggacccgaagaagtccaacagggccccggggtttccagctctggttatgggcctctgtccatcctacagggcgcccgtccccccagcaagttcatgccatcgtgacataggtaaggatcacacccgcaagacattcagtggacttggagaagtccaatag

SEQ ID NO: 56480 - DNA, 156 bp, Glycine max
  Peptide Sequence Number=SeqID_148165
atggttgctaacaacagcaacaagtgcgatgatggcagtgctatggtgtgcaaaagtgttaagtcaagaattaatgaaacattgtgcttaatccagattttggttatggacttgaagagggcaaataaagcagcgcttaccttagttaatttctaa

SEQ ID NO: 56481 - DNA, 137 bp, Glycine max
  Peptide Sequence Number=SeqID_148166
atggctccgaaaaagctttccgcgaagagatctaggaaggacaccgtggctgaagggactagtgccacccccgagtttgatagccaccatttcaggagcaccgagcaccagcagcgcttcgaggccatcaaaggatg

SEQ ID NO: 56482 - DNA, 942 bp, Glycine max
  Peptide Sequence Number=SeqID_148167
atggagcgcgcgctaacgcacaaggacgagcaggaagcagcgtccgccgtcgatatgctgatgggcggtgaggcgaacaaaatcctgacgtacatgcgcctgaccggcaagagttacaaagagctgatggatcagcagaagcgttacaacctggtgacgaaggaaggcgcagatggcgctattcgcggcaatatcgcgtttagcaatctgcgcagcgtgtggggggcggccgttgaggaaatcgccggcaagctgggcggatcattggcgccaaaagtgacgcagctggcggacgagctttccgcctggttcaaaaatggcggcatagaaatcatctctaccacgatcaagaacaaatggatcccgaacatggtggaatttgccaacggcatcatgaccgtaacaaagctgtttctggcgattgcccgccgtttgtcctggctattgcctaatgagcagagcgacaaaaaagccattgtgcgctctctcggcaagggagacatcgagggagcgcgtgattttgcgcagtcgcacgggttaggtccttggcttgagtcaattattgcagatccgaagaagcaaaagaccctgcagggaatttaccgcgatacgcaatattccgtgacctctgaacgtgtattcagcccgggcgaatattgggataaggctgatgaccgggcattggcagccattggtgaaacagataagaacgatgatccattagatggtgcgtttgcgtacctttcctcactgatcaatcaaagcaccgccggcgacaagccacaagtgacggataacagccgtaaagagatccacatgaacgtttatgccctgcctggccaggatgcgcaagcggtggcggatagcgcggtttcatcactgaaaaacatggacgtgttcaacggcaataatgcgatgcatgaccctgcggaggcctggtaa

SEQ ID NO: 56483 - DNA, 241 bp, Glycine max
  Peptide Sequence Number=SeqID_148168
atgtttcatcctgcaaattctattacgtcatgtggacataatatatctcatcatgagtcggaactaccaagaaatataagcaatttacatgatgatgaagatgatgatgatgattatcttgcgtctaactcatacgttgaaaagtctttcgatgaagatgatagtgttgatggaatatctgatacagacgatgaagtcaccgacatcgttgaaccagtttcaattgttcacccaactaaag

SEQ ID NO: 56484 - DNA, 410 bp, Glycine max
  Peptide Sequence Number=SeqID_148169
gcaatatagttcctctagacttagaaattgaagctacattgcgaaggaacagggccgagaggagaaggaaacttctgcaagacagaacagttgcatccattcttgaggaagagagtcattcctccgacttattatcacctgattcaccatcatcaagggaatctgtcactcaattacctgaagccattaccatggtagaagagcatgaccagaggattacccttgaggattatgcaagtagttcagtaccacaattttttaccagtattgcacgtcctgaagtgcaagctaacaacatcaactatccacattccttaattcatttaatacagggggacttatttcaaggattacctaatgaagatgatggaatcttgcttgtggggcttctatggaggctggatctttga

SEQ ID NO: 56485 - DNA, 189 bp, Glycine max
  Peptide Sequence Number=SeqID_148170
atgcctaattctaacctaagtaagttcaagttaggcaagatgctaatccatgagaagggaggggacatggcctataatgcatttttgaacaatgggacatgccacattgtccccgttctcttgctattgacgcctaaacgcgcgcccaccaagtgttcggtgaaatgcctcaatggcattagcgcgtga

SEQ ID NO: 56486 - DNA, 216 bp, Glycine max
  Peptide Sequence Number=SeqID_148171
atgcgggggtaccttatggttatccgcatctttcgtcaaccagaggccagcaagcccgttgacacgcagagactaacgttgtcttctgcacctttgtcatctggagacggcgagtccgatgacaggcgggggttttactttcgtcatccagagacatccaagcccgacgacgcaccagattcttctctgctaggcagggacgatcgagttcaatag

SEQ ID NO: 56487 - DNA, 286 bp, Glycine max
  Peptide Sequence Number=SeqID_148172
atgtacatgaatcatgaagatgttgggtgcatgactgattttacaaaagaaggttgcaacactcaacacattcatcatatcacttactttagggatttggtgcctaatgtcgcaacatgcccttttgcgggcgagcgaaggcgtggctcacgggtgcgctttccaaaggaggaaagaagcgcggagtcgccaccaacgtttatttgtgggaaacgtcgaaaaaaccgaaggaaaccggtcgaaatgaaaattctaagttcgggagttgtatttacgtttgaggaag

SEQ ID NO: 56488 - DNA, 366 bp, Glycine max
  Peptide Sequence Number=SeqID_148173
atggattcactcggtgggagttgtcccttcaacgctccaccaaaaactaaaattcatggtggaggggcacttagtcattgtttcgagggaggaggatgttctgaatccctctcgatgcggccccgcatgtctggcgtggcaatgatggtggcctgtgtgatgttagggcataactatgagtctggaatgggcttgggaaagaataatgatgacatgaccagcttagtggacatcaaggaaaaccgcggaaagtttgggctaggctataagcccacgcggactgatgtgagaagaagcatcgtagaaaggaggaacaggggcgcgagcccgcaactaaggccacaagcgagggaggaccctccttga

SEQ ID NO: 56489 - DNA, 300 bp, Glycine max
  Peptide Sequence Number=SeqID_148174
atgaaagtgagcaaaaactatttgaattttcaacactgtactttagaaggtgcagaagtaaacaagtggagatggtttgagagatgtattggagcacagaatgagactcatattcctgttgcaatttctcctgatgagagacctagatatcatgatagaaagggtgatgtctctacaaatgtgttagccgcttgtggtccatatttaaggggaaaagagggtggtggttgccgcccaactcacccaggcgagctgggttgcttccaccagaaggcaccgccttctggtggaagaccctag

SEQ ID NO: 56490 - DNA, 585 bp, Glycine max
  Peptide Sequence Number=SeqID_148175
atggcaaggaaagcccggtcgtcaccattttggccatgtatgacacgttcgaccggggatgtgaaaagagtgacgcaagaattgtttgttgtgcactggctctctatgtgtggctggtttcacacctttttctccaagaaggtaggcccgtctatccgctacaaggtcaccgctcgaaggaagaatcaggattctatcttcatgcgaaggatgtccaaatgttcccttgatggaacaaggggttgtattaattataatcccgtcctcgccataagacagcttggctaccccatgagaggagtgccatcatacgaaagcatcacgcctttcatcgcacggggtttcagtgaccccaatgcgagggacagagagcttaggggaagcagtaatgggagcatcggcggctatcataagtggctgagagtctggacacaaggattggattggctcccaaatctaaagactatgagagatgatgaggttaaagctttggaagaaagtgatgaggtacaagccctaaaggcagagcttgaaagagcccgggtagtcaaagagaagttcaagtccatagccatcaaagtctga

SEQ ID NO: 56491 - DNA, 201 bp, Glycine max
  Peptide Sequence Number=SeqID_148176
atgagattgactgcatatgaatcttcaaggctgtataaagagagggttaaaacttaccatgataaaaaggtgctaaagaagaattttcaaccaggacaacaggttaattacgcgactctgaaaaatgctacttttcaccttctcgctaagccaatctgtaggcttagcgagcgtccgctaagcgcaacactcattagctaa

SEQ ID NO: 56492 - DNA, 309 bp, Glycine max
  Peptide Sequence Number=SeqID_148177
acttatcaaggtaatccttgtggcgtctacccagacttatcttccttcattggaagtggcgtctacccagacttatcttccttaaccggaagtggcgtctacccagacttatcttccttcaccggaagtggcgtctaccctgacttatcttccttcaccggaagtggcgtcatccaaaaactctacagcctgtataaagtgatccgccccgtaaggctaaaggcccaagtggagaaggacgaaggcccaagtggagaaggacaaagcccccgagtggagaaggatgaaggcccaagtggagaaggatga

SEQ ID NO: 56493 - DNA, 210 bp, Glycine max
  Peptide Sequence Number=SeqID_148178
atgctggaagcggcaattgcaaccgcattggcttccattatcttcttcacgctcatcacggcctccatcattgtggccattttctctttaatggcctccatgtcggccttcatcttctcttgtatctcctctacttcacccattactctagctctagcacgatttcgaaatgggtttatgatcccaacatggttggctcatggtgcctaa

SEQ ID NO: 56494 - DNA, 342 bp, Glycine max
  Peptide Sequence Number=SeqID_148179
atgacgaaggggtctgttcttgggttaacccgccattgccaatggcggcaaagctggagagaggctggtatcgttactggtagtggcgatataggtggagagaggctgggactcgctgaccgtgatggcgagatagggcaagggcaatctcgccggttcaaagctagctgtaggttgcgcatgctctccttgttcatgatgagactaaacataaggtctgaaatagggcttataactagctgtaaatgttcacagaacacttgcaatgacattgaatacttgcaaaatttcatactgaaagagagtaagaaactgaagagaggaagaaagaggttcgtttga

SEQ ID NO: 56495 - DNA, 90 bp, Glycine max
  Peptide Sequence Number=SeqID_148180
atgaagaaaacaacaatggaagagaagcttgcttgtggagcttctatggaggctggatctttgagcttcaatgaggtccttcaatggtga

SEQ ID NO: 56496 - DNA, 1332 bp, Glycine max
  Peptide Sequence Number=SeqID_148181
atgcctcagattttctttctcaatgggcccaatgccaatctttacggcatggatcgccacggtacttacggcagcgacagtttcgccagcatcggcgagcgctgtcagcagcgcgccgacgcgcacggcctcaggctgcagtttcgtcagagcaaccatgaaggggtgctggtggactggattcaggaagcgcgccagcaggcggacgggctgatcatcaatgccgccggattatcgtaccgatcagtaccgattctggatgcgctgctgatgtttgatggcccgatcatcgaagcacacatgagcaatatctggcagcgcgagtcgtttcgtcatcagtcgctggtgtcgaaagccgccaccggcgtgatcgccgggctgggcgcgctgggagccaagcgcatgacgacgctggtgttttatagcgagttcgacagcttcgaggcgtggtcggcgctgctggcaccacaattaccggatgtcactatctgccgtgccgaccaggtcgaggatgccgatagcgtgcagtttgcgctggcgtggaagccgccgcgcggcttttttgccccgtatcgccagctgaaattgctggtgaatctgggcgcgggcgtcgactcgctggtggggcgcgacgacctgcctgacatcacgatcgtccggctatcggacccggatatggcgcgcatgatggccggttacgtgctgtttgccgtgctgcgttacgcgcgtgacataccggcatttgagcgcgcacagcgtgaacatcgctggcactatctgcatccgcgcgagccggcgtcgattcgcgtgggcgtgttggggctgggcgaactgggtgcgtatgcggcgcgcgaactggcgcgtcagggctttgacgtgcgcggctggtcgcggtcgcccaaagcgctggacggcattcactgcgtcagcggtatgcaggcgctggatgcgtttctgaccagcagcgacattctggtggtgatgctgccgctcacgccgcaaacccacggtttgctggatgcgcagcgtctggcgcggttgccaccgggttgcgcgctgatcaacgtgtcgcgcggcgcgattatcgatcagcccgcgctgaccgcggcgctgcagagcggacagatcgcccacgccacattagacgtgttcgatcgtgagccgctgccgcccgacgatgcgctgtggggcatggagaatgtgctgatcaccccgcatctggcgtcggtggcgatcccggccagcgccgcgcgtcaggtggctgataacatccagcgggtgatgcgcggcgagccggtgctcaaccaggtgtttcccgcgcggggttactga

SEQ ID NO: 56497 - DNA, 337 bp, Glycine max
  Peptide Sequence Number=SeqID_148182
gtgttttgatgataacaaaagatgatgacaaaggtgatgaacaaaaagctcaaagatcaaagaacaactcaagtgaatcaagaacaagtcaagagttcaagaatcaagaagaattcaagactcaagaagaaagcctagaatcaagaatcaagattcaagattcaagatctcaagaatcaagatcaagattcaagactcaagattcaagaatgaagaaaagacccaatcaagataagtacatctacttgggtttgactgagaacaagagagggtacatctcttgtggatcagttctagtggagggtacatccactaggttcaaagagaacaagggagg

SEQ ID NO: 56498 - DNA, 962 bp, Glycine max
  Peptide Sequence Number=SeqID_148183
caccttcagaggactgcatgtcctcaccttcgttagggctacacgccctcacctttggaggactgcatgtcctcaccttcagaggctacacgccctcgccttcagaggactgcacgtcctcaccttcagcgggctacacgccctcgccatcagaggactgcatgtcctcaccttcagagggccacacgccctcgccattagaggaccacacgtcctcaccttcgtagggctacacgccctcacctttagaggaccacacgtcctcaccttcaaagggctacacgccctcgccatcagaggaccacacgtcctcaccttcagagggctacacgccctcgccatcagaggaccacacgtcctgacctttagagggctacacgccctcgccatcagaggactgcatgtcctcaccttcagagggctacacgccctcgccatcagaggactgcatgtcctcaccttcagagggctacacgccctcacctttagaggaccacacgtcctcaccttcagagggttacacgccctcgccatcagaggaccacacgtcctcaccttcgtagggctacatgccctcaccttcagaggactacatgtcctcacctttagagggctacacgcccttggctccgaggactatacgtcctcatcttcagaggactacatagggctacgcgccctcgccttcgtagggctacacgccctcacattccgaggactatgtcctcaccttcagagggctacgcgccctcgccttcgtagggctacacgccctcaccttccgaggactacatgtcctcaccttcagagggctacgcgccctcgccttcgtagggctacacgccttcaccttcctaggactacatgtcctcaccttcagagggctacgcgccctcgccttcgtatggctacacgccctcaccttccgaggactacatgtcctcaccttcagaggacaacat

SEQ ID NO: 56499 - DNA, 119 bp, Glycine max
  Peptide Sequence Number=SeqID_148184
ggggaatacatgtacttgaggtgatgcaatcctatcccgcaagggcattgggtagaagactccaagtagattgggctagagatccaagggaaggccctagggttctcatgaaccttagg

SEQ ID NO: 56500 - DNA, 672 bp, Glycine max
  Peptide Sequence Number=SeqID_148185
atgccgatctccccctgcgaaagggtcgcgcccacaagacactcaatggacccggagaaatccaatagggccctggggtttccagctctggttacgggcctctatcagtcctacagggtgcccgtaccccccggcaaggtcatgccatcgcgacatagggatcgcgcccgcaggacacccagtggacccaaagaagtccaacagggtcctggggtttccaactctaattacgggcctctgtcatcaggcctcctactaactgagctttcatcaagaagtactgcgccccccagaaaggtgcagggcgagacaccacaacagcctggggatggccggcagcgggcaataaacgcaccgccgccacctctagagttcacctcatcgaattcttgcagaccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttctcctgctggattgcgcaccccgaatggcgaacgggacgcgccctggagcggcgcattaagcgcggcgggtgtggtggttacgcgcatcgtgaccgctacacttgccagcgctga

SEQ ID NO: 56501 - DNA, 332 bp, Glycine max
  Peptide Sequence Number=SeqID_148186
gactacacgtcctcaccttcagaggactacacgtcctcgccttcagaggactagacgtcctcgccttcgtagggctacatgccctcacctttagaggactacacgtcctcaccttcagagggtcatgtaccttcaccttcagaggactacacgtcctcgccttcaaagggctgcatgccctcacctttagaggactacctgtcctcgccttcaaaggactacacgcccttacctttagaggactagacgttctcgccttgagaggactacacgtcctcgccttcggagggatgcacgccctcatcttcagaggactatatgtcctcccctag

SEQ ID NO: 56502 - DNA, 669 bp, Glycine max
  Peptide Sequence Number=SeqID_148187
ggcccttcaccaaagcaagctagggtcagaggccatctagtgaagattgacgctgacagcctcaacacattcttagagacacctgtggtgttggcagagggtgagacttttcccccatactccagatactgcaggctgcccacagactacagagagattgaggctgccttatgcataccaagccaagggttcatcttgaatgctaagggctattttgggaggattctcatgaaagatttgactactttagcccagagtttacatgtggtggcacctctaggatccattccttctgttgagcagtttctggagagggtagcctggcttagggcccaaccttctctttacagggaagatgaaggtcccacagcccaggtaccacaacatgtagaggatgagtcatccgaggccaccattctaaagccattcattgtagaggaggaggcaggtgagacacaggttagacatgaagttgctgccactcctgagagatctcttaagggcacttcaaagccccctgcaccagtggtggacctatcctcgcctcagcatgcagtagacccctccactcctatactagagataccagaggacccaaccacaccaatcctgactctgaacacttctccttcagctactccagtacttcatctgaccgatgaggaggat

SEQ ID NO: 56503 - DNA, 969 bp, Glycine max
  Peptide Sequence Number=SeqID_148188
atgcggaggatttcgaatgttcccttgaaagggacaaggggttgcatcaattacaatctcgttcttgcgataaggcaacttggatacccgatgagaggggcaccactagaggaagagctcacacctgtcatttcacgagggttcagtgagaccaacgtggagacgcttcgaaaggtccgcaaagcatgggaagtggtacaaaagaaggacaaagagcacagaggcagtaacaatgggcccattggtggctaccgtgagtggttgaaagcccacatgcaaggtttggattggctcccaagtctaagaaccgctaaaagggaggaagttgaggcaccggaggaagacgaagaggtgcaggctcttaggacagaactcgagcaagctcaaacagtcaaagaaaggttcaaatcagtggctcttaggatccaaaaggagaatgccgaactgagggatgtaaatgtagctaccaccaaggccttggaacaagagaccaagaggagtcgtagggaagagcacggccggaacaagttccgaggggctctgtggggtagcaacagcgagcttaaacttcgaagagaggaaagggaccaatcacgagtagacagtttgatcttaaaagatgaattgaaggcttgctcgaggtccgaaagaagtttgtctcagcggttatgcgagacagagaccaacatgttagctatcatcaccaagtaccaagaagaactaaatctagctgcggcccacgagcatagagtggtggacgagtatgcccgagtgtacgcagaaaaggaggctagaggaagggagatcgactcgttacatcaagaagcaacgatgtggatggaccggtttgcccttaccttgaacgggagttgtcgcaacctacccttcggcgggagggcgacgcgtgactcgcgggatgcgtgttccacgaaaggaatacgcgcggagtcgccaccaacgtttatttga

SEQ ID NO: 56504 - DNA, 372 bp, Glycine max
  Peptide Sequence Number=SeqID_148189
atgttgctaagtagcaatgtcatctatatctgtgtaagagtggacatgttggtgcgcatgatccgcactcgtctctttgcagcggcacgggtgaaatcttgccccagtatgcatagtagcagtgtgatagcctccctctctagttgtgctcgcacagttggccctcctccaatatcagggggtggcccaggaaccgttaaaaggaaactactggtgtggatatggagcccactgaaagtgaggacgcgtagccctctaaaggcgaggacatgtagtcctctagaggtgagggcgtgcagccctctgatggtgaggacgtgtagtcctctcaaggcgaggacgtgtagtcctctcaacggtgagggtaactag

SEQ ID NO: 56505 - DNA, 327 bp, Glycine max
  Peptide Sequence Number=SeqID_148190
atgcaaagaaaggacagagagcttaggggaagcagtaatgggatcatcgacgactatcataagtggctgagagtccggacacaaggattggattggctcccaaatctaaagactgtgagagacgatgaggttaaagcttcggaagaaagtgatgagctgaagccttggaacgagaaaccaagaaggcccgaaaggaagaacacgaccaaaacaagttttgaggggctttatagggcagcaatagtgagctcaagctccgaagaggtgaaaggaatcatcacgggtcaaaggaatgatctggaaggacgagctaaaggcttgccttag

SEQ ID NO: 56506 - DNA, 582 bp, Glycine max
  Peptide Sequence Number=SeqID_148191
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccccacctttcagaacgcagctgcaaccctcgacctcgaagctccaacacagcgcgacccctgcaaccagcgatgacccatggagtgaacggcggcgacgagcacggcagcgatcgcccacggcaacgcgaacgggtaccgagctcgaattcgtaa

SEQ ID NO: 56507 - DNA, 784 bp, Glycine max
  Peptide Sequence Number=SeqID_148192
aagctgaaggaagctgcacagtcaggaagcatggatggcgtcatcgaccttccatcccccgtcaaacgccacgtgaagtggaagatggcccgcaccaagaaaacaagggaaatgacgactgaggccgcaaaggaaatcgctgacaagatcggaaattcctttgaggagcaggcgtcacagggatccttcatcccccatggatgtcaggatgttctcaccgctgctattggatgtttagagcaccctggacgtgtctgtgctagtagaggaccagctagaggagtcgatcaaagaaaaagtgactcggcaactcatggcatcattcagccagatgcagtcccagttttagtcccagatgcaatctcaggcactgccttcgaagcctctggaaatgatcctgagacaagtgactcagataggtgcggcttgtacatcgaagcacatcctacccgcctggttgccctgggaagagtttatgagagattcattgttgttcataacactcttttgttgtctggccaagtaaaggtgggcaattcacaccttccttgcttgtccgacacatctggtcaagcctttatcacagcagttgtgtctccggcaaaaccacctcaaaagccggatccgaaggtcgatgatccgctttatctaatgacattgaccatcccaaagcttttcttgaggccttaccaggttacatgggatgccaccatgttcggggtctttaatccagacttcccactctacataaagcacaaagatctctccaaaatcgcacatggtg

SEQ ID NO: 56508 - DNA, 219 bp, Glycine max
  Peptide Sequence Number=SeqID_148193
atgtcccatgctgttaaagataatcgaggaaaatgggccccgaattatgaaggacctttcatggtgaaaagagctttttctgggggtgctctgatactcacccgtgaactccgatggattcccattcactgtatttgtctcatttctttgaaaagaaaagatgggcgaggtttcagtcctccctttggtttcaaaccttgtgttttagatttgttataa

SEQ ID NO: 56509 - DNA, 261 bp, Glycine max
  Peptide Sequence Number=SeqID_148194
atgggtgccaagtacctcgaagtggtcaaacgaaagttgcatcccaacaatggatggtccccggacgaaattaggacgcagaatgaccataattcgtctctgcgttttgttggacacgatcgagcctgggcggcaagacacagaatgactataatttgtctttacgtgccaccagacacgatcgcctctggatggcgaaaaggtgcgcagaatgaccataatttgtccccgcgcatttaccacccaacttgttgttcctga

SEQ ID NO: 56510 - DNA, 537 bp, Glycine max
  Peptide Sequence Number=SeqID_148195
atgtttcattctgcaaattctcttacatcatgtggaaataatttatctaataatgaggcacaaccgccaataaatgtgagcaatttacatggtgatgaagatgatgatgatgatgattatcttgtgtctaactcatacgtggaagagtctttagacaaagatgatagtattgacggtatatctgatacagatgatgaagtcaccggcatgattcaaccagtaagaattgttcacccagtagaaggtgtacaaggaattcaaaatccattttggaatgatgttttgcattataataatatcaactggagtcatccggatgatgaggacatttgtggtttggagatgccatcgagttttaatgttggccaagaattatatgttggcataaattttgatagtaaagatgtggtcaagaatgcagtcaaacaatatgttatgaaggtgcatcaaagtttcaaagtggttgaaagcaaatcgaacaagcatgatcagagaagatccatcaataaaagtttctttgattcaagagaggcttaa

SEQ ID NO: 56511 - DNA, 411 bp, Glycine max
  Peptide Sequence Number=SeqID_148196
atgacattgctacttagcaacattctgcccagcgaccgcaatgccaatctccccctgcaaaagtatcagttggtctgtgtcgtcccgacttggggatcgcacccacaaagacacctagtggacctgaagaagtccaacagggccgtggggtttccagctctggttacgggcctctatcagtcctacagggtgcccgtacccccccagcaaggtcacgtcatcatagggatcgtgcctgcaagacacccagtggacccgaagaagtccaacagggtcttggagttgtcaagctctaattacgggtctctcaagggcatcaggccccctactaatcgagctttcatcaagaagtactgcgtctccaggcaggcgcagggcgaaacaccacatcagcattgggatggccggtag

SEQ ID NO: 56512 - DNA, 569 bp, Glycine max
  Peptide Sequence Number=SeqID_148197
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatcccccaaatggtttggttcaggctgagctttgggggttgtatgaagagttaaagcttgcatttagtaaaggtctgaggcttattaaaggaattcaacaacttttggctcaggagtggacaattaaacttgttagtatcttcaaggaggctaacaagtgtgtagatgctattgctaatgaagcatgtgagatgggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 56513 - DNA, 525 bp, Glycine max
  Peptide Sequence Number=SeqID_148198
atggcccaacctctacctcgtgagaggactcttagggagacggctgcacctgatttcacttatgaaaacttgtgcattcaatatcctgataagggtgttccatatgttctcaagactggactagtacatttgctgcccaagtttcatggtcttgcaggtgaagatcctcataagcatcttaaggagttccatattgtttgttccaccatgaatccccctgatgtcaaggaagatcatatctttctaaaggcttttcctcattctctagagggagtggcaaaagattggttctactaccttgctcccagatcatgcaacttagtgggacttagcaacattgagaggagtatgattgatgctgccagtggtgaagctcttggaaatatgacccctgctgaggctaggaatttgattgagaagatggcttccaacacccaacaattcattgcaagaaatgatgctattcatcttcatctactgaaaataaaaagcttgaaggaaaacttgatgccttggtcaacctag

SEQ ID NO: 56514 - DNA, 444 bp, Glycine max
  Peptide Sequence Number=SeqID_148199
atggcttgcttggaccagcagcattctggaaaggagggacagactgttgttgttatggaggacttgtccatctcagatttggatgattccttcaacctagattgtatctattgcatgaaaggtcataattattctgctgttgttggttttgctgctgaggagatgaagatgaatagcatcatttcttgcaatgaattgttgggtgttggaagccatcttctcaatcaaattcctagcctcagcaggggtcatatttccaagagcttcaccactggcagcatcaatcatactcctctcaatgttgctaagtccctcatagaaatattgaagaaggagttgctcagaaatcaggtggtgaggacagcttgcacacaatttgttgaatcattcctagtactcatacaagctttcaccactaagttgcatgatctgggagcaaggtag

SEQ ID NO: 56515 - DNA, 468 bp, Glycine max
  Peptide Sequence Number=SeqID_148200
atggctccgaagaaactctccacgaagaggtctagaagagacgccataggagaagggtccagtaccgccccagagtttgatagtcatcgtttccgaagtgccgagcaccagcagcgcttcgaggccattaggggatggtcgttccacagggagaggcgtgtccatctcagggaggatgagtatatggactttcatgaggagatagctcgcagacgttggacaccgctggtgactcccatggccaagtttgaccctgagatagtcctagagttctatgctaatgcttggcccatggaggagggagttcgagacatgcgttcgtgggtgaggggtcagtggattccctttgacgcagatgccctcaaccagttcctgggtgacccgctggttttggaggaaggccagcagtgtgagttcagccagaggaggaacaaggctgacgggttcggtgatgaagccattgcctag

SEQ ID NO: 56516 - DNA, 159 bp, Glycine max
  Peptide Sequence Number=SeqID_148201
atgcatattgttgtggtaaaacaggggcgggatcatcttgagctaccttctggggtggggacaaaacatgaacagcagaaaccaaccaaggtacttaggaacggatacaactggggatggggtcacgaccgactgatcgtcgccccttctctgcgctaa

SEQ ID NO: 56517 - DNA, 186 bp, Glycine max
  Peptide Sequence Number=SeqID_148202
atggaaaaagaaaaacatgcctcctatagtagtcatgactcttgcaagagcctaagtgaagaacttagtgactattatagaggaagacataggtcacatcctaaacctcactcccataggagagaaaaggaaagaaaacctcaagaggctaacattaacctttcatacttccatgggaagaacaat

SEQ ID NO: 56518 - DNA, 176 bp, Glycine max
  misc_feature (150)..(150): n is a, c, g, or t
  Peptide Sequence Number=SeqID_148203
agatgcttatgcgatgcatgatatgaatgcattttacgaacacgagagcccggaaaattatctcttcttacttgcgcatttgggggcgcagtgccccatgtgtacaattaagaaggtgtctgccatcgccttggcattggctaacaatcnggggaagttcttgactcccgttcaag

SEQ ID NO: 56519 - DNA, 153 bp, Glycine max
  Peptide Sequence Number=SeqID_148204
atgaggaagactctggaagaagatgagcggtacaggttcactaagcgcaccgcttcagttcatccgctaagccaaaaatcactaatgtgcgctaagcggtccatacatctgcagagaccagagcatgaagcaggagccggtttgagagcttga

SEQ ID NO: 56520 - DNA, 195 bp, Glycine max
  Peptide Sequence Number=SeqID_148205
atgtccatccaatcaactttagatgatattgataaattaaatatggataaagatgaggatgattatgtgccacaaccatcaaccaacaccatggaagatgtgaatccaaatgaaagtaatatgggtgatgagtctcattcttttgatgaagaaggatcacctaaagttgacccaacattaacttcttggatataa

SEQ ID NO: 56521 - DNA, 372 bp, Glycine max
  Peptide Sequence Number=SeqID_148206
atggataatgaagagggcgtgcaagaacagatgaaggccgacctatcggccttaaaagatcaaatggcttctatcacggaggtcgtgctaaaacttcagaaaactatagaagataattccatgacggccgcctccaatacagctagggaagcggaaccggtgctacagcccgcaataaacttgggccgagacagaaacatgacggtgttaggtcggaggtatagtcctcaagcctacccttatgatttgccttcggacttcactccccgtaccgctccggatgatttgagccaagcccctaccttcgtggggcaactccctccttatgccgactatcccttcaagaagatgatgaaggagatgcccatctag

SEQ ID NO: 56522 - DNA, 262 bp, Glycine max
  Peptide Sequence Number=SeqID_148207
atgacatcttcgtcgtcatgctcatcaagtatacaaacgaggtctggtccaattgagggtgacgttttgtggatgcaacccaagcatgtttcagaacatgtttggaatggggaaccagacagaaaactacacatcagacgagcaatcccgacgtatcaaggtgaagaacaaataccagaggaaattgttcctctgcttcggcaatgtgggttttattggataattaagatgggatacctaaagataaatgcggccttaatta

SEQ ID NO: 56523 - DNA, 393 bp, Glycine max
  Peptide Sequence Number=SeqID_148208
atggaggtcaacacggctacagtcgttgccgcaagtaccgccactaaggtggacctaactcacccatctggcctcaatcattttagaacaagcattccttcccaccatacaccacccaatgttgcacacactcccgatgagaatgtcaataactccactcccatacttattgaaagccaacaaccccaatttggtcaggcacaggtccctcaacccataggggagacacatgaagtaccccgagaccacactctagccgactttgagccttgcctcggatatgctattaaggagcaagcatttggtggcgtacccctactaaacactttggggggccctcagtatcacccacaaccacaaaccttgcattttgtagtgggtgggatcctctag

SEQ ID NO: 56524 - DNA, 376 bp, Glycine max
  Peptide Sequence Number=SeqID_148209
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaaactgaaaaggacaagtttttggtgactgcgctcctccaagccagttacctcggttcaaagagttgggtagctcagagaaccttcgaaaaaaccgccctgcaagggg

SEQ ID NO: 56525 - DNA, 942 bp, Glycine max
  Peptide Sequence Number=SeqID_148210
atgggatcaagtcaaaagccttcgtttaaaaagaggttctatcaagtcaaaatcaagagcttagaggtcactagtttacgagagttggggcaattgatgggtcaacttcaacggcaagccttccgcaaagcctatggtaagatttgggacctagctagggtagaagtctccacagagtccattgcctcccttgcccagtattatgatcatccgttgaggtgcttcacttttggggacttccaactatcacccatggtggaagaattcgaagaaatcctaggatgtcctctagggggaaggaaaccatacctcttctcagggttctatccctcattagctagaatttctaaaatattccaaatcttggcgaaggaattagaccaccaaaagcaagtcgaaaatggggtggtcgggataccgagaaaatgtttggaggcaaaagcaagaatcttggcaggtagaaatgaatgtgccccgtttatagacgttatcgcactgttgatctttggaggagtcctcttttcgaatgtggatgggttggtggacctggcagcgatcgacgcttttctcgcctatcataaccacaaggaaagcccggttgtcgctatgctagccgacctatatgacacgttcgaccggggatgtgaaaagagcagcgcaagaattgtttgttgtgcactggctctctatgtgtggttagtttcacacctttttctccaagaaggtaggcccgtctatccgctacaaggtcaccgctcgtgcgtcgaaaaaggaaaggcgaattgggaccaactcttggctagcatggaggggcgtctgttaattggttccctcgctagaaggaaggaagaattaggattgtatcttcatgcgaaggatgtccaaatgttccctggatgggaacatggggttgtattaattataatcctgtgctcgccataa

SEQ ID NO: 56526 - DNA, 654 bp, Glycine max
  Peptide Sequence Number=SeqID_148211
atggccagtcaaggagattgggtcccgtttatggatgtgttagcattgctaatttttggggtcgtcctctttccaaacgtagatggtttggtggacctagcagcaattgacgctttccttgcataccaccatagcaaggaaagtctggtgcaagacacgaggcatccatgtccgctccaaagccatcgctcgtgtactgaaaagagaagaatagattgggaccagcttttggctgggataggaggtagaacaatcaattggttcccccgatggaaggaaggaaaggagggagtccttttctcatgtggagggtacccaaacattccgctgataggaacgaggggttgtattaactacaatcccgcgctcgctataagacaactagggtaccccatgaggggagcaccgatggaagaaagcatgtctcctttccttgtgagggatttcggcgcgcaaaatttcaaggctatacaaagaatccataaggcatgggaaaccccgttaaggaaagatcaagaacttaggggcattcgtaatggcatcattggtggttaccatgaatggctgaaagttcatatacgaggtttagattggctcgccaagttaaaactcgtcagcgaagagagttttgaagcaccggaagaggacgaagaa

SEQ ID NO: 56527 - DNA, 201 bp, Glycine max
  Peptide Sequence Number=SeqID_148212
atgcggggggcaaacgagcccgttggcgcacgaaccgatattcgtccttctgcaccttttgtcgtcgttgaccgtgaaatcaaggtgacatgcggggttaccttatggttacccgcacctttggtcaaccacgggcaaagaatccgttggcgcgtggagaactacatcgtcttttgctccttttgtcgtcctgacccatga

SEQ ID NO: 56528 - DNA, 261 bp, Glycine max
  Peptide Sequence Number=SeqID_148213
atgaattgcgttttcgttcatgcatcctccacccatgagtttggagcaatgcgtagtgattgcttagtgcaattctccattctcaacccttatcgcagccgcatgaattgcgttttccttcatgcgtcctccacccacgattttggagtcatgcgtagtgattgcttagtgcaattctccattctcaaccctttttcggagcaccatgaattgtgttttcgttcatgtgtcctccacccacgactttggagccatgcgtag

SEQ ID NO: 56529 - DNA, 252 bp, Glycine max
  Peptide Sequence Number=SeqID_148214
atgagtgatggattttgcggtactcatttgcagatcatggttaggactagaggattaggtcgtgccttaagtcaggtcactggcagaggtctggacagaggagatcgtgatgattccgatgatgctccgcagcgtcgacggcctactgcatccgcatggaggcagcgagtcgctgtgactgtggatcacgtcgatgagccagtcatccctgcgcctgatgttcaggatgacccgatggaggcaccaactgct

SEQ ID NO: 56530 - DNA, 1178 bp, Glycine max
  Peptide Sequence Number=SeqID_148215
atggaggtggaaaccttagaggatcgtatcacttgggagttaggatataacgtccgcactaagttcctcggagacgacatggttcttctccctgggatgtccgatgacaaagctaaactcctcattcaatcagagacggaaagcgatgattctctcttttactcactggagaagtggacgccgaaatgtagacccaataacagggttgtttggctccagctgtggggatttccgatacaggtgtgggaaatgaaaaatctcaggagggctgtagctgctattggggatgtcatcgagtcagacgatgacacagaggaccgccgacgattggaccgggctcgagtattggtgcagacaccgcttccgccgttgataaggtcagaggtcatcgtccgtgtgggggagcttgagtatcgggtatggattgtggaagagacagggttcgaaggtgggtcgaaccggaaaggaagctcgccgtccgatgggtggtcggagatgataacatcggacgacggtggggaggttggcgatgttcttgacgacactaataccaatttctccttctcgccggagctgcccaaccagaaattgtctccgtctcgtacccaacgggcagaaggagggaccgatgtgcgctgttgtgatcttagacccctgggtaatatccaggcagacgttacacccaaagaaaagtcaaaaggcactgtagaaggtatgctgggctctagctttggtaagctcaacctaggggacagcttcgcaggaacagaagaggaagctgctaacaccaaagaggtaacctgctataataccctacatgatgatcgaaggcacaggaatcacatagagggaaagtatttgaatggtggagcgaaagtagctgctgaccagacctttatcggggaagaagagggacatgtcacgcagtctctctctccttctttatcggggcagattcaacaaggaattgggccaggttgcattaagggcccaatttcgactcaaggagggtgtaataaagaagacatccacccagttgagcttttgggggtgcaagctgtgcagaataaaaaagagggtgggctaagtaatgatttaggcccaattttgaaaactgacgggtgccataagaaggaatccctacctgtaatccaatccataaaagagactccagacaa

SEQ ID NO: 56531 - DNA, 522 bp, Glycine max
  Peptide Sequence Number=SeqID_148216
atgaaaagagaaaaacatgcctcttatagtagtcataactcttgcaaaagcctaagtgaagaacttcgtgactattacgaaggaaggcataggtcacatcttagacctcactcccatagaagagaaaaggaaagaaagcctcaagaggctaacattaaactctcatacttccatgggaaggacaatgtagaggctaacatagattgggaaataagggtagagcaacaacttaaaaagaagacacattacttctcaatgccccaccacaaaaaccatgattatgagggccaagacatttatagtagccaagatgaggctactacttcaccttcctctagtgaaagtgaaaaagcaaaaggggaagaatctagtgaagaaatctacccccaagaagaaggacaaccattagtggttaaagagaagtgtaaggaggcacttgctagcattgccacacctcttgggcttgagtttattcctcaagtaaagaagttgttggatgatggtttgggacccattaggtag

SEQ ID NO: 56532 - DNA, 79 bp, Glycine max
  Peptide Sequence Number=SeqID_148217
atggataactcagagccctccactggggcaatgaaaggctccattcgtgatcctcaagcgtcctatggaccatcaaaag

SEQ ID NO: 56533 - DNA, 453 bp, Glycine max
  Peptide Sequence Number=SeqID_148218
atgaggaaacaagaagttattttacatggaatctggaaatggaacgtgtattggctgatgtacttagagatcaaaggaatttgtgcaacaagggtggcggaggttggaaaagatagagccaccggtcatggagctgaaactgctatggatgctgatgaagcgatgagtagagaaacaaatgaagtggaattcatggggttaggtgctactgccatagatttagaagaaccaagctctaatacaaaaggaaaaaaacaaggttcgacctcttctggcacacatcctcacaagagaaagatgggagaaaaagaaggaataatagcttctttggataaaatggcaaactcttttaaccgaatggtagaaaaaatggatggtaaagttgatgacgaagatattcaagaagtattacgtgaggcaactttgataccagatcttaatagacaacaatga

SEQ ID NO: 56534 - DNA, 540 bp, Glycine max
  Peptide Sequence Number=SeqID_148219
atggtggcgcgtgttatgctcaggaacggatttgagcccggaatgggtctaggcaaggactgccttgggaatgccgatgtggtcgatatcaagggaaatccatacaagtatggattagggtatgaacccgggatgccggggaggaggaacgtgccgtcaagatttcgggcggatagggtatggcccgaccgtattagccagtgtttcaccagcgctggaatggtgtccgaggaggaggtggccacaatagaagaggagttccctcaagacccaccaagttttgtgcaaccatgcgaccccgattcccaagtggggaactggcacatgataagccagtcagaagtctataccgctgattcaatatatgagggtcgattctttgagggtcctaacaacgagggtttgaaaatcgatttcgatcgagatataagccaaaagataaacgaggaagaggaagaggacgtcctgtcaccagagttggagaggttggttgctcaggaagaacgtgaaatgaagcctcaccaagaagaaaccgaatag

SEQ ID NO: 56535 - DNA, 324 bp, Glycine max
  Peptide Sequence Number=SeqID_148220
atggaggtttatcaggtgccggaaatcatggaggagagaagagagagaaagagagagagagagacctttttctttgaggaatctgcgacagtcttcgcgagtgagctgagaaatgtcatcctcggtgagctggttgaggggcttgtcgaggatggatcggaaggtggcggtggtggcaccgccgttcatggcctccgattccggcacccgctcgtcggtgggaccatcaattttgtagagagtgtggttgttgttcagcgtttgggttggggggaaatgggggaaggctgggagggcttttttaggacttggggtgaaccctaa

SEQ ID NO: 56536 - DNA, 1473 bp, Glycine max
  Peptide Sequence Number=SeqID_148221
atgtccaagacacgtgttcgtacagggatgcgcaggccttcctggaacaaatcgcaggcgatccaacaggtcatttccctgaaagcgctgctggaaccttccgacgatgatactcctcctcctaccgccatgcaccaccgtagtcatgctcctccccctccacctcaacctcaatctcaagtgaatttgactgaacctcctcctccgcccaaggctccgccacctgaagaatcctcttttcatgctgctgaagacattcagaaacctgcgtcgtctggggaaaaaccttcggaaactaatgacaccaacaccaacgttgctagccccaattcagtgaagagtgaaggttgtggactagagggactagataggaggatttgggtggttaaaactttaaatgttacggtgaatgtctatgatggagtctcgcctgataaggcacgagcaatcatgcagcttgcggtgagtcctgtccagtttactcaagatgatccttcaaatggaaatgcagctgtttggccttctccttgccacttaccaatggataaggatgtcctcattcctgtagatacaacaatccttcaggttgctcaatcagataagatgatggaatatcctctgcaatatagagagaaaggtagcatagctcgtgatgctgagggtcaggcaagcagaaaagtgtcattgcagcgatatcttgaaaagcgtaaggacagggggagattgaaaggcaagaaattgactgggataacttcatctaacttcgagatgtatttgaaccttccagtgaaggtccatgcctcaaatgggaattcaagccgtagcagtactagctctccaccacagcctagactgcctctagtatctagtggttcagctgacaaccagctaaaggttgcccttcccattgatctcaatgacaaagttgggacattacaggcatggttgatggacgaaagcaatgaagatccaagactccctcaccgccgcaatcccaacaagtcagtttcattggaccaattagcagaatttggggtgttatactggaagctgaatccaactatctatgagaacgatgaagagttggccaagattagagaagataggggatacaactacatggacctgcttgatttatgcccagaaaaggtggaaaattatgaacagaagttgaagaacttctacactgagcacattcatcaggatgaagagattcgttattgtttagaaggaagtggctactttgatgtgcgagacaaggatgatcgctggattcgcattttgatcaaggccggtgatcttatcattttacccgctggaatctatcatcgcttcaccctagacccaagtaactatgtgaagggcgagccagtgtggacagcatataatcgaccacaggaagacaatcctgctagaaaggaatacattaagggcctgactgagaaatttggagtgccacttgcaactcattag

SEQ ID NO: 56537 - DNA, 1032 bp, Glycine max
  Peptide Sequence Number=SeqID_148222
atgttggctgttttcgacaaatcggtggcaaaaagcccagagggtctgcagagccctcactcagattccgtctcagccctaaaagacggttttatcgcagaacacttctcttccgttcaccctggttccgtcaccgtcaaccttggctcttccggtctcttggcctattcccttcacagacagaacccccttctcccaaggctgtttgcagttgtggacgacattttctgtttgtttcaaggtcaccttgagaatgttgccaaccttaagcaacaatatggattgaacaaaacagcaactgaggtgatcattatcatagaggcatacaggactctaagagatcgtggtccctatcctgctgctcaggttgtgagagatttccaaggcaaatttgcatttattctgtatgacagtggttctaagaccgcatttgttgctgcggatgctgatgggagtgttccctttgtctggggaactgatgctgatggaaatctcattttttcagatgagacagagatcgtaactaagagctgtgggaaatcttctgcaccattccccaaaggtaataataagacccctttgttgaacatttcttgtgagatcactcctttaaaaatcatccaagcaaacacgagaatggagacacgcatggaagccatggagaaggctatagaggagaatcgtgaagcggttgaggcgagactgagttcgatagaagggatgatacaacgattagcagcatcatgggagaaaaaacctcctgaatcgaatggagaagatcctatgggctggttaacaaagacagaaaggtatttccggttgcaagctgtaagagaagaggataagcttgaagtagtgatggttgccatggacggagaagctctagggtggttccaatggtgggaatcctggaacccaaaccattcttgggaagggttcaagatcacaatctcccaaaggtttcaagcatctaacttggggaatccttttcaggcgttgctagcgttggaacatgaagaaacagtgcaataa

SEQ ID NO: 56538 - DNA, 216 bp, Glycine max
  Peptide Sequence Number=SeqID_148223
atgtcggacatttggatattcaatggatttttcttttcaacatccggaggtttgagcagttttgagcatccacttaatgaggtgaagcctgtaccaagggttgacagttctggacaggtgtgtggtgcaactttcaaggtggatgctgaggctaagaaggaagcaactggcatgccaagggttgggagtgctgctaactggtcgaataatatctga

SEQ ID NO: 56539 - DNA, 288 bp, Glycine max
  Peptide Sequence Number=SeqID_148224
atggatagtatcaacgagtctgcaaaggttattaccttttgtgcggtgtcgttttgttcgcgctcaccgcaaccaccgctatcagagaaggaagccttacttctttggcaatggcggtggcgcgcgacgaagtcaacaccctcactcgccatcaacgctaaagtcgagtacaacaatgacaacaagcacgaaagcgaagacgagggagaccgcgagatcgacgacgagggagattgcgagagcgatggtgaaggacatcgcgagagtggcaacaagggacaacactag

SEQ ID NO: 56540 - DNA, 171 bp, Glycine max
  Peptide Sequence Number=SeqID_148225
atggcaatggcaatggcaatggtaatggctttgggcgtatacaggggcccacgtttctgggaaggaggccaagagatctacattgatgatgactttggtttcagatcatgtcatgatgataatacttggctttgttgggtggggtacatgctgtctacgtggcttcggtag

SEQ ID NO: 56541 - DNA, 471 bp, Glycine max
  Peptide Sequence Number=SeqID_148226
atgcgccaagactggatgatccagcttcagatatgttatgtgtacctatatagatctggattagatggctggaagcctgaaagtgtgaaaataaatggttataacggcaggcctgttactttctattacaacacatatatccccagagatacgtggtatggatttaatttgtgcaacggtgcttcttcttcttcttcataccaggtatctatgcagaaatggcttatatttatggttctaggatttgttcttagctgttggtttttcattttgaccaacaatggtcaaacatttcatgaattcgttgcttctgaattgtttaagcaactaatgagtttatttccagggtcatcagatgctataataagacaaaagaaggggctagggggattgcttttctacactaattcaattacatcgaagatgatatctctggctagagttgcaattgttggagtatcgatattctga

SEQ ID NO: 56542 - DNA, 297 bp, Glycine max
  Peptide Sequence Number=SeqID_148227
atgagaaatccacaaggtaaatgggagagggctttgagaggaagtgcttcaccaggaaacaaagaaggaggaaacatggtagcacaaaatggaacagtaggtcccagttttgcacaagtaagaatgcttcaattaagaaggggggattgcatggaagagaggaacatggttttggttggaaatggcttccattatgtgatcatagcagttatggtgatatggtcttctgcacaagaagtagagttgtttctgttgttcacaaaggatactcgacttcctcatttcttcagtctctag

SEQ ID NO: 56543 - DNA, 441 bp, Glycine max
  Peptide Sequence Number=SeqID_148228
atgaggggaacggttttctacgttgctccagagtatggctacaatggggatgcgtctgagaagtgtgacgtgtacagcttcggggtattgttgctagtgattgtttcggggaggaggccgcttgaggtgacgggttcgccggtatcggagtttcagcgtgcgaatctggtgtcttgggcgaggcaatgcgcgcggagagggaagcttctggaaatggtggatgagagtgtggaagggatggataaagagcaggctagtatgtgtgtaacggttgcgctaatgtgcttgctaaagtcacctgctcgtcgtccttccatgaaggaggttgtgggaatgctcagtggggagatggagccgccgctgttgccgcctgagtactcgcaacaggccaagttcacgttcaagtcgcgtttgcgttgtggcctagctgttggggattga

SEQ ID NO: 56544 - DNA, 99 bp, Glycine max
  Peptide Sequence Number=SeqID_148229
atggtggtgggttctgttgctactacacttttaccctttgcagcttcatcaagggagggtactacatgcaccctttatatattgttaagctcctcttag

SEQ ID NO: 56545 - DNA, 417 bp, Glycine max
  Peptide Sequence Number=SeqID_148230
atgggtaccgagctcgaattcgtaatcatgaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaaccccccgttcagcccgaccgctgcgcctttatccggtaa

SEQ ID NO: 56546 - DNA, 1155 bp, Glycine max
  Peptide Sequence Number=SeqID_148231
atgtctatgatgtctagcaaagttgatcccttccagcatctcaaactcgtccccaattccgacggcacgatcactcgccagcgtgatgacccacccatctcaccctcactcaatcccacccttcccgtcctcacccaagacgcaaccatcaaccgatcaaacaacaccttcgcccgcatattcctaccccgcgaagcactcgattcctccccctccaacaacctccctctcgtcgtttacttccacggcggcggcttcgtcctcttcagcgccgcctctgacttcttccacgacgcatgcgtaaacctcgcagacgacaccaactccatcgtcgtttccgtggagtaccgcctcgcaccggaacacagactccccgcggcgtacgaagatgccgtcgaagcgctgcactggatcaaagcacagtcaaacgattggttgcgcaaccacgcggatttttccaactgttaccttatgggaagtagcgccggagcaaacatcgcgtaccacgtgggtctacgtgtagctgcggagcttaacgtttatggagacaattatctggcgccacttaagatcagagggctgatattgagtcagccgttcttcggaggaacgaagagggtgccttctgaggtgaggcttgtggacgatccggttttgccgccgcacgtgtgtgacttactgtgggagttgtcgctgcccctgggggttgaccgtgatcacgagtattgcaatccgacggctggcgatgggcctgtgattctggatcgggtgaggcagcttgcgtggcgggtgctggtgagtgggtgccatggggacccacttctggatcatcagatggctctggcaagactgatagaggagaagggtgtggctgtggtcacccgttttgaccaagggggatgtcatgggattgaggttcgtgctcagagggagattaaggaagaaagtgaaaatgagttgtttaataatgtaacggaattgaaggttaacaatggcattacggtcattgatgccttctttgtcaatcgtgtagtctttgtaatcacttttgttgttatcgtggtcgttacgtgggaaagacaagggtcaatggtggtgcttcaggattccacacaatgtcgttgtcgtacgtcaattattgtggatgtcacctaa

SEQ ID NO: 56547 - DNA, 445 bp, Glycine max
  Peptide Sequence Number=SeqID_148232
ggctgtcttagcttggctttctattattgcacatcgcaacaaagacaagaagccaggggagaaattgatctctgtatctgacatcgtgacagagcactgggcaacttatggaaggaatttcttctctagatatgactacgaggaatgtgaatctgaaggtgccaataagatgatagaacacctacgagatattgtgtctaagagcaagcctggtgatcagtatggaagttatgtcctccagtttgcagatgattttgcatacactgatcctggtactggttctgcaggggcaactgttagagtgtacattgaacagtttgaaccagatgtctctaaacatgatgttgatgctcaaattgccttaaaaccattaatagatttggcaatatccatgtcaaagctcaaagacttcacagggagggagaagcctacagttatcacataa

SEQ ID NO: 56548 - DNA, 2140 bp, Glycine max
  Peptide Sequence Number=SeqID_148233
caaaggcataagtttaccaattatgggcaaggagtggcatcgggatggaaggtcctccaagagaggtggaggtgctcaaacagaaatcccttccggttgcatgtgtgcaatgtttcaggtatttgattttcatccttttcacttttccattgaccagcaacaatcttctttcaagtctcgcaccccagaagaccacactgtccccaaaggagttgaagcaccaaggagtagcttggagtcagaaactgtgagttatgatgattttgatcacttgtctaatttaatgattcttgaaatgcagaagaacattcgaatcaaaacaagagggagcacaagatcaagaacagaaagttttagtgatttttcctcagaaatcggtgcctctccagggaccaagacaccaactttggttgcaagattgatgggtcttgatcttcttcccgatgcacattcctcttcttccccatgcctttccactccaaaccttcacaaaccacagcaacacatcaaaataatcaaacatagaaacagcactggcagtaacgccttgcctgagactcctagaatgtcctctgcaagaagatcagatgttgagcatagacaatctctccaaatcaacaaggagaacaacacagtcccctatgaggattctgagtctcctcggttttcattttcaaagaggaaatatgatgagaacaatttcaggagtccaagccactatgccaggcaaattgtgaaacagattaaagaaagtgtgagcaggaaggttggactagacatcaccaacactgtcaagaacagagaacaaggaagagaagaatctgtaggccaattcaaattcaagaaaaaatctaaaacttcagtgaatgaatccagccctgtaaaacactcaaactcatcttactccccaaggctcaacagattcattgataccaaacacaaaccaagcactacaacacaatcaccaactactccaaaaaatcaaaacatacacatactaaaaccaccatcaacaactactccaaaaaatctaaacacgcactcagtactaaaaccaccatcacctcctcctgttgtcaacattgaaacacagctttcaagagtttctacaaagccaaagcctcaagcatcgcctgagaaagaggtgcataaccaaaaatcagtaacaaaaggcaagaacactggcagtggaaagttgagttcccgggtcaacaagcctccacagacatcaatcagaaacaagcaagaagagtcatttattactcgtcctccatcagccactaaagcaaatgacatcaaaaccaaaagcaagagaactcatccactttcaagcaatcttcttaataacctcaacacggttccaaatcttctccctgtcaagacaggaccttctcctcaaaaacaggtacgtgatgatgatgctcgagatgaaagacgcagcgcacagttatttagtagttcgcgcccgacgtacaaacaagaagcgccacgatcacacccaccccgaggagcaaccaccagcagcgatgacgacaaacttcacggcacctccgccaccaccaccggcgcagacgacgacgaaggaccagaatatcagtacattacaagcattctaactcgtagtaccaccactggaccccacaacagcaacagcgctacagcactaataccccacctccagtttcagtggttctctccgacacaccccttggacccttccgtttttcactgtctcgagcactacccaacatccaattcctttgtttccttccccggcgacaacaaagattgcatctttcagcggaaacagcatctgggtccgcgctgcaaccgtagattgctgttcgatttggtcgacgagttgctgtcggagattctggttcggccgaggcgttacagagaggcgttgttggagacgacggtgtgggagagggttcggagattcccacgtgcgaagtgtgaggttttggaggatattgatgcgttgattgagatggaggagatgagggaggaagagaaagaggaagtggaagggttggtgaaagagattgaaaggagcatgtttgagatgttggtggatgaaacgtttaccgttatggttggtggcgtggataaatacgtagaggacgacgtcgtttga

SEQ ID NO: 56549 - DNA, 603 bp, Glycine max
  Peptide Sequence Number=SeqID_148234
atgacagagaagtcaacgaggaagcgaaaaatgggagacacagaggagacggctccgaagaaacccgcggcaaaatggcctctcatcaaacccaaaaagaatcttcagattagccacctcctagatttcgatctcttttcggtccagaatttcttctcctctgctgaatcaaaggcattcgttaaaattgctgaagaaattggttttgctcatcaagggagtcgaggtggcgaagcatacagagataatgatcgaatttcggtggatgatcctgtccttgcagatactatttgggagtctggacttagcaaacttttttctgatattaaaattcgaggaaaggttgctgtaggtctcaatccaaatgttagattctataggtacaaggttggtcagcgctttggacggcattttgatgcaagtgttgatcttggagatggaaaacgcacttattatactctactagtgtatttgagtggtgggcctggtgaacttaaatcaaagcccaaaaatgattccagcaacccctcagtttcatctgttgatcctttagtcggaggagaaacagtgttttatggtcgaagaaataaaactgtggcttag

SEQ ID NO: 56550 - DNA, 267 bp, Glycine max
  Peptide Sequence Number=SeqID_148235
atggtgagagccccacttatccgtatggaagagagggaccctcacgctcagagttctgtatttatttttcacagtgaaattgaatcaatggctggatacactcctcgcgttaactgggccactgggattgtgccacgtagggagtctaggttctactgtgaattcactgttcctgttccagttttgtgcctaattgatgacaatttgcgaatttccatgttaaagaaggaaaaaacatcaaaattttccgtattcgtcgctgggtaa

SEQ ID NO: 56551 - DNA, 1461 bp, Glycine max
  Peptide Sequence Number=SeqID_148236
atggggaagacaggcaaatggcttagaaacttgttgacaacaggtaagaaagacaaggaaaaggagaaatctacaatcaagctgaattcttcttcaaatggaacagaaaactcaaccactccaacttcctcaaccccaaaggagaaaaagagatggagttttagaagatcatcagcctcagccactgccactactgccacaaccacaccaacaacaacttccaaggaattgaattttgtagaaacaaatgtgactgcttcacagacagtgcaaactgacactgatattcagaatgagcagaggaagcatgtcatggctgtggctgcagccactgcagcagcagctgatgctgcagtggcagctgctcaggctgtagctgctgtgatccgtttgacttctacttccaatgcaacatccaaaagtattgaagaggctgctgccattaaaatccaatctgcctttcgctctcacttggcaaaaaaagcattgtgtgctctaagaggattagtgaagttgcaggcactagtaaggggtcacttggtgagaaaacaggccaaggcaacactgagatgcatgcaggctttggtgacagcacaagccagagctcgtgctcagaggatccaaatggggtcagaaggaaaggccaatcaaaagcacagaaatgctgccgaagatgatttgctcaggcatatatataatgaaatggacagaggcttggaagacaacatcaagattgtagagatggatgtttgtgaatcaaaagttaactccagaagcagcagtgtgtatcatcatggacatcaagaacaatatgacaatagattttccacacattattcaacaaatggttcctacacaaaagaagaaaagtacaaggtatcaccggctccatcagcattgacagagtcgagtccaagagcctgcagtggtcattttgatgactgtttcagcacagcacaaagcagccctcaccctcagttctactctgcagtgtcaagatcagaagattcaaagcacccttttgctttccataggccagcttatgcagaatccatgtcctatgactaccctttgtttccaaattacatggctaacaccgaatcatcaagggctaaagtcaggtcacacagtgcaccaaaacaaagaccggattcattcgagaggcaaccaagccggcgaagagcttcagttgagggaagaaatgtcccaaggccaatgaggatgcagagatcatcttcacatgtgggtgccactgtccataactaccattatccttggtcaataaagctcgatagatccgcagtttcactcaaagatagtgagtgtggctctacaatcacgtggagatgggtactgactactgagagtgcaccttgtgctacaccaaatagtagccactttgcaagaacaccaaaatctagagttgagaatttcagtttgctgagtttttctcctttttag

SEQ ID NO: 56552 - DNA, 1092 bp, Glycine max
  Peptide Sequence Number=SeqID_148237
atgccttctacgaaatcttctctgcaagtacaccgcaccaacaatattgccagcactttaagtcttaatttcagaaccaccgcgccgggcgccgcacctggcggcgccggaggcgggaagacggtggggaggtggctcaaggacaggaaggagaagaagaaagaggagaccagggcgcacaatgctcagctccacgcggcggtgtcggtggccggagttgctgcggcagtagctgcaattgccgccgcgaccgctgccacgtccgggactggtaaagatgaggagatggcgaagactgatatggcggtggcgtcggcagcgacgctggtggcggcgcagtgcgtggaggcggcggaggctatgggggcggagcgtgagcaccttgcgtcggtggttagctccgccgtgaatgtgagatccgccggtgatatcatgactctaactgccgcggctgcgacagctttgcgtggggctgccacattgaaagcgagggccctgaaggaagtgtggaatattgcagcagtgattcctgtggagaaaaatttggcagctggtggagttaataacaataatgcaagtaatggaaattctaatagtagcttcagtggtgaacttgtcccagaagaaaatttcttgggtatatgcagtagagaattattagccagaggttgtgaactcctcaaacgcacacgcaaaggtgatcttcactggaaggttgtttctgtgtatataaacaggatgaatcaggttgtattgaaaatgaagagcaggcacgttgctgggaccatcacaaaaaagaaaaagaatttggaggtgggtcttgttccgttttggggatttgtgaaagtcatagctaaagttgtgaaagatcaaaaggatgtggtgcttgaagtgatcaaagatgtacccgcatggcctggtcgccacttgcttgaaggtggtgaggatcgccgctactttgggttgaaaacagtgatgcgtggtgttgtggaatttgaatgcagaaatcaaagagaatataatgtgtggactcaaggtgtttcaaggcttctctccattgcaacagaaaagaacaacaaaaacagaatttga

SEQ ID NO: 56553 - DNA, 2025 bp, Glycine max
  Peptide Sequence Number=SeqID_148238
atgtggtataatgaaagaatatcaaaacataaaaatagtacaagcctgaggttcaacttatgttgtggagatggcaaagttgaacttccattgttacaaaatccacccaaatatctccaccgacttctctttgatcataattcagctgatggtagaaattatcaacaaaacatacacacatataacatgatgtttgcatttacttttgctggtattaagctagacaaatcaattaatcattcgagaggacctcctacaattagaattcagggtcaaccatgtcaccggataggcagtttattaccaatgtctggaaaagaacccaaatttgcacaattatatatctttgacacagataatgaagttcaaaatagcattaatgccatcagccagcatgatggaattcaaccgcaaattgtttcaagtttaggtgaaatgttggatgaacacaatgcgcatgctaaaagttttaggatggctagagatagattggcagatagtgatgtggataatgtcagattaagattgatagctactcgtgaaaaggatggtcgtacatacaatgttccaactgtttcagaagttgctgcacttattgtaggtgattttaatcccaactcaagaagagatattattgttgagactcaaaatggacagttacagagaatacatgaattgcactctagctatctaggcctacaattccctctgcttttcccttatggtgaagatggatataggtctgacatacttcactatgcaacaccagacagcaaaaagagaaagagaaatcgtctcactatgagagagaggtttgcttatagacttcagtctagaccaaatgaagctcaaactttattgcattctagaagactatttcaacaattcattgctgaagcatatacgatggttgaatcggaaagacttaactacatcaggaacaaccaaaagaaactcagagttaacaagtattgtagcttacaaaattcactggatgttgggacaagccaaggtttaaataaaggcaagagagtaatttttccttctacctttgttgggagtccgcactacatggatcagctatattttgatggtatggcgatatgcagccacgttggtttcccaaatctttttatcactttaacatgtaatccaaattggcctgaaatccatagattacttgcaccattgaatttgaaagcagcagatagaccagacattatctcacgagttttcaagttgaaatatgaagaaatgctttcagacctatcaaagaatcacctacttggaaaagcagtggcatacaataaatatccaacttcagatgaaattgatcagattatatcagcagagatacattcaaaggtagatgacccaaaattgtatacattggtgcaaaatcatatggttcatggcccatgtggaattatacgctctgaatctccatgtatgaaagaaggaaagtgtagcagattttatcctaaaatgttccaaccttacactcttttagatgcaaatggttatccagtatatcataggagaaatgatggtcgtacaatttcaaagaatggtgttatcattgataatagacacatcgtaccttataatccaaaattactgaaaaaataccaagtgcatgtcaatattgaatggtgtaatcaaagtacttcaatcaaacatttattcaagtacataaacaaagggtatgacagagtcactgatgttatggtttatgatggcaatgatgaaatccagaatgctaccaaccaaaaagatgagattaaagaatatatagattgcagatacatttctccctgtgaagctgcttggagaatttttggttttccaatacatgctaggaagcctgccgttgaaagattatatttccatcttccagtccaacacaatgttctttatgaggaccatgatgatattgatgatgtcctatccaagccaagcatttcagattccaaatttttagcttggatgaacgccaactgtttacgccccggtgttacttgttaa

SEQ ID NO: 56554 - DNA, 312 bp, Glycine max
  Peptide Sequence Number=SeqID_148239
atggtagaaggagatataatttacaagctcaaggttcaagtaatcaatttcagctcaatatgggtgcaaaggataaatcatttcattcgcaaggaaagtataaatcttgtcaccggtcctgtggtgggtcctgatccatggcatcctcctcatcagtcagattcagcacaagcgtgcctactggtgatccctgcgggttgccatatagggaattggaaaggaggattggtgccataccttgaagaatttgagtcaagaagcaaggggccaaccaccttaagagctattggactaagaagcactccaaattga

SEQ ID NO: 56555 - DNA, 415 bp, Glycine max
  Peptide Sequence Number=SeqID_148240
atggaggaatccaatcgggaaaataacaaagatcacatttcccagtcaagagggtccgctcttgacggtgaagaacacattggagaatggaggaatccaatcgggaaaataacaaagatcacatttcccagtcaagagggtccgctcttgacggtgaagaacacattggagaatggaggattcaatcgggaaaataacaaagatcacatttcccagtcaagagggtccgttcttgacggtgaagaacacattggagaatggaggaattcaatcgggaaaacaacaaatatcacattttccagtcaagagggtccgctcttgacggtgaagaacactttggagaatggagggaatcccatcggagaaaataaaaaatatcacattacccaagtcaagaagggttccgctcttgacg

SEQ ID NO: 56556 - DNA, 128 bp, Glycine max
  Peptide Sequence Number=SeqID_148241
atggcggatgcacttgccactttggcgtccatgttccagctaacaccgcacggggacctgccgtacattgagttctggtgtcatggcagacccgcgcattgtttgtcaggtggaagaggaatgggaca

SEQ ID NO: 56557 - DNA, 115 bp, Glycine max
  Peptide Sequence Number=SeqID_148242
ttgccatattgggaattggaaacgaggattggtgccatcccttgaagaatttgagttaagaaccaaggggccaagcaccttaagagctattgcactaagaagcactccaaattga

SEQ ID NO: 56558 - DNA, 123 bp, Glycine max
  Peptide Sequence Number=SeqID_148243
atggcaagggctagaacaaagaaggtcaaggaagctcttcaacaagtgttaaccatgcccaaacttgtgttaaagtggatgtcaattctcttgggatttgcaccacctatgggcttgttttaa

SEQ ID NO: 56559 - DNA, 254 bp, Glycine max
  Peptide Sequence Number=SeqID_148244
aagcaaagcttcatgatgaatcaagattgattcaaagatgttttgatgatatcaaagatgatgacaatggtgatgagaaaaagctcaaaggaaagttgaagaacacttcaagattcaagaggaaagttgatttcaaggatcaagaatcaagattcaaggatcaagcttccaagaatcaagattcaaggatcaagcttccaagaatcaagatcaagattcaagactcaagattcaagaatcaagagaagacttaa

SEQ ID NO: 56560 - DNA, 492 bp, Glycine max
  Peptide Sequence Number=SeqID_148245
atgactagaggcaatccatctgacttacaaccctttgatcctgagatagataggaaatttcatagattagttaggcatcattttataccttttgatcattctgagcattccattactggtgaatctgtgcattctgttattggtgattttgaacatcctgatcttgagcattataattttgagcattctgattctgagcattctgattttgcacattctgagaacatggcacaacctccaccccgtgagaggactctaagggaaatggctgcacctgatttcacctacgaaagcttgtgcatccaataccctgatgaggatgtcccatatgttcttaaaactggactaattcatttgcttccaaagtttcatggccttgcaggtgaagacctgcacaaacatttgaaagaatttcacattgtctgctcctccatgaaacccccagatgtccaagaggatcacatatttctgaaggcttttccccattcatag

SEQ ID NO: 56561 - DNA, 628 bp, Glycine max
  Peptide Sequence Number=SeqID_148246
gactgatagagcccgtaacagagctggaaaccccagggccctgttggactttttcgggtccactgggtgtcttgtgggtgcgatccctgcaaacaatagatgggggagattggcattgcggtcgctgggcagaatgttgctaagtagcaatgtcatctatatctgtgtaagagtggtcatgttggtgcgcatgatccgcactcgtctctttacagcggcacgaatgaaatcttgccccggtatgcatagtagctgtgtaatagcctccctctctggttgtgctcgcacagttggccctcctccaatatcagggggtggcccaggaaccgtgtggatatggagcccaccgaaagtgaggacgcgtagccctctaaaggcgagggcgtgtagccttctgaaggcgaggacgtgcagtcctctgaaggtgagggcgtgtagccctacaaaggtgaaggcacatgaccctttgacggcgaggacgtgtagtcctctgaagttgaaggtacatgaccctttgaaggcgagaacgtgtagtcctctgaaggtgaaggtgagggcgtgcagccctctgatggtgaggacgtgtagtcctctcaaggtgagggcgtgtagccctctgacggtgagg

SEQ ID NO: 56562 - DNA, 273 bp, Glycine max
  Peptide Sequence Number=SeqID_148247
ggaaaccctaaaagagagaaaaagaacaattacctgagaaatttgatccttgtgacgtcgaacatcagagacccacccttcgtgctgcattcgaaggtggtcttcgagaaacttgtggcggctcgcgaaggagtgaagctggttctgctggttgcgcaccatctgaaccatagcaaaggagtaaatgccatgaagatgatgcaccatgtgctgactcgcaaaggagtgaagctgcgttccaaagaaaagacatcgttggagggttctgcttag

SEQ ID NO: 56563 - DNA, 327 bp, Glycine max
  Peptide Sequence Number=SeqID_148248
atggaaacttctgggccaaaaacatcaactcatgttgctctggttttgttcttaggccaaaaacattcttttacatttgataaagtttttacaccagaggcatcacaagaagaagcttttgtagaaatttcacagcttgtacaaagtgctcttgatggttacaaggtttgcttctttgcctatggtcagacagggtcaggaaaaacttatacaatgatgggaaggcctggacatttagaggagaagggcttcatacctcgttcattagagcaaatatttcaaacaaagcagtctcaacaacctcaagtctggaaatatgaaatgtag

SEQ ID NO: 56564 - DNA, 504 bp, Glycine max
  Peptide Sequence Number=SeqID_148249
atggggggatttcatcagcagactctccttccccggatacgtaggagcaaaagccttgcttttgtcgaccacaccgctttttgttaccatgacccaagatctggtaacccgcggagacaccttacggttatccgcacccttgtgtcatccagaggcggcgggcccgatgacacgcggagataccttacggttattcatacccttttgtcatccagaggcggcgggcccgatgacacgcggagacaccttatggttatccgcacccttgtgtcatccagaggcggcgggcccgatgacatgcggagataccttacggttatccgcacccttttgtcatccagaggcggcgggcccgatgacacgcggagataccttacggttatccgcacccttttgtcatccagaggcggcgggcccgatgacacgcggagataccttacggttattcgcacccttttgtcatccagaggcggcgggcccgatgacacgcggagataccttgcg

SEQ ID NO: 56565 - DNA, 222 bp, Glycine max
  Peptide Sequence Number=SeqID_148250
ttttatggagtgcctgtcacccccagcaaggtcatcaagccccccattaatcaggtttttatcaagaagtactgcgcccccaggcaggcacagggcgaaacaccacaacagcctggggatggccggcagcgggcaataagcgcgccgccaccacctccagagcccctcagctcatccacaaaaaggttagagtattgccttcgacacatggtcgacaaatag

SEQ ID NO: 56566 - DNA, 276 bp, Glycine max
  Peptide Sequence Number=SeqID_148251
atgattatgagaggccaagacatttatagtagccaagatgaggttattacttcaacttcctctagtgaaactgaagaagcaaaaggggaagaatctagtgaagaaatctacccccaagaagaaggggaccttttaatggtcagaaggcttctaggagaccaatcttgtgacttgacccaatctcaaagagagaatatttttcagacaagcacaagattagtctctaagttaagccttgctatcactccccatccaaagccttacaaacttcaatga

SEQ ID NO: 56567 - DNA, 177 bp, Glycine max
  Peptide Sequence Number=SeqID_148252
atgaatgctctcctagaacttaagcttttgcatcctagaaaaaccatgaattttttgcagcccagcctcattacaagcctagagagtccttcggattcaaattgtgaaaagatgaagaataagaaggttgaagcatctggtgtctcgctaagtgaggcatatgcgcttagcgagtaa

SEQ ID NO: 56568 - DNA, 330 bp, Glycine max
  Peptide Sequence Number=SeqID_148253
atgagaaagcgccacgcttcccgaagggagaaaggcggacaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacctcttggaagccaatggatgtggttactgggaaacttcagaatattgagaggctcaggaagttgtactaa

SEQ ID NO: 56569 - DNA, 330 bp, Glycine max
  Peptide Sequence Number=SeqID_148254
atgtgtctatcggggaaggagaaggaagcactgggtccaacaaaaatagaagaaaatcactcaaagtgtatcaatctcacacagtgcggggcgagaaagtcgctaccacacaggattttggttggcaatcaaagggagaggaccactttaggtcgtgggcaaggattgacattctcaccctgggtcaaggtttatgataagttgggattttggctcaaggcttgtagaacggctggtcatgatatatgtcagggtttggccagcggttcggggataaaggggatgtccccacattatttccatgatattacatgcaacaatgatgattag

SEQ ID NO: 56570 - DNA, 297 bp, Glycine max
  Peptide Sequence Number=SeqID_148255
atggtggacccttgggtacttgtacctatcacctttagaggactatatgtcgtcgccatcagaggactgcacatcctcgcctgtagagggctgtacgccctcgcctttagagggctacgcgtcctcattttcagtgtgctccatatccacaccttaagagaatataaggatcgcgcccacaagacgcctagtggacccgaagaagtccaacagggccctggggtttccagctctggttacgggcctctgtcagtcctacagggtgctcgtccccccagcgaggtcatgccatcgtga

SEQ ID NO: 56571 - DNA, 1086 bp, Glycine max
  Peptide Sequence Number=SeqID_148256
atggataagaagatccgcagtattgtgagtaacattctgaaaaatgcttctgtccctgatgctgatgaagatgttccaacatcgtccaccccaaatgtttctgttcctgatgctgagaaagatgttccaacatcttccaccccaaatgctgaagtcctctcttcacccagtaaagaggactcaacagaggaagaggatcaagccacagaggagacccctgcaccacgggcaccagaacctgctccaggtgacctcattgacctagaagaggtagaatctgatgaggaacccattgccaacaagttggcacctggcattgcagaaagactacaaagcagaaaaggaaaaacccccgttaagaggtctggacgaatcaaaactatggcacagaagaagagcactccaatcactcctaccacatccagacggagcaaagttgccatcccttccaagaagaggaaagaaatttcctcatctgattctgatgatgatgtcgaactagatgttcccgacatcaagagggccgagacatcagggaaaaaggtgcctggaaatgtccctgatgcaccattggacaacatctcattccactccattggcaatgctgaaagagaactgggaagagctgccttggattgcaaggagatcatggacctcatcaaggctgctggactgctgaagactgtcaccaagttgggagattgctatgaaagtctagtcagggaattcattgtcaacattccctctgacataacaaacagaaaaagtgatgattatcaaaaagtatttgtcagaggaaaatgtgttagattctcccctgctgcgatcaacaagtacctgggcagacctactgaaggagtggtggatattgatgtttctgagcatcagattgccaaggaaatcactgccaaacgagtccagcattggccaaagaaagggaagctttctgcagggaagctgagtgtgaagtatgcaattctgcataggattggcgctgcaaactgggtacccaccaatcatacttccactgttgccacaggtttgggtaaatttctgtatgctgtggggaaccaagtccaaatttaa

SEQ ID NO: 56572 - DNA, 396 bp, Glycine max
  Peptide Sequence Number=SeqID_148257
atgctgacgaaggttaccgactttcggtggacgcggagccaacgagtctttaagtcagtgggcgaacagcgtaacgagtctaaggttacagaagcgttcgccaactttgatagcttgttgagtaaggccgtgaagggagaacttgctgcttacttgctatatccccgcgttcttgcacggctcgttcttcgagccctgcttctcccttccccctctccccgttcgttctaccgtccaaaacaaggccgtatggagtatagccaagtggtaaggcatcggtttttggtaccggcatgcaaaggttcgaatccttttactccagattatgaacacccgatcggatctgtcaagaacgagctgacgactacaggggaagcggctgattgcagtccctga

SEQ ID NO: 56573 - DNA, 462 bp, Glycine max
  Peptide Sequence Number=SeqID_148258
atgcaatctcagggacttgcaccgcctcccgaccctctggttggtcccttcggtcctcgagtaaacacaaaggggagttgtgttaatccctcaggaaacgatcctgagacgggtgactctgataggtgcggcttgtacatagaagcagatcctgccagcctggttgccatggggagagtttatgagggattcactgttgttcataacaatcctttgttgcctggccaagtaaaggtgagtggggaggaggttacagatgcagatgctccagttcctgtacccactaatgagggttccttagtggggcagacacttcataccttccttgcttggccgacacatctggtgaagtctttatcacaacatgtagttgtgtctccggcaaaaccacctccaaagcccgatccggaggtcaatgatccactttatctgatgatattgaccatccagagcttttcttaa

SEQ ID NO: 56574 - DNA, 201 bp, Glycine max
  Peptide Sequence Number=SeqID_148259
atgcccctctatgccaaatttttgaaggatatgctaacgaagaagaaccggtacatccatagtgacagaattgttgtggaagatatagaagaggatactgacattcctctcattcttggccgcacattcatgtctactacaagctgcgtggtggacatgggaaagaagatactgcagatgggcatagaagatcaactttga

SEQ ID NO: 56575 - DNA, 267 bp, Glycine max
  Peptide Sequence Number=SeqID_148260
atgattggcgagcgggtttgttttcacgttgggccgatcctcttgaaacgtcagccatccggcgtctatcaaatgttggaccttgtatttaagggccaggcatttttcggtagagtggcccggggttttcccatggtatgcgcaagttgcgtcagggttgtcgcaacgtgcccttttgcgggcgtgcgaggcgaggctcactggtgcgctttccaaaggaggaaagatgcgcggagtagccaccaacgtttaaaattcattttctag

SEQ ID NO: 56576 - DNA, 753 bp, Glycine max
  Peptide Sequence Number=SeqID_148261
atggccgtaactaagctggttctggtgcgccacggcgaaagccagtggaatcaggaaaaccgcttcaccggatggtacgacgtggatctgtccgacaagggtcgcaccgaagccaaagcagccggtcagctgctgaaaaaagaaggtttcgtgtttgattttgcctacacctcagtgctgaagcgtgccatccacactctgtggaacgtgctggatgagctggatcaggcctggctgccggtcgagaaaacctggcgtctgaacgagcgccactacggtgcgctgcagggtctggacaaagcggaaaccgctgcaaaatatggcgacgatcaggtgaaacagtggcgccgcggctttgccgttacgccgccagagctggatcgtaacgacgagcgtttcccgggccacgacccgcgctacaaatccctgaccgacgcgcagctgccaaccaccgaaagcctggcactgaccatcgatcgcgtgatcccattctggaacgagagcattctgccgcgcatcaagagcggtgagaaagtgatcgttgccgcgcacggtaactcactgcgcgcgctggtgaaatacctcgataacatgagcgaagatgagatcctcgaactgaacatcccaaccggcgtaccgctggtgtatgagttcgacgagaacttcaagccaatcaaacattactatctgggtgatgccgacgagatcgcagcgaaagccgccgccgttgctaaccagggtaaagcgaagtaa

SEQ ID NO: 56577 - DNA, 1191 bp, Glycine max
  Peptide Sequence Number=SeqID_148262
ggtttcaccggtggccagggaacgttccactctgagcaggcgctggcctatggtacgcagctggttggcggtgtgacgccaggtaaaggcggcactacccatctcggtctgccggtgtttaacaccgtgcgtgaagcagtagaagcgacgggcgccaccgctaccgtgatctacgtgccggcaccgttctgcaaagacggtatcctggaagcgatcgacgcgggcatcaaactgatcatcaccatcacagaaggtatcccgacgctggatatgctgacggtaaaagtgaagctggacgaagcaggcgtgcgcatgattggcccgaactgcccgggtgtgatcaccccaggcgaatgtaagatcggtatcatgccgggccacattcaccagccaggccgcgtgggtatcgtgtcacgttccggtacgctgacctatgaagcggttaagcagaccaccgacatcggctacggccagtccacctgtgtgggcatcggcggtgacccgatcccaggctccaacttcatcgacatcctgaaaatgttccaggacgatccgcagaccgaagcgatcgtgatgatcggtgagatcggcggcagcgctgaagaagaggccgcggcattcatcaaagagcacgtgaccaagcctgtcgtcggctatatcgccggcgtaacggcgccgaaaggcaagcgtatgggtcacgccggcgccatcattgccggtggtaaaggcaccgccgatgagaaatttgctgcgctggaagcggccggtgtgaaaaccgttcgcagcctggccgatatcggcgacgcggtgaaagcgggcaaagaggcgtgctttttcccgtcagcgtccaggcgtctggctggcaaagaggagtttgtgccaggcgttgtcatatcaattctgtcgcctcctcatcttactcctgctcgaaacaggctgaagcgatcggtttttcggggaattttcaccactgttactcgctcacttcgggccgcagtacgcattgtgctgtcggatgagttcatgcgaggagcaaggagtcatcatgttagatattgtcgagctgtcgcgtttacagtttgccctgacggcgatgtaccatttcctgttcgtgcccttaacgctgggtatggcgtttttactggcgatcatggaaacggtctatgtcctgtcgggaaaacagatttataa

SEQ ID NO: 56578 - DNA, 1320 bp, Glycine max
  Peptide Sequence Number=SeqID_148263
atgacagataaaaaagtgacgctaaccctacaagataacaactccgtggaactggatgtgatgcaaggcacgctgggacaggatgttgttgatgtccgcgcccttggctcaaaaggcctgttcaccttcgaccccggttttacctctacggcgtcctgcgaatcaaaaattacctttattgatggtgatgaagggattttgttacatcgcggtttccctatcgatcagctggctacccactccaactatctggaagtgtgctacatcctgctgaacggcgaagccccaactcaggcgcagtacgacgagttccgtaccaccgtaacccgtcacaccatgattcacgagcagattacccgcctgttccacggcttccgtcgtgattcacacccgatggcagtgatgtgcggcgtgaccggcgcgctggctgccttctatcacgattcattagacgtgaatattgaacgtcaccgtgaaatcgccgccttccgcctgctgtcaaaaatgccgaccatggccgcgatgtgttacaaatactccatcggccagccgtttgtgtatccgcgtaacgacctctcctatgccggtaacttcctgcatatgatgtttgctacaccgtgtgaagagtacaaagtgaacccggtgctggaacgcgccatggaccgtattctgatcctgcacgctgaccacgaacagaacgcatcaacctctaccgtgcgtaccgccggttcttccggtgccaacccgtttgcctgtatcgccgccggtatcgcctcgctgtggggacctgcgcacggtggtgccaacgaagccacgctgcgtatgctggaagagatcagcactgtggatcacatcccggaattcgtgcgtcgcgccaaagataagaacgattcgttccgtctgatgggcttcggtcaccgtgtgtataagaactatgacccgcgcgcgaccgtgatgcgtgaaacctgtcatgaagtgctgaacgagctgggcatgaaggacgacctgctggaagtggcgatggagctggagcacatcgcgctgaacgacccgtacttcatcgagcgcaaactctatccgaacgtcgatttctattccggcatcatcctgaaagcgatgggcattccgtcatcaatgtttaccgtgatcttcgcaatggcgcgtaccgttggctggattgcgcactggaaagagatgcacgacgaaggcatgaagattgcccgcccacgtcagctctacaccgagccctgcctggctgagccccgtttcaggcgtcctcgcgccgctgacgcggtaccttcacacccttcgtcagtctga

SEQ ID NO: 56579 - DNA, 864 bp, Glycine max
  Peptide Sequence Number=SeqID_148264
atggctacctcaccaaaagaaatttccgcttctggttcaccctctgtaccatcatctccgcaccaggaacaacctgaattcaacatccaacccatacaaataattcctggtcaagcctctgctcctgagaaactggctcccagaagacaacagggagtgaagatttctgaaaaccctagccttgcaacaagtcctagggaagtagacccggagatggataagaagatccgcagtattgtgagtagcattctgaaagatgcttctgtgcctgatgctgagaaagatgaatcaacagaggaagaggatcaagccacagaggagacccctgcaccacgggcaccagaacctgctccaggtgacctcattgacctagaagaagtagaatctgatgaggaacccattgccaacaggttggcacctggcattgcagaaaggttacaaagcagaaaagggaaaacccccattactaggtctggacgaatcaaaactatggcacagaagaagagcacaccaatcactcctaccacatccagatggagcaaagttgcaatcccttccaagaagaggaaagaaatttcctcatctgattctgatgatgatgtcgaactagatgttctcgacatcaagcgggccaagaaatcagggaaaaaggtgcctggaaatgtccctgatgctccattggacaacatttcattccactccattggcaatgttgaaaggtggaaatttgtatatcaacgcagacttgctgttgaaagagaactgggaagagatgccttggcttgcaaggagatcatggacctcatcaaggctgctggactactgaagacagtcaccaagttgggagactgttatgaaagccta

SEQ ID NO: 56580 - DNA, 957 bp, Glycine max
  Peptide Sequence Number=SeqID_148265
atggagatggaaaatgataaagtaaaagcagttgtattcaggatcaattccccgggaggaagtgctaatgcatccgatgagatcttgtttgagcttcagcagctaaaaaagaaaaaaccactgattgtttcttttggtgattatgctgcgtcaggagggtattatattgcaatggctgcagataaaatttattctgaacctaataccttgacgggatctatcggagtttttggagtaattccttattttaaggatattgccaataagaatggaatccgatcagatattgtcgctacaaatgccaattctcaatattattcaggtttgaacggtgtaactccatatggtgtaagtatgattacaaaaagtgtagaaggaacatataaaagatttgtacactttgtaacccaaaacagaaaacagacatttgaacagatcgataacattggtggcggaagagtatggagtggtgtaagagctaaacaaatcggtttggtggatgaattgggaacattaaatgatgccgtgaaatttgcagcgcaaaaagcaggattgaagtcttataatgtggcctcatatcctaagaagatgtctccttttgaacaaatatttaaagacctgaatgaagatgatatttctgcaagagttatcaaaagtaaaataggtaaagccaattatgaaattttacaacagattacagaagagaaactaagatctgagcttttctttgaggccattccaaaaatccaaaggacgataagtgaacctcccactgctaataacatgcttctgaagtcaaagttttcaactgttccccagccgattaaacttccaacaaatccacctacgaaagctccaacgattcctagtataatggtcataagccaaccaccaccttgtgttccaggcataataagtttagctattgcacctgcgataagaccaaaaatgatccaa

SEQ ID NO: 56581 - DNA, 831 bp, Glycine max
  Peptide Sequence Number=SeqID_148266
atggcagaggtctccacggaggccattgcctccctcacccaatattatgaccagcctttgaggtgcttcacctttggggacttccagttaacacccacggtggaagagtttcaagagatcctaggatgccctctgggaggaaggaaaccatacctcttctcgggattctatccctccttagctagaatttctaaaatagtcaaaatctcgacacagggattagaccgcgggaagcaagtcgaaaatgtgttggttggggtaccaaggaaatgtttggaagcaaaggcgagagtcttggcaagtcaaggcgaatgggccccattcatggacatcttggtacttttgatcttcggggtggtcctctttccaaatgtggatgggttggtggaccgggcagcgattgatgcttttctcgccttttacgaccgcaaagaaatcccgtttgtcgttatcttagccgatctatatgacacattcggccgaagatgtgagaagaacaatgcaaggattgtttgctatatgtcggccttctacgtatggggttgcatcaattacaatcctgtcctcgctataagacaacttggttaccctatgagagaagcaccatcagaggaaggcctcataccttttattacacgaggtttcaatagcaccaacgtgggggtgcttcagagggtccacaaggcatgggaaatgtcgcaaagaaaggacaatgaacttagggggagtagcaacgggcccatcggcggttaccataggtggttgaaagcctacgcacaagatatggattggctttcgagtttgaggaacactaacgggggtggaggttga

SEQ ID NO: 56582 - DNA, 355 bp, Glycine max
  Peptide Sequence Number=SeqID_148267
ggatcgcgcccacaagacacccagtggacctgaagaagtccaatagggccctggggtttccaactctggttatgggcctctgtcagtcctaccgggtgcctgtcccgccagcaagggatcgcgcccgcaagacacctagtggacccgaagaagtccaacagggtcctggggtttcctgctctgattacgggcctctgcaggcacagggcatgacaccacaacagcctggggatggccggcaacgggcaatagaagcaccaccgccatctctagagcccctcatcttatctacaaaggctagaactttgcctacgacctgtggccgaccagcaggcgaccaagtccaaagccaaag

SEQ ID NO: 56583 - DNA, 367 bp, Glycine max
  Peptide Sequence Number=SeqID_148268
gtcgactctagaggatccccgtgctcgtgcacttagcccacttatggaccgcttagtgcacgaagctgcacagtcaggaagcgttgatagcgtcatcgaccttccatcccgtgtcagacaccacgtgaagtggaagatggcccgcacgaagaaaacaggggagatgacaactgaggccgcaaaggaaatatctgagaagatcgatgttctcaccgctgctattggacgtccagagaaccctagacgtgtctgtgctgctgaagctggtgtcaccatcaagcaatacttcggatcggctccacggatgtcccgcagctcttcttcgctgcctcctgaagaattgcagcagctgacccatcaaatctag

SEQ ID NO: 56584 - DNA, 213 bp, Glycine max
  Peptide Sequence Number=SeqID_148269
atggatgattttagtgaggatgaggaccaacagttctttgatcacatcaatgaggatagcaatgaccaaagtgatgaccaaagcgatgacgagggtgttggcagaccaatgacacctccgtcacctccattgcagtatcaccaacctaggtgtccagtagacttgaactttgaccacctaccacactacattgatcgacaccattttttttag

SEQ ID NO: 56585 - DNA, 252 bp, Glycine max
  Peptide Sequence Number=SeqID_148270
atgagtgagaatgagaatacccaaaacttggacattggagatgttggaatgtctagggaacacttaaaaacttcgtaccccattgcccagaggctcttcgctatgcgaaggtatgggggagggatattgtacgcagccttacccttgcatatgcaaagaggctgtttctggattcgaacccatgaccaacaagtcaccaaggcacaactttaccgctgcactagggctcgccctcgtctagggaacacttaa

SEQ ID NO: 56586 - DNA, 522 bp, Glycine max
  Peptide Sequence Number=SeqID_148271
gctaaatcctcagttggggattcttgctatgaggtggccacagattcatcttcatctactgaaaataaaaagcttgaaggaaaacttgatgccttgatcaccatacagatctttatccttctttgcagcaatctggagtcaatgagcaacctgaagcctatgctgcaaacatttacaatagacctccttaacagcaaaaccaacaacaacagaataattatgacctttcaagcaatagatacaatccagaatgtcgctggtccaagcaagccatatgttcctcctccaatacaacaacaacaacaacagtcacaacaaggacaacaagcatctgaggctcctcctcaaccttccttagaagagtttgatgagaatcatgaaactggccaaatacaggctaaaggcccaagtggagaaggacgaaggcaacaaggacaaaacacgaaccaggacaaattacaaagaaaaataataggaaaagatagaacctgtatcaagagtcgaagctctgataccagatga

SEQ ID NO: 56587 - DNA, 300 bp, Glycine max
  Peptide Sequence Number=SeqID_148272
atgttagccggaagtgcaacaatagaaaaaccaagagcagattggactgaggaagaacgaagattagtacaatataatttaaaggccaaaaatattattacatctgccttaggaatagatgaatactttagggtttcaaattgtaaaagtgctaaggatatgtgggatacactacaagagcatgaaatggaattactaagattaaatcagcatgaagaaactgataagaagaagaaaggaatcgctcttaaagcctcatctgcaatccaagaagacagtgataaaagaagattcaattga

SEQ ID NO: 56588 - DNA, 1010 bp, Glycine max
  Peptide Sequence Number=SeqID_148273
tgcagtatgacacaaggagattctcttcgttagatgcttgggcccgatacatagataatgtcttggggagaaacattttaccagagaggaaagtagagatatatcacactgagctggatgagtttaaggctgaattaaagaggcataatttccataaacgcctcaccaatttagtcgatgggagcatagacctggctttggtgaaagatctcaacacattcctagagacacctgtagtattagcagagagggagaccttacgcgcatactccagatactgcaggttgcctatagactacacagagatagagggccatcctgggaagattctcaggaaggatctgactacactagctcaggtgtggagtgtcctctcatactctaacttgacccccacatcacacacttctaacttgacagtggatagagctaggttgatctttggcttagtctctcgcatggatatggacataggagtgctgatctctggccagatgacctctatagcccaatctaacacttctagacttggggcgagggctaggccagctgagctcccttcaacttctgcggctcctactccagcatccacgtcagcagctccttctgttgtggcgcctccaggatctattccctcaatcgagcagttcagagagttggtagattggcctgagattcagtcttctcttcacagggaagataaaggtcccacagctcaggtaccaaagcatatggagaatgtgtcctttgaggccactatcccaaagccatttactatagaggaggaggcaggcgacacacagacgacacaggtagttgctgccactcctgagagatctcttaaggccatttcagagcccccagcaccaacaatggatccatcttcacctcagcacgcagcagacccttccactcctgtcttagagatacctgagggccagaccacaccagtcctggctctgcacatttctcctccagctactccaatgcttcatctgacagacgaggag

SEQ ID NO: 56589 - DNA, 1128 bp, Glycine max
  Peptide Sequence Number=SeqID_148274
atggggacaaatcaaaacggcaaaaggttttatcaagtcaaggttaaaggtctagatgtcaccagcctcaaggaattgggacgattgaagggacctctacaaaggcaagccttccgcaaagtgtacgggaagatcctagatttggccgcagcggaggtatttacggaagctgtcgtatccctcgcccaatactatgaccagccgttgaggtgtttcacgtttggggacttccaaatggtaccaactattgaagagtttgacgagatattaggatttcctcttggggggagaaaaccgtatcttttctccggctttcttccttccttgagcaagatcgcagctgtggttggagattcagcaaaggagttggatcgcatgaagcgaattcagaacggcgtagtgggcctgcctcggaaatacttggaagacaatgcaagggatatggcgagccaagagaaatggggcccgtttgcggatgttttagctttgctgatttttggggttgtcctctttccgaacgttgacggcttggtagacttagccgccattgatgctttcctcgcatatcaccatagcaaggagagtccagtggtggctatcttggcagggggcagcgcgatcaattggtttcctcgttggaaggaaggcaaggaaggagttcttttctcgtgtggggactatcctaatgttccactgatagggactaggggttgtattaattataatcccgcactcgccataagacagctagggtatcccatgaggggagcgccaaccgaagaaagtctctcgcctttccttgtgagggatcaaggcgcgcaaggtctcaaggttatacaaagaatccacaaggcgtggaggagtccgttgaggaaagacaaggagcttagaggcatccgaaacggcgtcattggaggttatcatggatggctaagaattcacacgcggggcttaggttggctctccaaattgaaagttatcaatgaggagaacttcgaagctccggaggaagatgaagaagtccgagctctgaagttagagctagggaaagcgagactcgccaaggagaagttcaaatcagctgctacacacatctggaacgagtgcaccgagttacaagaggaaaac

SEQ ID NO: 56590 - DNA, 101 bp, Glycine max
  Peptide Sequence Number=SeqID_148275
atggcgaccaagatgaagagatgtcagttcgaagccttgggctcaatagctccaatcacatctattccccacatagagaagggccatggcgctgccaatag

SEQ ID NO: 56591 - DNA, 575 bp, Glycine max
  Peptide Sequence Number=SeqID_148276
ggctagacgccctcgccttcagaggagtacacatcctccccttgagagggctacacgccctcaccttcgtagggttacatacccttaccttcaaaggagtacacatactcaacttcagaggactatacatcgtcgccatcagagggctacacatcctcgcctttagagggctacacgtcctccccttcagaggacaacatgacctcccctttagaggaatgcaagccctcgccttaacaggactgcatgttctcatatttagaggactacacaacctcgccttccgagggctagacgccctcgccatcagaggagtacacatcctccccctgagagggctacacgccctcgccttcgtagggttagacacccttaccttcaaaggagtacacgtactcaacatcagaggactatacattgtcgccatcagagggctacacgtcctcgccttcagagggcttcactccctcaccttcagaggactacacatgctcgcctatagaggactacacgcctttgccttcgtagggctacacgccctcaccttcagaggactacacatcctcgttttctga

SEQ ID NO: 56592 - DNA, 569 bp, Glycine max
  Peptide Sequence Number=SeqID_148277
caagagggaagataaagctgaaaacccctgaagaggcaactgaattgattgagaatatgtctacaaatgctttgttggcacaaaataagttgctttctaagcaacttgagatcttaacagaaacacttggtcattgcattcccattgaagaacacactcaggaagttcattacatgggaaatcaacagagacaaggatacaaccaaggaggatttttaggattccagcaaggtccctacaatcagccacctcaacaagggccaaatatttttcagaggaccaccaaattggaggagacactagctcagtttatgcaagtgaccatgtccaaccataagagtactgagtcagccttgaaaaaccttgagatccaggtgggtcaaatggccaaaatgttagctgagaagtcatccaacagctttggagcaaataccaagaaaaataccaaagaagagtgtaaagctgttatgacaagaagcatgaagcttgtggcggctgaggataaggatgttgttgctttgaaggagcaagtttctttgaaggacactactgttaaaaagaagaatagg

SEQ ID NO: 56593 - DNA, 312 bp, Glycine max
  Peptide Sequence Number=SeqID_148278
atggctattggttggcacatttctgatataaaaggaatcagtctccatcatattgtatgcacaaaatcaatttggaagccaattataagcctgtgcgacaacccagagaagattgaatcctataatgaaggaggaaataagaaaagaagtgctcaagttattagaggcaggccttatctatccaatttcagacaactcatggaacagtcacaggatggagaatgtgcattgattatagaaagcttaatgaagccacaagaaaatatcactacccacttcccttcatggatcaaatgcttgagagacttgtag

SEQ ID NO: 56594 - DNA, 357 bp, Glycine max
  Peptide Sequence Number=SeqID_148279
atgcttctatttttcagtcctttgaataaggctaagcgcaactgctacgctaagcccttgttgtgtgtcaaggaggttgagctaagcgcgccctgttgcgctaagctcaattctctcactgattttgagcttttgtgtgctaaaaggagtagtcgcgctaagtggaccctgtgggctcagcgcacatccacggctaagcatagcttcagcgtgcttagcgtgacaagggaatctagaagagcacaaggatctaggccgcacgctaagtgcgagatcagcttgctaagcgagacatttgtctcttgccaggctcaacgcatgactggcaccaagcccaaatccactaactcgcgctaa

SEQ ID NO: 56595 - DNA, 384 bp, Glycine max
  Peptide Sequence Number=SeqID_148280
atgggaacaaatcaaaccggcaagaggttttaccaagtcaaggttaaaagcctagataccaccagcatcaaggaattaggacggttgatggaacctctccaaatgcaagccttccgcaagacttacggaaagatcttagagttgaccatagcagaggtatccatagaaaccattgcatcactcacccaatactatgaccagcctttgagatgcttcacattcgaagacttccaattggggaagaaaaccatacctttcctccgggtgtctcccctctttgagcagaattgcaactgtggtcaaggattcagcaagaggtttggaccgcataaaacagactcgaaacggcatagcgggcctaccacggaagtacctagaagataa

SEQ ID NO: 56596 - DNA, 702 bp, Glycine max
  Peptide Sequence Number=SeqID_148281
atggattgcaaggagatcgtggatctcatcaaggctgctggactgctgaagactgtcagcaagttgggagagtgctatgaaggcttagtcagggaattcattgtcaacattccctctgacatatcaaacagaaaaagtgatgattatcaaagagtgtttgtcagaggaaagtgtattagattctcccctgctgtgatcaacaaatatctgggcagacccactgatggagtaatagatattaatgtttctgagcatcaaattgccaaggaaatcactgccaaacgagtccagcattggccaaagaaagggaagctttcagcagggaagctaagtgtgaagtatgcaattctgcacaggattggagctgcaaactgggttcccaccaatcatacttccactgttgccacagaatcatttgctgtcaaattacccattgccttccctactgtattgtgtggcattatgttgagtcagcatcccaatatgttaaactacactgactctgtgatgaaaagagaatctcctctatccctgcattacaaactgtttgaggggacacatgtcccagacattgtctcgacatcagggaaagcagctgaggaagacaaagaagcagttgaagaagaagaagaagctgctgaggaagaggaagatgcagcagaagagacagaatcagatgatgattctgaagccaccccatga

SEQ ID NO: 56597 - DNA, 475 bp, Glycine max
  Peptide Sequence Number=SeqID_148282
gagagaaaaggaaagaaagcctcaagaggctaacattaatctcccatactttcatgggaaggacaatgtagaggcttactcagattgggaaataagggtagagcaacaacttaaaaggaagtctacttcaatatcttatagatctcattcttatccaaagaaagaccaaggtcaaggcatcttaggggtgacaccttctaagaccaaagatgataatgggaagacaatagaaaagcaaccccttaaggctaacacttgtagtattgccacacctcttaggcttgagtttattcctcaagtaaaggagttgttggatgaggatttggttcgcaagagcttaaatccttgtgctttcttggtgcccaaaataggggttcccatgaaccctaagagaataaaagtcattcctgagtggcccgctccaccaagtgtgttgaggaaaaaagcccagagtttcaagaacctcgggatttga

SEQ ID NO: 56598 - DNA, 1107 bp, Glycine max
  Peptide Sequence Number=SeqID_148283
atgacggaaccatcaaaaaagcggaaaggaacttcaagtcggagtcagtggcattcagggtcacaggaagccccaattcctccctccattccctttggatcattattctcatcagaggaacaatgtatacggtacacaaacctcttttcctctcgtttcattgtagacccaaaattcatagatatggagttcttctcaaatgagaattttgaatgcttccaagcatttgaaaactccaatcttattccattcatgtctctaaaattacctgtctattctgaattagtcaaagctttctattctaatttagaaatccatgaaggtaccctaatgtctgaagtttatgggattaagatggtcattgaccaatccctattttatgatttaacaaaattgcctagtgaaggtgtgccttttgagggtgcactgattgatgaatggaaattcgatttctctgtgcatgatgcacgccggttggtttgcaccaaccaagcggatatgaccggaagactacttgccggttcattggcttttgagagccgcatcctccattaccttattgtttgcatcctactccctagatcttcaaaccttgctcaagtttctgaagaagatctcattgtcatgtgggcctttcataaaggtttacaaattgattgggcacaccttgttagatatcgcatgcataaggcattgcgattgaatgcccctttgccttatcctcatcttattacccttttccttcaacacttcaacatccctcttaactctgaaccctatgttccaatcaagagatcattccttataggcacttcagtcatagcatcctttggttatattaaggagcatgatggctcttgggtaaagaagggtgctagaaatgttggtgaagaaggacatgagggagaagattcatctcttctttcaaagattttggaaaggtttgatggtcttcaaacctttgttgatgagaggtttgatactttggaattgcaagtggatatgtgcttcaatgaaatggagtcaagaatgacaaaggttgaagaagatgtatcttacattcggtcaagcttcgatcttctaccaccaccgccaccatcatcttag

SEQ ID NO: 56599 - DNA, 51 bp, Glycine max
  Peptide Sequence Number=SeqID_148284
gcaacatgctatggggtggtggtcccacttatggggtcaaatcaatccgtt

SEQ ID NO: 56600 - DNA, 333 bp, Glycine max
  Peptide Sequence Number=SeqID_148285
atggcttccatgatggatgccatgctgggaatgaaacaactaatggagagtaacacgaccatcgtcgccgctgttagtttggctgtcgaggcagacccgactctcttgactgctgcgcaccaccctattccaaacatggtgggacaagagagaagcacaccggggcacatcagcaacccccatccgggatacaaccaaggtacttacccctactgtttgccacccaattacacaccaccagccatacatgacgacgtgggtcacgttcctcccctcgtcctcgaaggggagcctcctcgacatccttatggggtccacgagaatcctcgatag

SEQ ID NO: 56601 - DNA, 210 bp, Glycine max
  Peptide Sequence Number=SeqID_148286
tggagtcgccaactgtcgcaacgtgcccttcgcgggcgagcgagggcgaggctcacgggtgcgcttcccaaaggaggaaagatgcgcggagtcgccaccaacgaaggtattagcacctcttacgttgacaaaagcggggcttttgctcctacgtaccctcctttggagaggaaatcagacctacgtagttcttccttatgcgtgaatcaa

SEQ ID NO: 56602 - DNA, 536 bp, Glycine max
  Peptide Sequence Number=SeqID_148287
gatccccgcttctccagactacaattcggacgccgagggcgacgattttcatggtgggcttttcccgcgggtagccccgcctgacctgaggtctcgttgggagcgtgcgtgcacgcaaagggtcgtcgatgggtccagaactgaccggctcgcacgtgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcg

SEQ ID NO: 56603 - DNA, 108 bp, Glycine max
  Peptide Sequence Number=SeqID_148288
atggcttcctatggtgaaacaaaggactccattgatgaagaagatccaaggcctacaagctccaatggagctacatcatgtggtattagagcatcttcatctagatga

SEQ ID NO: 56604 - DNA, 354 bp, Glycine max
  Peptide Sequence Number=SeqID_148289
atgtatcggtatcctttcgaaggtcatggcactgatatgtctgcaagtgaatattcgtttggtggtgttgcggaaacacatcctcatttttcatggccgaccatgaccctttcacagcaacatgatgccccaatggcaacacctaatgccccattaggtccgcaatgggatgtacccggagcaatacctgatatgggtgacttattaggttttgatttgcgtcacgagttttttgcaaaggctaagcaacaagggcggagacagcgcgcaagaagaaattcggatcgtcaagcccgaaggtgggatcaaccatgtggcacatccttgcgccatcacggacaccataatgactga

SEQ ID NO: 56605 - DNA, 501 bp, Glycine max
  Peptide Sequence Number=SeqID_148290
atggaaggtaaaaaagcgattcagattaaacgtagaattagtttcaatgctttgaaaaaaaaattggagataagatttttagtttctggaaaatatgttgcttttcaaatttgtgatgacgaagatgttgaaaccatactcgaaagttttcaacaacaagatcaaatgtcagatatggaattatacatagaaaaggatgtggctggtggttctatgtttcattctgcaaattctcttacatcatgtggaaataatttatctaataatgaggcgcaaccgccaagaaatgtgagcaatttacatggtgatgaagatgatgatgatgattatcttgtgtctaactcatacgttgaagagtctttagacgaagatgatagtgttgacggtatctctgatacagacgatgaagtcaccgacatgattcaaccagtaagaattgttcacccagcagaagtaagaattgttcaccctaaccctaagcccctaacccctaaaccctaa

SEQ ID NO: 56606 - DNA, 504 bp, Glycine max
  Peptide Sequence Number=SeqID_148291
atgtcaattcataaaagcactgagtcaacactgaaaaaccttgaggtccaggtgagacaactagccaaacagatagctgacaagtcatccaatagttttgtggcaaatacagaaaaaaatcccaaggaggaatgcaaagctgtgatgacaaggagtaaaaggtttgtggaggtgaaggatgaggatagtgtagtgtacaagaataaagctgctgaaaagaaaggtactgatgaaaagaaagaggatgtgataggtgaaagcaatcaggaaaaacaaaaacaaataatggtcaagaaaaaagaatttaatgaccaagaaaaagaaaaagaaggagaaaaagaaaaagaaaatgaaaatgaaaaaattgaaaaagatgaaaaaaataagaatgaagaaaggagtaaaagtgaacaggctagagagaagcaaagagaaaaggttgttcatgttaactgcaagctgcatagtttatatggagagaaagaagctggagctgggctttga

SEQ ID NO: 56607 - DNA, 616 bp, Glycine max
  Peptide Sequence Number=SeqID_148292
atgacggaagggtgtggtgaagggttttgcccttgcaaacccttcccggtgatgcttttagtctatggggggaacttctttgaggcaaagaaacaaatgatggctgatgccaagtttgcggggctgcttggtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcgggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacg

SEQ ID NO: 56608 - DNA, 387 bp, Glycine max
  Peptide Sequence Number=SeqID_148293
atgactcatcataattttcaagtgcaagccattggtctgtttgctcaagcgacctgtgctcttgagtttggacttccaagaccgttcaatcagagattactcgtcttgcacgttggtgggggtgccgtaaaacaacgaggatcgcgcccacaagacgcccagtgggcccgaagaagtccaacagggccctggggtttccagctctggttacgggcctctgtagtcctacagggtgcccgttcccccagcgaggaatcgcacccacaaagacacccagtggacccggagaagtccaacagggccctggggtttccagctctggttacgggcctctgtagtcctacagggtacccgttccccccggcaaggtcacatcatcataggtaa

SEQ ID NO: 56609 - DNA, 318 bp, Glycine max
  Peptide Sequence Number=SeqID_148294
atgttagctatcatcaccaagtaccgagaagaactaaatctagccacaacccacgagcatagagtggcggacgagtatgcccaagtgtacgtggaaaaggaggctagaggaagggtgatcgactcgctacatcaagaggcaacgatgtggatggaccgatttgccctttccttgaatgggagtcaagatcttccccgattactagccaaggccaaggcaatggcggacacctactccgcccccgaggagatccacagacttcttggctattgtcaacatatgatagatttaatggcccatataattagaaaccgctag

SEQ ID NO: 56610 - DNA, 783 bp, Glycine max
  Peptide Sequence Number=SeqID_148295
atggaaacgtgtttgggagtagaggaattgttacagtggatgatagatcaaggtcgactggaagtcggcagtgaaggaaaagaagagcagcatatatgcatgcagtccacggatgggagcagtgttgcgaagcccaaactattggtgatatacttcactaaaagcgcagcttcgcaaaagcccggacaccccttagcagctaaacctgttcctttcccataccaaagtagccacgcagtaccatggagatatacacctccgagggagaaagaagaagaagccaccaacgtcagctcgttgtcggctaaagtaacaaatatcacgggactgagtggtgtgacccgtagtggtcgtgtgttcgcgcctccggacctaccagtccaacccgcggacgtcaaagaaaaaggaaaagtggtggaggaacaagatggcgaagcaccccacgcttcgaataaagatattccggcaaaaggcctcccggagaaaaaggatggtaaaaaggaggtgtcgctagaggaagccagcgagttcctccgtataattcagcagagcgaattcaaggttatcgaacagctcaacaaaaccccgtccagggtctcgtttgttggagttacttatgagctccaagcctcatcgggctctactagtaaaagttctgaacgaggcccatgtggcccaagatttctcggtagaaagtttcggagggctggtcaacaatatcactgccaacaactatcttgccttcgtcgaagaagaaatccccgccgaggggagagggcataa

SEQ ID NO: 56611 - DNA, 225 bp, Glycine max
  Peptide Sequence Number=SeqID_148296
aaatctttcttgatcggtgttgttgtggttgcctcctttggttaccgcaaagagcgtcgtgatgactcttgggtaaaaaagggtgctcaaccaaatgatgatgaaggacacttaccggttgaaggggactcttttcttcttcagggtattttggacaggtttgatggacttaaaacctatgctggtgagaggtttgactccttgaaaagtcaagtggacacatga

SEQ ID NO: 56612 - DNA, 323 bp, Glycine max
  Peptide Sequence Number=SeqID_148297
cggatgccgggagcagacaagcccgtcagggcgcgtcagcgggtgttggcgggtgtcggggctggcttaactatgcggcatcagagcagattgtactgagagtgcaccatctgcgggcgatcggtgcgggcctcttcgctattacgccagctggcgaaagggggatgtgctgcaaggcgattaagttgggtaacgccagggttttcccagtcacgacgttcatgcatggtcctgtgtggaggactctggaaaatggtcctgtgatttctccaacacacaaggatgtttgtaggctcattgatcaaatgaaggaaggccagtaa

SEQ ID NO: 56613 - DNA, 206 bp, Glycine max
  Peptide Sequence Number=SeqID_148298
gaagtttctactctacagtagttggaggattgagatgctatgagaatccaaagaataagattactgcagtacctgccgaggaagagcaaatctggggtgcattcttcagggtaatcttagagcttaagaagttagagttgaacatccattatgtaactaggattgccagttgcaacaaaatttcaccgaggtggaagggtcagtag

SEQ ID NO: 56614 - DNA, 210 bp, Glycine max
  Peptide Sequence Number=SeqID_148299
atggagggacaagctgctgttgttgtggaggacttgtccatctcagatttggatgattcctctaacctggattgtatctgttgcttgaaagatcataattattttgttgttgttggtttttctgctaaggggattgctgcaaagaaggacaaagatctgtatggtgatctgcagaagaacatagaccacaaactcttgcaacaggtgtag

SEQ ID NO: 56615 - DNA, 78 bp, Glycine max
  Peptide Sequence Number=SeqID_148300
gaatttgatgaaacattgggcttaatccggatcttggtagtggacttgaagagggcaaataaagcagcgcttaccttg

SEQ ID NO: 56616 - DNA, 168 bp, Glycine max
  Peptide Sequence Number=SeqID_148301
atgactaaagcacgtcaaaagggggtacggaaagaaaaggaaggagaagctcgccaccaagctcgcccaggcgagctaggtttcttcctccagaaggcaccgccttctggagaacttcctggaaggtccaagtgggcctggttggtatttgcaccccccttttactaa

SEQ ID NO: 56617 - DNA, 189 bp, Glycine max
  Peptide Sequence Number=SeqID_148302
atggatcattttaaggtccaacgccttaaaaatgatcacctttcaagtaaaaaagaattgcttgattcacgcttaagaaagaactacgtaggtttgatttcccttttcgatggagggttgttgtcttttgagacaaacgtgagaggtgctaataccttcctcaaacgtaaatacaactcccgaacttag

SEQ ID NO: 56618 - DNA, 759 bp, Glycine max
  Peptide Sequence Number=SeqID_148303
atgagcttaaacgcagattatcagaagctggaatccggaaacgatgttcgtctgattgaggtggacggttcttcctttgggctgacggacgttctccgctttcacaattacaacattccccacacagaagcggaaataatcgccgctggtggggatgagtccaagcttccggcgaaaccaatctggtggcagggaaatgaatacgccgcctggccgtatcaactggaaggtctggagaaatcaaccagtgggagtaatgcaacaccatcactgacggttgcgaacatcgaaagctccatttctgctctgtgtcttgcctatgacgatctgctgcaggcgaaagtcactattcacgacacaaaagagaaatatctcgatgccagaaatttcgcagacggcaaccccacagcagacccgactcaggaaaagctgcaggtctggtatatcgacgggaaaacgggcgagcttgccggtgaaaccgttgaatttgctctgtccagcccgatggacctgcaggggcaaatgatcccgacgcgacagcttcattccctgtgtacctggtgcatccggaataaatatcgtaccggcgacggctgcgactatgccggcacccgctatttcgacaaaaacaacaacccggtaagcgatccgtcgctggatgaatgcaacggcacgctgacggcctgcaaactccgattcggcgaaaataacgaactctcatttggtggcttcccgggcacgtctttgatcaggagttga

SEQ ID NO: 56619 - DNA, 609 bp, Glycine max
  Peptide Sequence Number=SeqID_148304
atgcaatcacaggaacttgcactgcctcttgagcctgaggttggtccttcaactgctcgtgtcaacacaaaggagagttgcgttgatccctcagggaacaatccagacacaggtgactcagacaaatgcgagttgtacattgaagaaaatcctcctcgcatggttgccctagaaagagtttatgagggatccacaatcgttcaaaacatccctatgttgcatgatcaagtgaaggttggtgttgaggaggttagagatgcagatgctcacattcctatgcccattgaagaggttaagttagtggggcaggcacttaacacctttcttgcttggccgacacatctcgtcaagcgtttatcagaaaagggagttgtgggaccaacaaaacttgcagacatgccggatcatgaggtcgatgatcccctatatctgatgacattgaccatcccacaactttttctaaagccattgcaggttatgtgggatgctaccgtgtttggggtgtttaatgaagacttccccttgtacataaagcatgaagatctgtctgaaatagcacatggtgctcaatgtctcagcatctctgttatacagttgtggattctttaa

SEQ ID NO: 56620 - DNA, 390 bp, Glycine max
  Peptide Sequence Number=SeqID_148305
atgctggctaacaatcaagaccagccttggtctagaattttaatctctaagtatggtgggtggaaggagttgatttgtggtggaaggaggaatttcacttcccaatggtggcaggatttgaagagtatcttccagcagcatcacaatgaatgcttaactgataatttaaaatggagagtgggaatggggtccaacatcaatttctggaagcataaatggatggaggacaactatactctccaaggaaaatatccccagttatatttaataagtaaacagcagaattcatcaatcaattatatgggagattttgtggagggtagatgggaatggaagttatcatggagaaggacttccaaatgcactttaatttctggtcaaccaatctaa

SEQ ID NO: 56621 - DNA, 549 bp, Glycine max
  Peptide Sequence Number=SeqID_148306
atggcttccatctcggaggtcatgttaaaactccagaaaaccatagaggataaagccaccgcaaccgcctccagtacagttagggaagcggagccggtgctgcagcctgccttgaatccgggcctagacagaaacacggctgtgttcgatcgaaggtatagtccgcaagcttatccttatggcctgcctccggacttcaccccccgtgccactccggaagatttaagcctagcccctacttttgaagggcaactcccaccttatgaagactatcccggacaagacgatggggaaggagatacccatcttggccccctgctccacctcaaagatccatccccgcatgaactaccccagccgaacatagtccgccatatcccagcctcacccacacccgtaaaagaatctgttccctttgcggaagataaaggaaagattgaggcgcttgaagagaggttaagagcagtcgagggcctcggtaattacccattctcggatttggcagatttatgtcttgtgcccaacatcgtcatccttcccaagttcaaa

SEQ ID NO: 56622 - DNA, 171 bp, Glycine max
  Peptide Sequence Number=SeqID_148307
cttgtaggcctaggatcttcttcatcaatggattcctttgcttcttggaagattaatggcagaggaatggagaaggaagagagagagaggagacgccactttaaggagaaaatgagtctagaagaaactcaccaccatagtgttagacaagtggcctcaaatatcttatga

SEQ ID NO: 56623 - DNA, 387 bp, Glycine max
  Peptide Sequence Number=SeqID_148308
atggcagcgcaattaatccatgatcgcgtggtgatggagtgcctagagggagtttgggagaccttcgaaggcaatgagagtacatccggaggaacccgcacgcacacttcagcggactgtggagtggatactacctacactactccatatcgactagtggagtcagttcaagtgatagaggtgtcatcctctgaagaagaccctgaagaggacctagaggagttacctcctgagcctgctgtggatgctctagactttccagaggatgatgaggacccactccctgatgtggattctccagaggatatcatgtcagcatctggggcagactctacagaggagagcggccctagagggacagcgagtagtgaagactcttcatcatag

SEQ ID NO: 56624 - DNA, 438 bp, Glycine max
  Peptide Sequence Number=SeqID_148309
gaagatgatgttgcaaaggctaaatttgtgaaagatactttgttagatgataattggtgggataaggttgattatattctttctttcactagccctatctatgatgttcttagaagaactgatacggaagcttcatctctccatctagtatatgagatgtgggattcaatgattgaaaaggtgaagaatgtcatatatcaatatgagggaaaggaagagggtgaaggatcaaccttttatgagctaagtgaagattctaacccagttcctccacatcaagacatggaactcactcgtgaaagactaaaatgcttcaagaggttctttcttgatgtggatgtaaggaggaaagtgaatattgagtttgccaacttctcggatggaagagaaggtcttgattctttagaggtcaaatggatccaaaagcatggtggctag

SEQ ID NO: 56625 - DNA, 429 bp, Glycine max
  Peptide Sequence Number=SeqID_148310
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttccggtggcatacgagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 56626 - DNA, 468 bp, Glycine max
  Peptide Sequence Number=SeqID_148311
atgggaacgctgcacgactttggctccaaagagaactcctcctataatggaaaacaaaccactcggacacagtttgtgtgggagccttacccagcaactgttatgtcgatgttgcctcccatttgtttggttggcagtgtggcgtggtgcgcagtggtgccactcatttgtttccatgttgtagagtggcaccaaccggatagggtgttgcgacaatttggaatgcaacaacctattctagagtctccttcgcaaccacagaatatccatgggctaacgctgaaaggcaaacaagatgaaaattggttccagctgttgggcccctttatcagtcagtggaataatcgagctgagtttagggtcgacatttatcctcgacaagagggcctattgagttttaactcggattacatggtctgggtgaagttgtgggatcctctagagtcgacctgcaggcatgcaagctga

SEQ ID NO: 56627 - DNA, 812 bp, Glycine max
  Peptide Sequence Number=SeqID_148312
atggcgaatcaagaggagtgggtcccgtttatggacgtattagcattgctaatctttggggttgtcctctttccaaacatggatggtttggtggacctagctgcaattgatgctttccttgcatatcaccatagcaaagagagcccggtggaaggaaaggagggagtcctcttctcatgtggggactacccaaacgtcctattgatagggacgaggggttgtattaactacaatcttgcacttgctataagacagttagggtaccccatgaggccggcggaagagagcctctctcctttctttgtgagagatttcagtgcgcaaagtttcaagattatacaaagagtccataaggcgtgggaaagcccgttaaggaaagataaagaacttaggggcattcgtaatggcatcatcggtggttatcatgaatggttgaaagttcgtacacgagggttagattggctctccaagttgataattatcaacgaggagaacttcgaagctccggaagaggatgaagaagtccgagctctaaaaacaaaactaggaaaaacaagacttgtcaaagaaaaattcaagttagtcactacagacatctggaaagagtgtgccgagttacgagaagaaaatgcggctaccgcaagagcccttgaacaagaaaccaagagggctcgcaaggaagagcatggccgagacaaattccgtggagctttgtggggcagtaacagtgagctcaagcttcgaaaggaagagagagaccaatcacgagcacatagcatgatcttaaaagaggagttagctgcttgctcaag

SEQ ID NO: 56628 - DNA, 165 bp, Glycine max
  Peptide Sequence Number=SeqID_148313
atggagataatccgctataagaaaaggctagaggaaaagaatcaggtggaacaaatgcctagaaaaatagaagttgcagccctaggattaagtttcttcctatttgcagaaagtgtgctagggaaacaaagacaaccaaagactcttagaatggtaatgtcatag

SEQ ID NO: 56629 - DNA, 534 bp, Glycine max
  Peptide Sequence Number=SeqID_148314
atgacggagagggagatgatcacaactatggtggatacgttacccacgctctactataaaaagctgataggctatatgctagctaactttgcggatctcgtctttgccggagaaaggattgaatctagactacgaaaaggcaagttcgaatatgcttccaatgtggcccccaacaacaacagaagagccccagtagtgggcgcgaggaaaaaggaaggagacgcccacgcggtcaccactgccccgacgtggatgaaagcaccccaaaatatccaaacctcataccagcctgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcacggggaagggtgtttccctttgctcctacgtattcctcaatttgggatgagaaaatcagacctacgtag

SEQ ID NO: 56630 - DNA, 501 bp, Glycine max
  Peptide Sequence Number=SeqID_148315
atggggacgaggggttgcatcagctacaatcccgttcttgctataagacaacttgactaccctatgagaggggcgctactagaggatgagctcacgcctgtcatttcacgaggcttcaataagaccaacatggagacacttcagaaggtccgcaaggcatgggaggtgttgcaaaagaaggacaaggaactcaggggcaataacaatgggcccatcggtggctatcgtaagtggttaaaagcccacgtgcaaggtttggattggcttccaagtttgagaaccgctaaaagagaggaagttgaggcaccagaggaagacgaagaggtgcaggctcttaggacagaactcgagcaagctcaaacagtcaaagaaaggttcaaatcagtggctcttaggatccgaaaggagaatgccaaactgagggatgtagctaccaccaaggccttggaacaagagaccaagagggctcgtagggaagagcacggctggaacaagttctga

SEQ ID NO: 56631 - DNA, 381 bp, Glycine max
  Peptide Sequence Number=SeqID_148316
atggaagttccgtgctgctcgccactccccgaggccaaggacggggtcgaaccgtcattccaggatttgcagtccgatacatttccattatgttacccagccaaacccgccacctcatgtgccaaagtcaaacggttgttcttccttccccgctccctctttttctacatatgcgggcggagcactctatatgaccggcggcgggttaccagagaagaggggacaacttctttctcccttgccttgctccattttccttttctgattgaaagtcgcaagccactccactactggtacagaggccagaaggttgcttcctccatatgttcaggcaaagaacatctagaagctagcttttgtcttgtaagcaaccatgcctaa

SEQ ID NO: 56632 - DNA, 186 bp, Glycine max
  Peptide Sequence Number=SeqID_148317
atggtgaagaacgatgaagaatttccacataacgcttatagaagcgtttggaaatcagaccttacccgtagttctttcagaaattttacggtaaagcattacatgttgattttatgctttgacacggaatcccatgttaaccgattaaaaacaaagaggagccgtttaagcgccgttggatcttaa

SEQ ID NO: 56633 - DNA, 639 bp, Glycine max
  Peptide Sequence Number=SeqID_148318
atgtcaatccttaccctcggaagcaaaaaaaggaaagaaggaaaatttccgatcaaagagaaagcaaaaaaaaaggaaagaaggaaaatttccaatcaaagagaaagcaaaaaaaaggaaagaaggaaaatttccaatcaaagagaaagcaaaaaaagaaaagaaggaaaattcccaatcaaagagtgggagaaagcaaaaagaaaagaaagaaaattcccaatcaaagaatgggagaaagtaaaaaaggaagaagaagaaggaaagaaagctcctgatcaaggatcgaaagaaaacagaagaaatgtgcagaaagcatgtttgcattttagtggagaaaacaccgagactttttcaagtctcacaagttatccaaaactacgtaggtctgagttcctcaatggaggatacgtaggagaaagagcctcgcttttgtcgaccacaccaccttttgttgccatgacccaagagctggtaatccgcggagaccccttacagttatccgcacctcgtcattcagtgaccccaagtgtgattgatgagcagaggccaatatggtcatttgcgccctttccggagatgtcaacatcttccggtggagattttttcaagtctcacaagttatctagaactacgtag

SEQ ID NO: 56634 - DNA, 366 bp, Glycine max
  Peptide Sequence Number=SeqID_148319
atgcggaggaactcgcctgcctcctttagcgatacttctttcttgccacaaccatcctttttctctggaagacctttcactggaatatcctcactcggagtgaggatcgttttgtcattttgttcttccactatctttgctttccccttaacgtttgcgggttgtgtcggcaggtttaactaccgagggttatcggggcgtttggggagctgcgtctttggtgaaatataccaccacaggcttaggccttccaaaacttctctcatctgcggactgcatacatatatgctgctcttcactccccttatcgccgacttccagtcggcctcgatctatcatctgttgcaacaggtcctccactgctaa

SEQ ID NO: 56635 - DNA, 723 bp, Glycine max
  Peptide Sequence Number=SeqID_148320
gtcgactctagaggatccccaactgcacattcaaaatttaaaattccagttccagtttttgaagactcaacttgcaatatccatcaaggaactcaattagctgaactattaaatcagacaagtctaatcatttgggatgaagcacccacgactcacaaattctgttttgaggcacttgatcacagtcttagagatatcatcaaacacaactcaaaggacagtaaaatctttggaggtaaagtcatggtctttggtgaagatttctggcagatcctgccagtcattccaagaggcagccactctgatattgttaacgcaacaattaattcctcttatctatgggatcactatcagatcttgagactgacaaaaaatgtgtgtttacaaaacaacatgcaagcaacaaatcaagaagaaactgcagcttttgcacagtggattatagatattggtgatgatattattggagatgaaaatgatggctatgctactattgaaattccacaggaactattaatcacagaatataatgatcctattcatagtataattagctctacatttccagatctatctcatcatcacaatgatcctgaatacttccaaaccagagcaatattagcttccacaaatgaaatagtgcaacaagttaatgattatatgcttacaatgataccgggtaatcatatagtaaattatcttattctgtttttcatcttttaa

SEQ ID NO: 56636 - DNA, 467 bp, Glycine max
  Peptide Sequence Number=SeqID_148321
caatagggccctgggatttcccgcctttgatcacaagactctgccagtcgttcggcgtccccgtcacacctagcaaggtgattcggccgcccatcacccgagcttttattgagaagtactgcacgcagagacaggtccagggtgattcaccacaggctgcagatgcgccgccacgtcatcaggctggtccagccggatcatttgatacagagcagtatttgcagcatttggttccccagcaggcggccaaccaccgggcacatagccagggctttacttcttttccgcgccctactctggaccagttcagggcagaggtcgcgtggcctggagattggcccgaggcccgggcaggagaggcaccagcggaggcaccagcagaggctcccgacgaggcagatgaggcccgcgaggacgaagagatgaccgatttacttgatttcttaggagggggcggggccacatga

SEQ ID NO: 56637 - DNA, 390 bp, Glycine max
  Peptide Sequence Number=SeqID_148322
atggcggctaactttgcggatctcagtctaggtcgccggagaaaggtattgaatccggactacgaaaaggagttcaaatatgctgccaatatggcccccaacaacacgaagagccccagtagtgggcgcgaggaaaaaggaaggagatgcccacgcgtcgggaattccctcccgactcaagtaaaaggaccacccgcagcagaaagagcgccggcccaacgcacaactgcagccgcaccccggccagttaataatacagccctcggcgcgacctataaatatgcacagcacccgcccccgaaagacaacttccctcctatccccatggcatactccgagttatggccttcattattggataatcatttggtggtggccatacccgggaag

SEQ ID NO: 56638 - DNA, 947 bp, Glycine max
  Peptide Sequence Number=SeqID_148323
gtcgactctagaggatcccacgtgtactgaaaagaggagaatagattgggaccagcttttggccgggataggaggtagaacaatcagttggttcccccgatggaaggaaggaaaagaaggagtccttttctcatgtggaagatacccaaacattccgctgataggaacgaggggttatattaactacaatcccgcgctcgctataagacaactagggtaccccatgaggggagcaccgacggaagaaagcatgtctcctttccttgtgagggatttcggcgcacaaaattccaagactatacaaagaatccataaggcatgggaaaccccgttaaggaaagatcaagagcttaggggcattcgtaatggcatcattggtgggtaccacgaatggctaaaagaaaggcgaaaacttgccaaggagaagttcaatttggccgctacacacattccaaaggagtgtgtcgggttacgggaagagaatgccactaccacggcccttgaacaagagaccaagagggctcgcaaggaagagtatggccggaacaaatttcgtggagctctgtggggtagcaacaatgaactcaagctgcgaagggaagagagggaccagtcgcgagcacatagcatggtccaaaagaagcttgtctcagcgtttatgcgagacggagaccaacatgctagctatcatgccaagtaccaagaagagttaggtctagccacggcccacgagcataggatcgcggacgagtatgcccaagtatacgcggaaaaagaggctagaggaagggtgatcgactctttacaccaagaggcaaccatgtggatggatcggtttgctcttaccttgaatgggagtcaggaacttccccgattgttagccaaggccaaagcgatggcggacacctactccgcccccgaagaaattcatgggcttctcggctatt

SEQ ID NO: 56639 - DNA, 243 bp, Glycine max
  Peptide Sequence Number=SeqID_148324
atgttgctaagtagcaatgtcatctatatctgtgtaagagtggtcatgttggtgcacatgatccgcagtcgtctctttgcagcggcacgggtgaaatcttgccccggtatgcatagtagctgtgtgatagtcctttgttgtgactcgcatagttgcctcctcctgacaggggtgaggaaccgtaagactactggtcctctaagggagtgcagagtcctcgttagaaggacagaggacgtgtaa

SEQ ID NO: 56640 - DNA, 453 bp, Glycine max
  Peptide Sequence Number=SeqID_148325
atgacgcctaccaggcaccctctggacccagataagtccaacagggccctgggatttcccgccttgatcacaggactctgccagtcgttcggcgtccccgtcacacctagcaagagacaggtccagggtgatgcaccacaggccgcggacgcgccgccacctcatcaggctggtacagccggattgtttgatacgaagcagtatttgcggcatttggttcgccagcaggcggccaaccaccgggcacatagccagggctttacttattttctgtgccctactccggaccagttcagggcagaggtcgcatggcctggagattggcccgaggcccgggcaggagaggcaccagcggaggcaccggcggaggctcccgacgaggcagatgaggcccgcgaggatgaagagatgaccgatttacttgatttcttaggagggagcggggccacatga

SEQ ID NO: 56641 - DNA, 381 bp, Glycine max
  Peptide Sequence Number=SeqID_148326
atgacgggttttaatcggaggtatagtcctcaagcctacccttatggtttgcctccggacttcactccccgtaccgctccagacgatttgagccaagcccctacctttgaggggcagctccctcctcatgctgactatcctctgcaggaagatgatgaaggagatgcccatttaggccctctacttcccctcaaggaatcggtccgccatgagttgccccaaccaaacatagtccgccacgtcccgtctccatccgcacccgttaaggaactcgttcccattgcaaaagacaagggaaaaattgatctgcttgaagagagtctgagagtggtagaaggcctcgacaactattcgttctcggatttatcggatctatgtctg

SEQ ID NO: 56642 - DNA, 345 bp, Glycine max
  Peptide Sequence Number=SeqID_148327
gccgcggacgcgccgccacctcatcaggctggtccagccggattgtttgatacggagcagtatttgcggcatttggttcgccagcaggcggccaaccaccgggcacatgtacagactcatgattgtctttatcagatgagtctcagcctgcagagccagggctttacttctttttcgtgccctactccagaccagttcagggcagaggtcacatggcctggagattggcctgaggcccaggcaggagaggcaccagcagaggctcccgacgaggcagatgaggcctgcgaggatgaagagatgaccgatttacttgatttcttaggagggagcggtgccacatga

SEQ ID NO: 56643 - DNA, 180 bp, Glycine max
  Peptide Sequence Number=SeqID_148328
aaaaagaatcagcaaaaaaggcagggggtgtatttagtaaaaaggggggtgcaaatagcaaccaggcccacttgggccttccaagatgttcctccagaaggaggttgcttctggaggaagcaacctagctcgcctgggcgagttgggtggcaagctcctcccccattttcctataaatag

SEQ ID NO: 56644 - DNA, 266 bp, Glycine max
  Peptide Sequence Number=SeqID_148329
atggcattcatggggctccgaaaaaaagtggagaatggagaattggcgaatagcgctacatcaataacttcgcggggctccagactcgttagtggaggatgcattaatagtgctaggcaatggcatttatggggctccgaaaaaaaggcgaggttggagaattgcactaagcaatcactacgcatagctccaaactcactcgttggtggaggatgcatgaatagcgctaggcaatggcattcatggggctccgaaaaaaaggcgag

SEQ ID NO: 56645 - DNA, 201 bp, Glycine max
  Peptide Sequence Number=SeqID_148330
atggatatctctgaagatactgacatccctgtaatattgggaagaccattcatgttgaccacaagcctgctccagaacacaatgtttgcttacagtcctttcgctaagcgcaagcctcgcgctaagcgcatctctgttcatgcgctaagctgcgagtctcaagtgcttagcgcccaagccttgcacctgaggttgatttga

SEQ ID NO: 56646 - DNA, 396 bp, Glycine max
  Peptide Sequence Number=SeqID_148331
atggactcgggaaggttcaaagttagtgtaccaggtaacagctaccccaggtacgccaccaactgcttgcccttcaatggcatatttgtggtggggcatttcatgcgtctcccccatgggttgagagacatgtgcatgatcagattaaggttgttggctttcaatgagtatgggagcggagttattgacatcctcactgggagtgtatgccacattgggtggtgtatagttgggaggcaagccatatggtgggaaggtgtcgcaacgtgtccttcgcgggcaagcgagggcgaggctcacgtgtgcgctttccaaaggaggaaagatgcgcggagtcgccaccaacgtttatttgtggaaaacgtcagaaaaaccgaaggaaaccggtcaaaatga

SEQ ID NO: 56647 - DNA, 267 bp, Glycine max
  Peptide Sequence Number=SeqID_148332
atgggacccttccaaaggcaagccttccgcaaagtgtacggaaagattttagatttgaccgcagtggaggtatttacggaagctgttgtatccctcgcccaatactatgaccagccgttgagatgcttcacgtttggggacttccaaatagtaccgactgttgaagaatttgaggagatattaggatgccctcctgggggaagaaaaccgtattttttctccgggtttcttccctccttgagaaagatttttacactgtcattctaa

SEQ ID NO: 56648 - DNA, 315 bp, Glycine max
  Peptide Sequence Number=SeqID_148333
atggaagataattgcacaaagaaaactggccaaatgatgtctcaggctataaaggaaattgctgacaagattgcctcacagggttcctttgtcgcccatggacatcaggatgtactgactactgcctttgggcgaccagaacgccttggtcatttgcgtgctattggagtcggggtaacgatcaagcaatactttggaccgactcaaaggacttcctgcacgtcttcctccatggctctcgaagatatggagcagctgacccaacaaatcagggaccaactagaggtgtcgatcatagaaaaagtgactcgatag

SEQ ID NO: 56649 - DNA, 162 bp, Glycine max
  Peptide Sequence Number=SeqID_148334
atgcatctatgtgatcaaggaagccttctttacaacaaagagaagaacaagatgaaagattgcaaaaatacaactggtgaagatgtctccttcacctctaggatctcacaatctcacaaactcatctcaagctctcaaaacggctcctgcttcaagttctag

SEQ ID NO: 56650 - DNA, 141 bp, Glycine max
  Peptide Sequence Number=SeqID_148335
atgaaaattagtgtgaagacaagtgccaaagctagagggaattggaaaggaggattggtgtcatcctttgaagaatctgagtcaagaagtaaggggccaaccaccttaagagctattggactaagaagcactccaaattga

SEQ ID NO: 56651 - DNA, 123 bp, Glycine max
  Peptide Sequence Number=SeqID_148336
atgtcgcgaaacttcacggattgcttaacgatgggtgtcaagttcctcgaagcggtcaagcgaaggttgcatgccatcaaacaatggtccccggacgaaattaggaagataggaggaaagtaa

SEQ ID NO: 56652 - DNA, 123 bp, Glycine max
  Peptide Sequence Number=SeqID_148337
atgaggaccactaagggaaaaggaaggagaagcttaccacccagctcgcccaggcgagctcggttgcttcctccagaagcaactgtaacgacccgcctcgtcgctacggtatccacactctaa

SEQ ID NO: 56653 - DNA, 117 bp, Glycine max
  Peptide Sequence Number=SeqID_148338
atggattcctttgcttcttggaagatgaatggcagcaaaatggagaagtgccctcaaatacaagggctgaaaaatcctacatttctagggtaccctacctacattatggagccctaa

SEQ ID NO: 56654 - DNA, 489 bp, Glycine max
  Peptide Sequence Number=SeqID_148339
atggcacctaccaggcaccctcttgacccagataagtccaacagggccctgggatttcccgccttgatcacaggactctgccagtcgttcggcgtccccgtcacacctagcaaagtgattcggccgcccatcacccgagcttttattgagaagtactgcacgcagagacaggtccagggtgatgcaccacaggccgtggacgcgccgccacctcatcaggctggtccagccggatcatttgacacggagcagtatttgcggcatttgatgagtctcagcctgcagagccagggctttacttcttttccgtgccctactccggaccagttcagggcagaggtcgcatggcctggagattggcctgaggcccaggcaggagaggcaccagcaggggcaccagcagaggctcccgacgaggcagatgaggcccgcgaggatgaagagatgaccgatttacttgatttcttaggagggagcggggccacatga

SEQ ID NO: 56655 - DNA, 455 bp, Glycine max
  Peptide Sequence Number=SeqID_148340
atggctgctagtgaccatgcaatcttgcatgatagatcacacatcccaacgaaaagaagcctgctggagctttcatcacaggatgctttgttggcacataacaagttgttatccaagcaacttgaagctttaactaaaacattaactaagttgccaactcaattgcatgctggacaacctttaccctcttttgttttgcgggttgcaggttgtgttatatgtggtggagcacatgattctggctgctgcattcccacaaaagatatagcacatgaagtgaactatatggggaatcagccaagaccaaactttaatgcagaccagggtgggccatctaacaggccacaacaacaagggcctagtctttatgacagaatgatgaagttggaagagactctttctcagttcatgcaagtatctatatccaatcaaaagagcacagagtcagccatcaa

SEQ ID NO: 56656 - DNA, 1123 bp, Glycine max
  Peptide Sequence Number=SeqID_148341
gagatgtgagaaaaatagtgcacggattgtctgttgtttacccgctctctgtgtgtggttggtttcacacctattccaacaagacacaagatacccgtgtccacttcaaagctatcgctcatgctccgaaaaaggaagagtcgattgggaccaacatttggctggaataggaggcaacacaatcaattggtttcctcgttggaaggaaggcaaggaaggagttctcttctcgtgtggggactaccctaatgttccattgatagggactaggggttgtattaattataatcccgcactcgccataagacagctagggtatcccatgaggggagcgccaaccgaagaaagtctctcgcctttccttgtgagggatctaggcgtgcaaagtctcaaggtgatacaaagagtccacaaggcgtggagaattatcaatgaggagaacttcgaagctccggaggaagatgaagaagtccaagctctcaaattagagctagggaaggcgagactcgccaaggagaagttcaaatcagccgctacacacatccggaaagagtgcaccgagttacaagaggaaaacgcggccactgcaagagcccttgaacaagaaactaaaagggcccgcaaggaggaatatggccgagaaaaattccgaggagcattgtggggtagcaatagtgagctcaagctccaaagagaggaaagagaccggtcacgggtgcatggcatgatcttaaaagaagagttagctgcgtgcgccagatccaagaggagtttggctcaacacttggaagccacagagcaaagcatgctagctatcatagggcaatacaaggaagagttgaaccagtctgtgtcccatgaacaaaagctagtggaggattttgcacaagtgtacgccgaaaaagaagcaagagggagggtgattgatgcattccatcaagaagcgactatgtggatggataggttcgccttgaccttgaatggaagtcaagacctcccgcatctattagccacagcaaaagccatggcagaagtgtgtacggcccccgaggagattcatgggctaatcaattactgtcaacacatgatagatttgatggccaatataattagaaatcgttag

SEQ ID NO: 56657 - DNA, 147 bp, Glycine max
  Peptide Sequence Number=SeqID_148342
atggagaattgcactaagcaatcactacgcatagctccaaactcgaagaaaacgcaattcatggggctccgaaaaaggttgagaatggagaattgcactaagcaatcactacgcatggctccaaactcgaaggtggaggacacgtga

SEQ ID NO: 56658 - DNA, 252 bp, Glycine max
  Peptide Sequence Number=SeqID_148343
atggagaataaagatcataatgaagaagaaaggaatagaagagggaatgatggtgttcctagaccaaaccgaattgatggtattaaactcaacattcctccctttaaaggaaagaatgatccggaggcctacttggagtgggagatgaaaatagaaagccattctcctatcctgggttatggagaattcgtccctaacagtcaaccacttaatccaaccctatttcaatttactaagcgaaaatcaacttag

SEQ ID NO: 56659 - DNA, 159 bp, Glycine max
  Peptide Sequence Number=SeqID_148344
atggaaaacgccagcaacgcggcctttttacggttcctggccttttgctggccttttgctcacatccgaacgaccgagcgcagcgagtcagtgagcgaggaagcggaagagcgcccaatacgcaaaccgcctctccccgcgcgttggccgattcattaa

SEQ ID NO: 56660 - DNA, 471 bp, Glycine max
  Peptide Sequence Number=SeqID_148345
atgttggatcaatttcatccatgcattcatgattccactgaaaacgttattcatgtcaaagttgatggtaattatggatatcatgcaattgttgccttattatgtatgagtgaagattcatggtctttggttcgcaaccatttgcttaaagaacttgcaaaatggtcttatcagtatatcaacctacttggtgacatagacagatttgagaaattaaagcgatccctacttgttgatggattatccatggttaccatggataagtggataaatataaccagcatgagatatgagattgcatcaagtctccaccaaccacaaaaacgtgagaaaccgacaaagagggaagagacacttacgatggcgaagcataacacaatgacgactgcgctggcagagactgacagcatgaatgatggcaacgtcgcagagagaacatcaaacgaagaacgaagaagagaaagcacataa

SEQ ID NO: 56661 - DNA, 402 bp, Glycine max
  Peptide Sequence Number=SeqID_148346
atggatatctctaaagatactgacatccctgtaatattgggaaggccattcatgttgaccacaagttgcatagttgatatggggaaaaggaagctggagctaggtttcgaagatcagaaaattgattttgacttgtttgttgaaagcaagcctgctctagaacacaatgtctacttacaggtaacggaaggaggtcaagaggttctgaaaaaaagcagtcctttcgctaagcacaagcctcgcactaagcgcgtctctattcatgcgctaagccgcgagtctcaagcgcttagcgcccaacccttgcatctgaggctaattcattccactaagcaagccaaggccaagctaagcctaatcaaattcgatctgaatttggctaagcggcagccaaacctctaa

SEQ ID NO: 56662 - DNA, 474 bp, Glycine max
  Peptide Sequence Number=SeqID_148347
atgtatatatatgtgtggaaatggctccgagaaagcttcatgcaaagagatccaggaaggacaaagcggctgaagggaccagtgtcgctcctgagtatgacagccatcgtttccggagtgctgagcaccagcagcgtttcgaggccatcaaaggatggtcatttcatggaagagatagctcgccggcggtggacatcgctggttacccccatggccaagtttgaccctgatatagtcctggaattttatgccaatgcttggcctacacaggaggatgtgcgggatatgcgatcttgggtgaggggtcagtggatccctttcgatgcggatgccctcagccagttcctgggataccctttagggctggaggagggccaggagtgcgagtatggccagaggaggaaccgggccgatgggtttgatgaggaggccatcgcccagttgctgtgcatagcaggtcaggattttgcctag

SEQ ID NO: 56663 - DNA, 1440 bp, Glycine max
  Peptide Sequence Number=SeqID_148348
atgaaggttatgcagaaatcctctttagcgggaagacaatcacagaatctggagataggggacaacaacaaacactatcgccttaactggaggaacaatgccgacattacctccttttatttcacccatttccccgacgaagctaatgcagagttgctatggaggcacttcaaaaagtggggtgacgtacgtgaagtatacatcgctaaaaggctcaacaaggatggcaagagatacaggttcatgcggttcaagggagtctcggatgcaaaaggattggaggtgagactggacaacatcttcatcaacgattgtaaactatttgtcaaccttcctaggttcgacagaccagttcggaatacagagttgctgaaaaagaaccccattgggaggaagtacaccgacgaagcaagtaagccctgcggggtaactactggtgctcttcggagatcatatgtggacgtggtgactaaaggggggtgccaaggagacaaaaggacagacgaggcacaaacaccaactattctgatcaacccagatgaaggcggggaatattggtgtaacgaaacctgggtgggcatgctaaagaaggtgatggaggtggaaaccttagaggatcgtatcacttgggagttaggatataacgtccgcactaagttcctcggagacgacatggttcttctccctgggatgtccgatgacaaagctaaactcctcattcaatcagagacggaaagcgatgattctctcttttactcactggagaagtggacgccgaaatgtagacccaataacagggttgtttggctccaactgtggggattttcgatacaggtgtgggaaatgaaaaatctcaggagggctgtagctgctattggggatgtcatcgagtcagacgatgacacagaggaccgccgacgattggaccgggctcgagtattggtgcggacaccgcttccgccgttgataaggtcagaggtcatcgtccgtgtgggggagcttgagtatcgggtatggattgtggaagagacagggttcgaaggtgggtcgaaccggaaaggaagctcgtcgtccgatgggtggtcggagatgataacatcggacgacggtggggaggttggcgatgttcttgacgacactaataccaatttctccttctcgtcggagctgcccaaccagaaattgtctccgtctcgtacccaacgggcagaaggagggaccgatgtgcgctgctgtgatcttagacccctaggtaatatccaggcagacgttacacccaaagaaaagtcaaaaggcactgtagaaggtatgctaggctctagctttggtaagctcaacctagcggacaacttcgcaggaacagaagaggaagctgctaacaccaaagaggtaacctgctatataccctacaggatgatcaaaggcacaggaatcacatag

SEQ ID NO: 56664 - DNA, 369 bp, Glycine max
  Peptide Sequence Number=SeqID_148349
aacgctgatagcatgcaggggctgacacagtcttctgcaccttttgttcctccgggaacaacaaagtcatttacatgcggaaatttcatggtcgcccgcgactctcgtcaaccgagaggagcgaaattagtgtcatacactgattttcggtttccgcacctttgcgacatgtcagaccattctttggtccttgtgaggtgtcgttggcacgcagagaccaagttttggtcaatttgccatgacctacgcggagacaagtctacggtttccgcacccctttgccattcagacacagtcgtgtcacgagaggcagcagagacattagtgtcatttgcacacatgattttcgggagataccttacggcttga

SEQ ID NO: 56665 - DNA, 456 bp, Glycine max
  Peptide Sequence Number=SeqID_148350
atgggatcaagtcaaatgccttcgctcaaaaagaggttctatcaagtcaaggtcaagagcacagggatcactagtctaaaagagttagggaagttaatggggcagctccagcaacaagcttttcgcaaagcttatggtaaaatttgggacctagccatggtagaagtctctacagaggccattgcctccctcgcccagtattatgatcagccattgagatgcttcacctttggggacttccagctatcacccatggtagaagaatttgaagagatcttaggatgccctctaaggggaaggaaaccatacctcttctcaggtttctatccctctttagctagaattgctaagatagtccaaatctcggcacaggaattagaccacagaaagcaagtcgaaaatggggtggttggaataccgagaaaatgtttggaggcaaaaatcttggcaggttga

SEQ ID NO: 56666 - DNA, 126 bp, Glycine max
  Peptide Sequence Number=SeqID_148351
atggcttctatggatacctctgctatggtcaactctaagaatctttccgtggtatctaggccttttaaccttgacttggtaaaacctcttgccggtttgatttgtcccccatgcttactaaagtga

SEQ ID NO: 56667 - DNA, 106 bp, Glycine max
  Peptide Sequence Number=SeqID_148352
atggagaattggcgaacagcgctactcaataacttcgcggggctccggactcgtggaggatgcatgaacagcgcctggcgtgacgttcgtggtgctcagttgcaaa

SEQ ID NO: 56668 - DNA, 484 bp, Glycine max
  Peptide Sequence Number=SeqID_148353
atgccttcgcttaaaaagaggttctatcaagtcaaggtcaagagcctagggatcaccagtctaaaaaagttagggcagttgatgggtcagctccagcggcaagcttttcgcaaagcttacggtaagatctgggacctagccatggtagaagtctccacagaggccattgcctccctcgcccagtattatgatcagccgttgaggtgcttcacctttggggacttcgagctatcacccatggtggaagaatttgaagagatcctaggatgccctctagggggggaggaaaccatacctcttcacagggaagcaagtcgaaaatggggtggtcgggataccgagaaaatatttggagtcctctttccgaatgtggatgggttggtggacctggccgcgatcgacgcttttctcgcctatcataaccacaaggaaagcccggttgttgctatgctagccgacctatatgacaccttcgaccgaagat

SEQ ID NO: 56669 - DNA, 576 bp, Glycine max
  Peptide Sequence Number=SeqID_148354
atgttggcactgatgaaggtgtcagtgaagtgcttcatgtggcaggagaaaaaggctgcaccggtgcgtcagcagatatgtgatacaggatatattccgcttcctccgctcactgactcgctacgctcggtcgttcgactgcggcgagcggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtccgaccgctgcgccttatccggtaactatcgtcttgagtccaacccggaaagacatgcaaaagcaccactggcagcagccactggtaattgatttagaggagttagtcttgaagtcatgcgccggttaa

SEQ ID NO: 56670 - DNA, 624 bp, Glycine max
  Peptide Sequence Number=SeqID_148355
gaggccatcgcccagttgctatgtataccggggcaggattttgcccggactgctgccgggagacgggtgcggatcatgcgcaccaacatgaccaccctgactcagatctggatgactttgctgctcagcaacatccagcccagcgaccataattccgacctccccctgccgaagtatggcgctaccaggcaccctctggacccggataagtccaacaggcccctgggatttcccgccttgatcacaggactctgccaatcgttcggagtccctgtcgcacctagcaaggtgattcggccgcccatcacccgagcttttattgagaagtattgcacgcagagacaggtccagggggatgctccgcaggccgcagacgcgccgccacctcatcaggccggtccagccggatcgtttgatacggagtacctgcagagccagggctttacttattttccgtgccctactccggaccagttcagggcagaggtcgcatggcctggagattggcctgaggcccgggcaggagaggcaccagcagaggctcccgacgaggcagatgaggcccgcgaggacgaggagatgaccgatttacttgatttcttaggaggaagcggggccacatga

SEQ ID NO: 56671 - DNA, 130 bp, Glycine max
  Peptide Sequence Number=SeqID_148356
atggcttttcaaataagatgtgtttaccttgtggttgctttagatgttattgccatggttgatgaagtggttgaagatgaaaggtcgatcgttattcttttgacacatggcaggatcaaggaagcgcaag

SEQ ID NO: 56672 - DNA, 54 bp, Glycine max
  Peptide Sequence Number=SeqID_148357
ggtgtcacagggactaaaaagtatggtattagccgctacctcagtatcaaatga

SEQ ID NO: 56673 - DNA, 495 bp, Glycine max
  Peptide Sequence Number=SeqID_148358
atggttaaaaaggaaagtgagacctttaaagagtacgctcagcggtggagggacctggcaacacaagtggcccctcccatagtcaaaaggaaaatgattaccatgatgggaagcgattactctcctctctcaagtaccaatgctaggaggatcggagcaactggggcaaaaaggaaggaaggagtacccatgttggtcacttcagcgctccgcatggacaatgccacccagacctctcacggtcacccatcagtacgcgcaacatcacccgagcttctcagctcgcgcaaaggagacctcttccaattcagcacccgagagttacaacctagagcgcctcagcgcccatgccagagggagccccccaagctccggttctccaaccccgactcgcccggccggcaacgccagcacttggcgccggttccaaccgcgataaggaacattcccgcacaaggccaactgtgtctagaagttcaccgccgcccgcaatga

SEQ ID NO: 56674 - DNA, 351 bp, Glycine max
  Peptide Sequence Number=SeqID_148359
atgttacaggcatgccccattgcttcagaatgcaccctaggcctaaggccatcccttacaacccctcaattcaacaaaaacaagcaacaatttgaggataaatccctcacgttttttagcaaatacatgcaatttagagcaccaaaatacatcaatggaaagctagagagcccaagaatgagagttcaagataagaatcaagaagaattcaagattcaagaagaaagtctagagacaagaatcaagattcaaggttcaagatctcaagaatcaagatcaagactcaagattcaagaatcaagagaagactcaatcaagataagtattaaaagagttttgaatagcacatga

SEQ ID NO: 56675 - DNA, 587 bp, Glycine max
  Peptide Sequence Number=SeqID_148360
atggtgccaaaaaagcctccagtcaagagttccaggaaagacactgctagagagggttccagtgcggccccacaagaagatgtggactttgatagacacagctggtcgttcctcaaggagaggcgagtccagctgagggatggggagtatgttgagtttcaagaagaaattgcccagaggcaatggactcaactggtgtcacccatggctaagccagtgaatcccttcgatgaggatgccattaaccagtttctggggcatccattggtcttggaggaaggccagcactatgagtttagccagaggaggagtcaggcctctggcttcgacgatgaggctattaaccagttgctatgcatttcggggcaggatttttcccagagcgtagtagggaaatgggtgcagatcatgcgcaccagcatgactaccttcacacaaatttggatgacattgatgcttagcaacattctccctagcgaccataacttagaactccccctgctgaagtggatagcgcctcctagacaccccgtggacccggagaagtccaatagggccctaggttttcctgctttgatcacaggcct

SEQ ID NO: 56676 - DNA, 216 bp, Glycine max
  Peptide Sequence Number=SeqID_148361
atgggagtgcagatagcaaccaggcccacttgggccttccagaatattcctccagaaggcggttgcttctggaggaagcaacctggctcgcctgggcgagctggggggaggagtgaagaagaaagaggttcagccctcttggcatttcgtaatcacttaaaattagtgaggaaaattgtttccgtgaagaaaattcaagccgaggcgcttccgtaa

SEQ ID NO: 56677 - DNA, 99 bp, Glycine max
  Peptide Sequence Number=SeqID_148362
ggagaaattttacactgatttagctaattttgaagccatttcagcagagggagagcaagtgaaatttggactgacaacaactagaaatttgcctgaccg

SEQ ID NO: 56678 - DNA, 192 bp, Glycine max
  Peptide Sequence Number=SeqID_148363
atggagtttaagcaacctgaggtgttattggtaaacaaggttcatcaatttgaggggagaaaaaggccacttgaggcattagcagatatgggactaaatggagagtacaatttgaaggacttaatgacattggtggattcagtcaaattgaagaaaaagggtagtactgggcagagtacaatgaaagagtag

SEQ ID NO: 56679 - DNA, 528 bp, Glycine max
  Peptide Sequence Number=SeqID_148364
atggagagaagtatgatagatgctgccagtggtggagcccttggagacatgactcctgctgaagccagaaatttaattgagaagatggcttccaactcccagcagtttagcgctagaaatgatgctatagtcattagaggatgcatgagggtttgtggtttgtgctcctctactgaccaccatacagacctttgcccttccatgcagcaacctggagcaattgagcagcccgaagcttatgctgcaaatatttacaatagacctcctcaacctcagcagcaaaatcaaccgcagcagaacaattatgacctctcctgcaacagatacaaccctggatggaggaatcaccttaatctcagatggtctagccctcagcaacaacaacagcagcctgctccttccttccaaaatgttgctggcccaagcagaccatacattcctccaccaatccaacaacagcaacagccccagaaacagccaacagttgaggctcctccacaaccttccctcgaagaacttgtgaggtaa

SEQ ID NO: 56680 - DNA, 660 bp, Glycine max
  Peptide Sequence Number=SeqID_148365
atggagaggagtatgattgatgctgccagtggtggagcccttggtgatatgactcctgctgaggctaggaatttgattgagaagatggcttccaactcccaacaattcagtgcaagaaatgatgctattgtccttagaggagtccatgaggtggccacggattcatctttatttgctgaaaataaaaagcttgagggaaaacttgatgtcttggtcaacctagtaactcagcttgccatgaatcagaaatctgcatctgtacctgttgcaagagtctgtggtctatgttcttctgcagatcaccatacagatctttgtctttctttgcagctatctggagtcaatgaacaacctgaagcttatgctgcaaacatttataatagaccccctcagcaacaaaaccaacaacagcagactaattatgatctttcaagcaacaaatacaatccaagttggaggaataatccaaatctaagatgggcaagtcctccacaacaacaacaacctgtccctcctttccagaatgttgctggtccaagaaagccatatgttcctcctccaatgcagcaacaacaaagacaacaagccactgaggctcttcctcaaccttccttagaagagttagtaaggaaaatgaccatccagaatatgcaattttag

SEQ ID NO: 56681 - DNA, 987 bp, Glycine max
  Peptide Sequence Number=SeqID_148366
atggacgtattagcattgctaatctttggggctgtcctctttccaaatgtggacagtttggtggacctagccgcaatcaacgctttccttgcatatcaccatagcaaagaaagtctggtggtagctgtcttggcaaacttatttgatacatttgaccgaaggtgcaagaagagtagcgcacggatcatctgttgcttgcccgctctttgtgtatggttggtttcgcacctgttccaacaagacataaggcatccatgtctgcccctaagccatcgcttgtgtgtcaaaaagagaagagtagattgggaccaacacttggctgggataggaggtaaaacaatcagttggtttcctcgatggaaggaaggaagggagggagtccttttctcatgtggggagtacccaaacattccgttgatagggacgaggggttgtattaactacaatcccgcacttgctataagacagttagggtaccccatgaagggagcatcgacggaagagagcctctctcttttccttgtgagagatttcggcgcgcaaagtttcaagattatacaaagagtccataaggcgtgggaaagcctgttaaggaaagatgaagaacataggggcattcgtaatggcatcatcggtggttatcatgaatggttgaaagttcgtacacgagggttagattggctctccaagttgaaaattatcaacgaggagaacttcgaagctccggaaaaggatgaagaagtccgagctctaaaaaatggactaggaaaagcaagacttgccaaagaaaaattcaagttagtcgctacaaacgtccggaaagagtgtaccgagttacgagaagaaaatgcagctaccgcaagagcccttgaacaagaaaccaagagggctcgcaaggaagagcatggtcgagacaaattccgtggagctttgtggggcagcaacaatgagctcaaacttcgaagggaagagagagaccaatcatga

SEQ ID NO: 56682 - DNA, 1032 bp, Glycine max
  Peptide Sequence Number=SeqID_148367
catctggccggacccggccaagctcaccgccctgtcgctgacgccgggcgacatcgtctcggccctgcgcagccacaacgcgcgcgtcaccatcggcgaactgggcaaccaggccgtgccgcaggacgcgccgctgaacgccagcatcgtggcgggggaatcgctgcacacgccggaacaattcgccaacattccgctgcgggcgcaaccggacggcgccacgctgcgcctgaaggacgtggcgcgggtggaactgggcggcaccgactacatgtacctgtcgcgcgtcaacggcatgacgggcaccggcctgggcatcaagctggcgccgggctcgaacgcggtcgagaccacccgccgcatccgcgaaaccatgcacgaactggcgcagtacttcccgccgggcgtgagctgggacatcccgtacgagacctccaccttcgtcgagatctcgatccagaaggtgctgatgacgctgctggaggcggtggccctggtgttctgcgtgatcggcgccatcgtcggcatcacggtggtgctggtgtcggtgttcgtgccgatggcgttcttcgacggcgcggtcggcaacatctatcgccagttcgccgtgacgctggcggtgtcgatcgccttctcggccttcctggcgctgtcgctgacgccggcgctgtgcgccagcctgttgaaaccgatcccggccggccaccacgagaagcgcggcttcttcggctggttcaatcgcgccttcgcgcgcctgaccacgcgctatacggcgcgcgtggccggcgtgctggcgcggccggtgcgcttcgggctggcctacgcgctggtgatcggcgtggcggcgctgctgttcgcgcggctgccgtcgtcgttcctgcccgacgaggaccagggcagcttcatggccatggtgatcctgccgcagggttcgccgcaggccgagaccatggccgtggtcaaggacgtcgagcgctacatgatggagcacgagccggtgcagtacgtgtattcggtcaacggcttcagcca

SEQ ID NO: 56683 - DNA, 201 bp, Glycine max
  Peptide Sequence Number=SeqID_148368
gctcataagaaccctagggccttctcttgcatctctagcccaatctacttggagttttctatccaatgcccttgcggggtaggattgcatcattccctcccccttgaaaaggatttgacctcaaatcccgaggtaaggtctgaaaactcatttcttgggcatcttcccatgaaggaacatggttcctcaccaactcaatga

SEQ ID NO: 56684 - DNA, 501 bp, Glycine max
  Peptide Sequence Number=SeqID_148369
atgggatcaagtcaggcgcctccgcttaaaaagaggttctatcaagtcaagatcaagagcctaggggtcaccggtctaaaagagttgggacagttgatggatcaactccatcgacaagcctttcgcaaagcttatggtaagatctgggacctaaccatggtagaggtctccacggaggccatcgcctcccttgcccagtattatgaccagcctttgaggtgtttcacctttggagacttccagttaatacccacggtggaagagcttgaagaaatcctaggatgccctctgggaggaaggaaaccatacctcttctcgggattctatccctctttagctagaatttctaagatagtcaaaatctcgacacaggaattagaccgcggaaagcaaatcgaaaataaggtggtttgggtaccgaggaaatgtttggaagtaaaacgattgatgcttttctctcctttcacgattgcaaggaaaacgcatttgtcgctatcttag

SEQ ID NO: 56685 - DNA, 231 bp, Glycine max
  Peptide Sequence Number=SeqID_148370
cattccataactggtgaatctgtgcattctgttattggtgattttgaacatcctgatcttgagcattataattttgagcattataattttgagcattctgattctgagcattctgattttgcacattctgagaacatggcacaacctccacctcgtgagcggactctaagggaaatggctgcacctgatttcacctatgaaagcttgtgcatccaataccctgatgaggat

SEQ ID NO: 56686 - DNA, 451 bp, Glycine max
  Peptide Sequence Number=SeqID_148371
atgccttattcatcgaaccgggaactgccggacagcgtgcgccacgtgctgccgggccatgcgcaaaccatctaccaaaaggcgtttaacagcgcctgggatcagtataaagatgaagacgatcgtcgcggtgatgaatcgcgcgagcaggtggcacacaaagtcgcctgggcggcggtcaaaaaagagtacgccaaaggcgaggacgacaagcagccgatgctatttacagataatttcccctttgtgatcggggtcaatcttgaaacgtttatggcaaatgcattactgtcttgtcttaagtcgacgccgcgtgcgccgcctgtaaaatcgcagattcagggagccataacgacaggaagcggattgcaaacttcatttggtgatattgacgaagcgctgctgtggagctgtgagaaacgcgccgcgtcgctctgcgccacgcttgcct

SEQ ID NO: 56687 - DNA, 399 bp, Glycine max
  Peptide Sequence Number=SeqID_148372
atggataatgaagagggcgtgcaggaacagatgaaggccgatctatcggacttaaaagatcaaatggcttccatctcggaggtcatgttaaaactccagaaaaccatagaggataaagccacggcaaccgcctccagtacagttagggaagcggagccggtgctgcagcccgccttgaatccgggcctagacagaaacacggccgtgttcggtcgaaggtatagtctgcaagcttatccttatggcctgcctccggacttcaccccccgtgccaccccggaagatttaagccaagtccctaggtaccgagctcgaattcgtaatcatggtcatagctgtttcctgtgtgaaattgttatccgctcacaattccacacaacatacgagccggaagcataa

SEQ ID NO: 56688 - DNA, 462 bp, Glycine max
  Peptide Sequence Number=SeqID_148373
ggtaggttgcgacacccttttgccattcagacgcagttgtgtccgatggcacgcagagacaaattatggtcattctgcgcccttttgtcatccagaggcggcgggcccgatgacatgcggagacaaattatggtcattccgcacacccttttgccattcaaacgcagttgtgtccgatggcacgcagagacaaattatggtcattctgcacccttttgtgatccagaggcggcgggcccgatgacatgcggagacaaattatggtcattccgcacacccttttgccattcagacgcagttgtgtccgatggcacgcagagacaaattatggtcattcttgcacccttttgtgatccagaggcggtgggcccgatgacatgcggagacaaattatggtcattccgcacacccttttgccattcagacgcagttgtgtccgatgacatgcagagacaaattatg

SEQ ID NO: 56689 - DNA, 261 bp, Glycine max
  Peptide Sequence Number=SeqID_148374
atgaatcagcaaaaaaaagcaaaaaggggtgtatttagtaaaaagggtgtgcaaatagcaatcaagcccacttgggccttccagggggttccaacagaaggcgatgccttctggtggaagcaacctagctctgagaaaaattgtttccgtgaagaaaatccacgccgaagcgcttccgtaacgcttccgagacgtttcagtgaacgatttcgtgaagattcttcaccattcttcgttcgttcttcggtcttcaaccggtaa

SEQ ID NO: 56690 - DNA, 423 bp, Glycine max
  Peptide Sequence Number=SeqID_148375
atgtcggtgcgcgtggcagacgaagtgttcattctgccgctgaacgcggtgatggagtcactgcagcccacggctgaagagctgaaaccgctggccggtggcgagcgcgtactggaagtgcgcggcgagtacctgccgctggttgagttgtggaacgtgtttgacgtgcagaacgccaaaaccgacgccacgcagggcatcgtggtgatcctgcagagcgcaggacgtcgctatgcgctgctggtcgatcagctgattggtcagcatcaggtggtggtgaagaacctggaaagcaactaccgcaaagtgccgggcatttccgccgccaccatcctcggcgatggcagcgttgcgctgattgtcgacgtatcggcactgcaatcattgaaccgtgagaagcgtgtggccggtgccgcagcgtaa

SEQ ID NO: 56691 - DNA, 519 bp, Glycine max
  Peptide Sequence Number=SeqID_148376
atgaccaccctgaccataatatggatgagcattcacgtggctcagttgatcgctgatgtcatctatctatttgcagtccccgtcgcaccaagcaaggtgattcggccgcccatcacccgagcttttattgataagtattgcacgcagagacaggcccagggggatgctccgcaggccgcagacgcaccgccacctcatcaggctggcccagctggatcatttgatacggagcagtatttacggcatttggttcgccagcaggcggccaaccaccgggcgaatgtacagacccatgattgtctttaccagttgagcctcagcctgcagagccagggttttacttcttttccgtgccctactccggatcagttcagggcagaggtcgcatggcctggagattggcctgaggcctgggcaggagaggcaccagcagaggctcccgacgaggcagatgaggcccgcgaggacgaggagatgaccgatttacttgatttcttgggagggagcggagccacatga

SEQ ID NO: 56692 - DNA, 803 bp, Glycine max
  Peptide Sequence Number=SeqID_148377
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggtcttgctctgtcaccaggctggagtgcagtggcatgatcttcttggctcacagccacctctgcctccaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 56693 - DNA, 303 bp, Glycine max
  Peptide Sequence Number=SeqID_148378
atgacgggaactgattcacacacaactatgattaatggcctgggtgttgctggatggggagttttgccccaaaaaagaagggatatatatggtgcttgggagcaatatcttggactgaaacacgatgacagtgctccaaaaaagtcctatgcagtcaaccaagaaataaattgttgctttgttgagtggatgtgcaagttgaggtgcaatatcagcaaaaaggtggatgcacaatatcaacaaaagcttctttgggaaatatcattgtcattcaaattgcagctgaaagcaggcttaagataa

SEQ ID NO: 56694 - DNA, 425 bp, Glycine max
  Peptide Sequence Number=SeqID_148379
atgactcaatctcttgctttctcaaaagggtggacccttggagggttgcacgccctcaccttcagagggctccacgccctcgccttcagaggactacacgtccttgcctttagaggactgcacgtcctccacttaagaagaccacacgtcctcgccatcagaggactaaacatcctcgctttccgaggactacacattctcgccttcagagggctacacgccttcgccttcagggagctgcacgccctcaccttcaaagggctacacgccctcaacttcagaggactacacgtcttcgccttgaggactacatgtcctcaccttcagacgactatatgtcctcacactaagagggctacacgccctcgccttctgaggactacacgccctcgccttgaggagtacacgtccacaccttcacgagg

SEQ ID NO: 56695 - DNA, 966 bp, Glycine max
  Peptide Sequence Number=SeqID_148380
atgagtgattttctgttaaacgcaggtcgccagaccctgatgctggaactgcaggaagccagccgcctgccggagcgtctgggcgaggagtttgtgcgcgcggccaacaccattatccagtgcgaaggaaaggtgattgtctccgggatcggtaaatccggccatatcggcaagaagattgccgcgaccctggccagcaccgggacaccggcgttcttcgtgcatccggcagaagcgctgcacggcgatctggggatgatcgaaagccgcgacgtgatgctgtttatctcctactccggttcagccaaagagctggatctcatcattccgcgcctgcaggaaaaggcggtcgctctgctggcgatgaccggaaaatcccgctcgccactggcgctggccgccaaagcgacgctggatatttccgtggagcgcgaagcctgtccgatgcacctcgcccccacctccagcaccgttaacacgctgatgatgggcgacgcgctggcgatggcggtaatgcaggcgcgcggctttaacgaagaagattttgcccgttcgcatccggcgggcgcgctcggcgcacgactgctcaataaagtgcaccatctgatgcgtactgacgatgccattccgcaggttaagctcgataccagcgtcatggacgcgatgctggaactcagccgcaccggcctgggcctggtggcggtgtgtgacaacgagggctttgtgaagggcgtctttaccgacggcgaccttaggcgctggctggtgggtggcggcaagctggaatcgcaggtgtcagaagcgatgacccagggcggactaacgctgaacgccgagagccgcgctattgaggccaaagagagcctgatgaaacgcaaaatcaccgccgcgccggtggtggatgacgccggcaaactgtgcggcgccatcaacctgcaggatttctaccaggccgggattatctaa

SEQ ID NO: 56696 - DNA, 316 bp, Glycine max
  Peptide Sequence Number=SeqID_148381
atgttggaaagttttaaacaacaagaacaaatgtcagttcttgaattgtacatagaaaagggtgtggctagtggttcaatgtttcattctgcaaattcgcttacatcatgtggaaattatttatctaatgacgagacacaaccgacaacaaatatgagcaatttacatattgacgaagacgatgatgattatcttgtgtctaactcatacgttgaagaatctttagacgaagatgacagtgttgacggtgtatctgaatccgacgatgaagtcaccaacattcctcagacagtaaggattgttcacccagcagaag

SEQ ID NO: 56697 - DNA, 252 bp, Glycine max
  Peptide Sequence Number=SeqID_148382
atggaatacttacttgttggtgatgaacaaaagcgcaaaacggaatcaaaaaatgcgaaaaaggatgaccctagggctgcaaattcgtcaatcccgtgggtatggcttttgaagggggggaaaagagtaaagaaagctgcaaaatacaaaggatacggggctgccttgcagcgacattccctgcttgtttcgcatagagaagggcaacgatcggtcggtcgtgaccccatccccgcttgcgttcatccttaa

SEQ ID NO: 56698 - DNA, 141 bp, Glycine max
  Peptide Sequence Number=SeqID_148383
atgcttgaaggaaatgatgcaattgctgcagcacctactgtagacaaaggatcaagccgatgttttgatgatgccaaaagatcgcatgcgtctcaaagctttattcaagacaaagcaattaaagatattcaagatggatga

SEQ ID NO: 56699 - DNA, 366 bp, Glycine max
  Peptide Sequence Number=SeqID_148384
atgaccacccttactgaatggatgacgttgctatttagcaacattctgcccagtgaccacaatgccaatctccccctgcagatggatcgcgcccacaagacacccagtggacccgaaaaagtccaacagggccctggggtgtccagctctggttatgggcctctgttagtcctacagggtgcccgttcccccagcgaggaatcgcacccacaaagacacccagcggacccggagaagtccaatagggccctggggtttccagctctggttacgagcctctgtagtcctacagggtgcccgttccccccggcaaggtcacgtcataatgacataggtaagtatacacatcgctcaactgatttctga

SEQ ID NO: 56700 - DNA, 600 bp, Glycine max
  Peptide Sequence Number=SeqID_148385
atgattatgaggggtcaagacatttatagtagccaagaagaggctactacaccttcctctagtgaaagtgaagaagcaaaaggggaagactctagtgaagaaatctatccccaagaagaaggacaacctttaatggttaacgaggagtgtaaggagacacttgttaccactcccacacctcttgggcttgaggttattcctcaagtaaagaagttgttggatgagggtttgggaagaagaagacaaacacacaagagtttttatactggttcggcaacaacatgtgcctacatccagtccccaagtgacctgcggtccttgagatttcttttcaaccttgtaaaagcctttacaagcaaagatccacaagggatgtaccctcccttgttctctttgaacaacctagtggatgtaccctccactagaactgatccacaagagatgtaccctctcttgttctcagttacaacaacccaagtagatgtaccctctacttgtaccacaaaggatgtaccctccaatgtgttaagacaaagttctcaggcggttagtcctttgaaacattgtgaaggggaaacaagagaattctcaggcggttag

SEQ ID NO: 56701 - DNA, 495 bp, Glycine max
  Peptide Sequence Number=SeqID_148386
atgtataactttccgttacattgcattaatgcatacgaagtctgcatttaccgcatttcaagagaaagtaccctcaccttcagaggcctacacaccctcgacttcagagggctacacgccctcgccttcagaggactacacgtcctcgccttcagaggactacaggtcctggcctttagaggactacacgtcctcaccttaagagggctaagtaccctcaccttcagagggcaacacgccctcgccttcagaggactacacgtcctcaccttaagagggctatgtaccctcaccttcagagggctacacgccctcgccttcagaggactacacgtcctcaccttcagagggctacacgccctcgccttcagaggactacacgtcctcgccttcagagggctgcatgccctcgctttcagagggctacatgcccttaccttcagaggactacacgtcctcgccttcagaaggctacacgccctcgcccttcagagg

SEQ ID NO: 56702 - DNA, 213 bp, Glycine max
  Peptide Sequence Number=SeqID_148387
atgtttggaagcaaagcgagagtcttggcaggtaaaggcgaatgggccccattcatggacatcctggcacttttgatcttcggggtggtcctctttccgaatgtggatgggttggtggaccgggcagcttttgatgcttttctcgcctttcatgaccgctgggaaaatcggcttatcgctacctccaacaatctatatgacaccttcgactga

SEQ ID NO: 56703 - DNA, 282 bp, Glycine max
  Peptide Sequence Number=SeqID_148388
atggagtgcaacatctgtggtgtaaataaaaaatatgaaggtcctgtagataagggagctggaagtgctggtgtctctggtgctgctgaagtagtggggacctctgatttgttacccctggccttccttggccctccaaatgacaccgttaatcctctggccttgcataaagctgtgatcaaggcagggaatccaagtctggatgtatcatgctatgcagtgacattagatgtgtgggatgtaggaatcaggttagagaaggaaagaacactccatgtctga

SEQ ID NO: 56704 - DNA, 219 bp, Glycine max
  Peptide Sequence Number=SeqID_148389
atggggatacaaaagaattctcaggcgggagaagggagaagagagacacaaaaagaattcaagcggttagtccttggaaaattctttttggcaaagggagaagagaatgaaaagatgaatagcacaagttttcaagatttggaaaaccagaaaacttcagaaaacttttggtacaaagaagaagaagttcaaagagattcaaggcttgtaaaagattga

SEQ ID NO: 56705 - DNA, 162 bp, Glycine max
  Peptide Sequence Number=SeqID_148390
atgggagaaagtaaaaaggaagaagaagaaggaaagaaagctcctgatcagggatcgaaggaaaacagaagaaatgtgcagaaaggaaataatttgcaaagtcaagtcatgacatatctatggttcggaattaggaagaaacacttacctgtgcgagattga

SEQ ID NO: 56706 - DNA, 246 bp, Glycine max
  Peptide Sequence Number=SeqID_148391
atgcccttaggggtaggattgcatcagtttgtggtacaagtagagggtacatctacttgggttgttgtaactgagaacaagagagggtacatctcttgtggattagttctagtggagggtacatccactaggttgttcaaagagaacaagggagggtacatccctagtggatctttgcttataaaggattttacatggttgaaaagaaatctcaaggaccgcaggtcgcttggggactggatgtag

SEQ ID NO: 56707 - DNA, 211 bp, Glycine max
  Peptide Sequence Number=SeqID_148392
aatgaccaaacttggtctctgcgtgccaacggacacgactgtgtctgaatggcaaaggggtgcggataaccataaggtatctccgcgtatcatggtgggtgtggtcgacaaaagcgtaaggctctatgctcctacgtatcctccatgtggcaggaattcagacctacttgtagtctctgcgataacttgtgacgactgtttgaatgcaaag

SEQ ID NO: 56708 - DNA, 369 bp, Glycine max
  Peptide Sequence Number=SeqID_148393
atgggggagacacatgaagtaccccaaggccacactctagttgactttgagcctcacctcggatgtgccactgaggggaaggcattttttagtgtacccctgccaaatgctttgggggggggggggggggcgggggctcaatatcatccacaaccccaactgttacatttagcgataggaggaaggcctcctgctatggtggaaagacaggaatttgatcatatagaggaatggctgatggtcattgaaggaggcagaaattatgcctttgccggcatggcagagttatgcctagtgcccgacgtggtcattcctccgaagttcaaggtgtcagattttgataagtacaagggaactagttgcccttaa

SEQ ID NO: 56709 - DNA, 360 bp, Glycine max
  Peptide Sequence Number=SeqID_148394
ggttgtcatcatcaaaagggggggattgtagaagcaagcttcatggtgatgaatcaagttgattctagtagttttgatgatgacaaagatgatgacaaaatgcccaagagaatgatttcaaggttgagtcaacaaggtacatcctttgtggtacaagtagagggtacatctacttgggttgttgtgactgagaacaagagagggtacatctctagtggatcagttcaagcgaagggtacatccacttggttgttcaaagagaacaatggagggtacatcccttgtggatctttgcttgtaaaggattttacaaggttgaaaagaaatctcaaggaccgcatgctacgcttggggagctga

SEQ ID NO: 56710 - DNA, 441 bp, Glycine max
  Peptide Sequence Number=SeqID_148395
atgggtgaagcagaggaggtgcaagagaagatgaaggctgaaatggaggccatgaaagagcaaatggccacaatgatggaagccataataagcatgaaaaagagaagggaagtcgatatggttgcagttgccgctaccaacgctattgctaaggtgaacccgacgtccccatccggcatcaaccaaatgaatcatccaaatatgataggcaaagatttgggaagtacggacgaccccatgatgtgcaaattcaaaacgagcacgccttcccatcatatggcttgcctcccaactatacaccacccaatgtggcatacactctcaatgaaaatctcaataactccactccgatactcattgagaaccaataacctcaatctgatcaggcacatatctctcaaaccacggaggagacacatgaaattccccaccacaatctag

SEQ ID NO: 56711 - DNA, 378 bp, Glycine max
  Peptide Sequence Number=SeqID_148396
atgttggaagagaagtttgttactattattgatgctagtagcaatgaagagaaagttcattataaaacttgggcaagatctgatagactcagcctaatgttgatgagaatgactgttgcagacaatattaagacaactctctctaaaatcgaaagtgctaaaaggtttataggattagtgggagagtattctcaaacagctgataagtctgttgttgggacattaatgagtacattgaccaccatgaaatttgatggttcacatactatgtatgaacatgtcattgagatgacaaacattacagaagaaacgaggcttaagaatcaaggaagtcacttagtccattatgttagccaccaagggaatcaaggagcttga

SEQ ID NO: 56712 - DNA, 591 bp, Glycine max
  Peptide Sequence Number=SeqID_148397
atggggacaaatcaaatcagaaaaagattctatcaagtcaagattaagggcctagatgtcaccagccttaaggagttgggacggttgatgggacccctccaaaggcaagccttccacaaagtgtacggaaagattttagatttgaccacaacggaggtatttacgaaagtcgttgtatccctcgcccaatactatgaccagccattgagatgcttcacgtttggggacttccaaatagtaccgactgttgaagaatttgaggagattctaggatgccctcttgggggaagaaaaccgtatcttttctccgggtttcttccctccttgagcaagattgcagatgtggttggagattcagcgagagagttggattgtatgaagcaaactcgaaacggcgtagtaggcctaccgcggaaatacttggaaggcaaggcaagggatatggcgagtcaagaagagtgggtcccgtttgcggatatactagctttgctaatctttggggttgttctctttccaaacgtggacggtttggtggacctagccgcaattgatgctttccttgcatatcaccatagcaaggagagcccggtg

SEQ ID NO: 56713 - DNA, 282 bp, Glycine max
  Peptide Sequence Number=SeqID_148398
atgggggcatacgcaaaagatgaaaagttgttgatgcatttcttccaggaaagtcttactggggcagccgtcacctggtacactaatctagaagcttctcgagtccattcttggaaagacctaatgttgccttcattaggcagtatcagtacaattctgatatggctccggataggatgcaactacagaacatggatgaatggcagcagaatggagaaggaagagagagaggagacgccacttcaaggagaagatgagtctagaagaagctcaccactatag

SEQ ID NO: 56714 - DNA, 315 bp, Glycine max
  Peptide Sequence Number=SeqID_148399
atgcctgcaggggtagagggtgtcacatctaactcatatgtggaagagtctttagacgaagatgatagtattgacggtatatctgatacagacgatgaagtcaccgacatcattcaaccagtgtacaaggaattcaaaatccattttggaatgatgctttgcattataataatatcaactggagtcatcctgatgaggaggacatttgtggtttggagatgtcatcgagttttaatgttggccaagaattatatgttggcatggattttgatagtaaagatgcggtcaagaatgcagtcaaacaatatgctatga

SEQ ID NO: 56715 - DNA, 210 bp, Glycine max
  Peptide Sequence Number=SeqID_148400
atggaaagtgcaaggcacatggctacacctatgagtactggttgttatttagataaagatgaatccagtcagtctatagacatgaaagaatatcgagttgctatgcaaccgaagaacaatcagtttgaaagaaaaattgtgggaactcaattagaagccattagaatgctcttagcttcatggcatccagtaatgaattttaagctttaa

SEQ ID NO: 56716 - DNA, 270 bp, Glycine max
  Peptide Sequence Number=SeqID_148401
accgcatatttggcggtgacccagccggtcgaccagagaaagacgaagatggccggagccagacggtcgagcgacatgggaacatccactgtgccgcatgatgccgtaaccgggacaggcggcgaattgatatttctgcggcttcacgcaaaccggcgagtgatcgaaccgggtgttcagcatggcggtatccgcatcccgacccaagcgccaccacgccattacacccctcgtcaccgcgcaaccaatttgccgatgccgcatttatag

SEQ ID NO: 56717 - DNA, 866 bp, Glycine max
  Peptide Sequence Number=SeqID_148402
atggcttcctcaccaaaagaaacttccgcttctggttcaccagctgtaccatcatctccgcaccaggaacaaccagaattcaacatccaacccatacaaataattcctggtcaagcttcagtccctgagaaactgattcccagaagacaacagggagtgaagattgctgaaaaccctagccttgcaacaagttctagggaagtagacaaggagatggacaagaaaatccgcagtatcgtgagtagcattttaaaagacgcccctgttcctgaagctgatgaagatgttccaacatcttccaccccgaatgtttctgtgcctgatgaagatgatcaagcgacaaaggagacccctgcaccaagggcaccagaacctgctccaggtgacctcattgacctggaagaagtagaatctgatgaggaacccattgccaacaggttggcacctggcgttgcagaacgattacaaagccgaaaagggaaaactcccatcaagaggtctggacgaatcaagactatggcccagaagaagagcactccaatcactcctaccacatccagaaggagcaaggttgcaatcccctccaagaagaggaaagaaatttcctcatccgattctgatgaggatgtcgaactagatgtctcgacatctaagagggccaagaaatctgggaagaaggtgcctgaaaatgtccctgatgcaccattggacaacatctctttccactccattggcaatgttgaaaagtggaaatatgtgtatcaacgcagacttgcggttgaaagagaactgggaagaaatgccttggattgcaaggagaccatggacctcattaaggctgctggactactgaagacagtcaccaa

SEQ ID NO: 56718 - DNA, 210 bp, Glycine max
  Peptide Sequence Number=SeqID_148403
atgggtgaaaaatcatggtcattggtgcgcaaccatctacataaagaactgacaagctggtcagaagagtatatcaacttgcttggtgacataaagagatttgaggaattaaagtgttccctacttgttgatggattatctatggtgcgttaccatagacaagtggatgaatattacggatatgggatatgtcattgcttcacgatataa

SEQ ID NO: 56719 - DNA, 177 bp, Glycine max
  Peptide Sequence Number=SeqID_148404
aaatttaaaaaaattgctaataatttaacattccggaagactttcttccggaagttactaagcccaattccggaagaaggtcttccggaagcacttcttccggaattggccttcgtaacttccggaagaccttcttccggaagtggtcattccggaccttcctccttctgtgcctaa

SEQ ID NO: 56720 - DNA, 274 bp, Glycine max
  Peptide Sequence Number=SeqID_148405
gcaaggctcacgggtgcgtcttccaaaggaggaaaatgtgcggagtcgccaccaacgtttatttgtggaaaatgtcagaaaaaccgaaggaaaatcggtcatgaagaatattccagattcgggagttgtatttacgtttgaggaaggtattagcacctctcacgtcgacaaaagcggggctcttactcctacgtaccctccatcgaagaggaaatcagacctacgtagttctttcaaaagcgcaaatcaagcgattctttttacttggaaggag

SEQ ID NO: 56721 - DNA, 267 bp, Glycine max
  Peptide Sequence Number=SeqID_148406
atggcttacacccacattccggattcaacaagcgattctcctcaaatttcagccagcccgtatcaattagaccttgcaccttacgcttcagagccctaccatgctcaatggaacgccccggggcttctccgtgacaagcacacgttgcgttcgagtcgtattctcggagaaatggaggttgatgaaccttggctagggttatggctaccattgaattatcaactagatatgggagcaagtcagcataggacactggaattggggtga

SEQ ID NO: 56722 - DNA, 567 bp, Glycine max
  Peptide Sequence Number=SeqID_148407
atgacgacgtgcatcaaaagtgggcaattttgtgaaagaagttggactcaattaaaatctcggtggaacatgatccatcctccatttcaaaagtttaacgggtgttacaaacaagcagataaacataggagaagtggaagttcagagaaggatgttttggctgatgctcatatgatttactcacaagatacagaatttatgtcaaagtgttcaaaaagaacaaaggtttctgcttctggaaattactcatcgtcttctaacccagagacacccgttgaagtcaaagaatgtgatacgtcatcgccaatgtctcgcccaattggacaaaaagcagcaaaaaggaaaagcaaaggaaaagaatctcgtaacactcttgatttatttggcatagaaagtgtaatgaaggacaaaaatatgaacacatcaaaacttattcagttaaagaaagcacatgaatggcgtatggagtatgaaatcctcatgaaggatacatccaacatgtctgaacaacaatgcaaagaccacgaaaagtattgtgaccatattaggaaaaaactaggatattaa

SEQ ID NO: 56723 - DNA, 177 bp, Glycine max
  Peptide Sequence Number=SeqID_148408
atgtaccctccacttgaactgatccacaagaggatgtaccctctcttgttctcagtacaacaaccccaagtagatgtaccttctacttatgttacaaaagatgtaccctccaatgtgttaggacaaagaattctcaggcggggaagggaaaaatcaaaagaattctcaggcggttag

SEQ ID NO: 56724 - DNA, 498 bp, Glycine max
  Peptide Sequence Number=SeqID_148409
atggtgaaagttggaacctcttacgtgccgatcaacgtctcattttcgccaaaagttggcccagggcttcccgggctgcccgctttccattcgggaaaccatgtcggtgcgcaactgcattatgaatcggcaaccgggcgatcgaggcggcctttgcgtattacgccagcggcgctaggcggagtgtgcatactggcttactatgttggcactgtaacgccagggtgttccagtgaagtgcttcatgtggcaggagaaaaagctgcaccggtgcgtcagtcagaatatgtgatacaggactcatattccgcttcctcgctcactgactcgctaccgctcggtcgtcactgcggcgagcggaaggctctacgaacggggcggagatttcccccggaaagcgcaggaattgatatattacttaaccagggaagtgagagggccgcggcaaagccgtttttccataggctccgcccccctgacaagcatcacgaaatctga

SEQ ID NO: 56725 - DNA, 816 bp, Glycine max
  Peptide Sequence Number=SeqID_148410
atgcattctgaagttgaagcactagaacatatgaagaaaatagatacaggccatcaaagtgtgtcattggagaataagacaggagattcaactatgctgaagataggagattcggctaaagttgtgataaaacaagacatgaagggaggagagcataaatatgggtttaacaacaataaacgtgagaagccacagaaggataataatctaggtgtcttgttggtagaatatggtattttactatcagaagtaaaaatagaaaagaaagagaagaactgttttacttttgatattctgggattaagaaggattgaatggaatctacaaggaagttggccagccgccacaaatactgtccctgccattactttcatcatggctgttttaattaggatggaaagcatttccataaaatgtgtgcatggattggccaagattttggggtccgttctaagccttgctggggcaataacatttagtttagttaaaggacctcacctgggtttcatgaaatggtatccagaaaatcagaaccatacttctcaccctttaacaattgtgcactccaaagacttggagttatcacatgcagtcctcttgaacccttaccacccaccctgtcatcatgccgagactcaggaaggccaacagatgcacaatgaagtgaatcatgatgtcaaagaaagcaaggggaaaatacatctccaactggcacagtataattgcagcctcattttccagctcatcaaacttcacaagatcaatgactttgctacatatagcatggaagaaaaagcacaggcgagttatggctaa

SEQ ID NO: 56726 - DNA, 273 bp, Glycine max
  Peptide Sequence Number=SeqID_148411
atgctcgagtgcgacgaacacgatgctcagatgcagacagggaccttcaagcatccttggctgcacaaatatttttcaatgcaaggttcaaggtgtgcatgtcgcaacgtgcccttttgcgggcgagcgaaggcgaggctcacgggtgcgctttccaaaggaggaaagatgcgcggagtcgccaccaacgtttatttgtggaaaacgtcggaaaaatcgaaggaaatcggtcaagatgaaaattctaagttcgggagttgtatttacgcttga

SEQ ID NO: 56727 - DNA, 459 bp, Glycine max
  Peptide Sequence Number=SeqID_148412
atgctattttcttatttgctgtcaagacttgctttagagcagaaacggatgcagccaaacccttgccagggtccttattattgcagtgctgggacagataagtcatttggacgtgacatatctgatgctcattacaaggcttgcttatatgctggaattaacatcagtggcaccaatggggagattatgccagggcagtgggagtaccaagttggtcctagtgtaggtattgaggctggtgatcatatctgggcttcaaggtacatcctcgagttaattgctaggggaatagaagaagtttgctgcagtgccatctggtgcaggggtattgttacatctactgtcaaagggaaggagaaaaagattgtaagagagaaggaggagaaagatgattgtgggagaggcagtcatctcccgccatgcgagaggctttacagccgtcagataaaagcattttaa

SEQ ID NO: 56728 - DNA, 246 bp, Glycine max
  Peptide Sequence Number=SeqID_148413
atggagaacgcactaaagagtgtagcctacaatccacaacctgagaggcatgttgggattcttgttgcggctgagaaccaagatagtggcggtgatggcgatgaaggcgaagttctagagaatgtccaagatgacgacgggcttggaataggcttaattgctctgcctctctttgagttgccattgactagacgtgatgacgtgacacttcgtctgtcacgatatcatttaactgatgtggactaa

SEQ ID NO: 56729 - DNA, 885 bp, Glycine max
  Peptide Sequence Number=SeqID_148414
atggggcgtgaagactatggctccaagctcgttgagtgtcttcctatacctgatggtgaagctcctgaagagcttgccctgaccaaaggtggtcatcaagtccacgtagtctctggtctcgactctctcgcttgcaaagtcgaggagtggaccggcgtggaggatataaacggaattgccctggtcgatgaggaccttgaacaccataaagttcattatgatgaaggagacaaccacggggtcatcttggttgacggggttgatgcccttgaagtccgtgtccgtaaagtttccgaactggttagacaaccctctataggaaatgtcgccagcaatggttgtgtttatgtcgctgttgttggtgtctttgtctaccttagtcttttgctcttcttctgtatgcttcctggttcctattttgctcctctgggtgtcctgcaggtcttgctcctgcttggtgattgtctggcgtccaaatgctcgtctagatctattgtcccatcgtactgcttgaggttgagtggtttccaccccaaggtgttgcccgtgcgtcaggggtgtgattcttcttgggtgcgtttaggcaaggtgtgggcagattgtttgtcgccttgggaacgtctgacacgagcctctagtaggtcatggtcatcctttagctttgttaactcttcttcgtggcgttgctccatctccgcgatgcggttttggaattgttgtagagtgtctatgtctatcatagttgtcggacaaggatgggagtccgtgaggggggtcttgtgtctgaggccagatcaaatgctaaccatggataagtgtgagagaattaaggagaggccgcgagggttccgaacttcacacgtcggcttggaaaggtgtctttga

SEQ ID NO: 56730 - DNA, 1786 bp, Glycine max
  Peptide Sequence Number=SeqID_148415
gccaggcgtccgtgctcctgtagcagggttgacgtggagggtgggcacgtgtcttcgagtgccacttgggatgccacgtagattttatggccctggacagtacataagccccctaagctttgagccggcttgcgggcgaaagaggttattcaatgttgaagtagattgtctcgcgtcgaaggagtctgtttggtgtatgggccttgacgaatgtgagagttgcagatcgatgaggcttgtcaagcccccaagcctgaacatgtgttgtctaggctacctttgtcaagttgtccgtgatgaacatatttttggtgtgccagtaggcgcgtgtagcacacgtgcaatactcttgtatgcgtgtcacacgcagagtaggcacgtacttccatccatcataatgtcttattttttgtctgattccaccactggactgggtgacagtgattttgggggctcaattgagcaacccaacatggatcaagaggtcatctcgataagcggttcctcgtcaaaggatacttgtcgaggtgcctctgatagggtacttctcgccctcacggaaggacatgactttctgctgatgccagggagtcagtcctggtactatgatgcttttaggggtgcaaggagagctagcggtgagaaagatgtgaggatgtctccacgcgtacgacctagcatgtgtggtgggtcgtcttcatcaccctcgggtgttgctgactatgagtgggtgaaggatgatgggttgaagtataagtcctgtttgaccacaacagcgagtgtcgctgcgcttcaacaccaggtgaagctggtgaaccctgagggctcttgtcctatggatcatttttcccttgaccaccttttagtatgctccgttggagcacttgaatgtggtccattcctagctccacccaaacagttggacaatgggatggcgagccctacttctcgttctactagtaatctgatcccaccagccatcttgtctcttcctttggtgagcaatcctctcgctgccttggatggtattatgggtgactttgcttggaggccattcgtgaagcaggttggacctgtaggtgagaccgtaccatcatttgctgctactccatttgctagagaagggggaggaagatggatgatgtttttggactggaagaagtcgaaggcccctatgagtgtccgtgccttgaggcaagctgcagggctagggcccactgcgggttaccttacgactacgcaagatgtacctccggctccaccggtcgtcaaggctcctcctactgctgctgctactcttactacttttgctccttcacctcctctcgtggctatggttcaggaggtttctcccactattgttgaagctattgtgctagctgctcaggctgagtctgttgtggtgtcgtcatctactgtggcggctcctttactaagtgccggtgtagcgaccactagtgctcccacggtgctgcttctgtcttcgttggcttcagtggtcatgcctattgttgtttttgaggatatggcgtcaccttcttcgtccttgcgccctcgcatctccctcgatcatttatacacctctagtgatgctgactcaatgtggggtgcaacttacaagctggagcagaattccaaaagaacatattggaattatgaagaggcacgcttagcacgtctaaggcgctcaacgcaaagcataggctcaatgggaacaacacgcttagtggcaggaagtagaactaatttaggaaagcaggttaattcaggaaagaggcgcgcttaa

SEQ ID NO: 56731 - DNA, 1224 bp, Glycine max
  Peptide Sequence Number=SeqID_148416
atggagtctaaaggtgggaaaaagaagtctagtagtagtagtagtaaatcaattttttacgaagctcccctcggatacagcattgaagacgttagaccaaacggtggaatcaagaaattcagatctgctgcttactctaactttctctactgttacatggccatggcggtttccgcaattggttttgaaggtttcgagaaaaggttggaaatatcctttttccagccgggactttttgctgaccctgaaggaaggggtctaagggctcttacaaaatcccagttgggtgagattctaacaccagctgcttgcaccattgtttcttcgctcaaaaacgataatgtcgactcctatgttctatctgagtccagcctctttgtttatgcctacaagatcatcatcaaaacctgtggtactactaagctattgcttgcaatcccacccatattgaagttcgctgaaatgctttcccttaatgttaagtctgtgaattacaccaggggaagtttcattttccccagtgctcagccatatccccatcgcaacttttctgaggaagttgctattcttgatggctactttggcaaacttggtgcaggaagcaatgcttatattttgggtggccaagacaaagcacagaactggcatgtctactctgcttctgcagattctgtaactcaatgtgacaatgtttacactcttgagatgtgcatgactggcctggatagagagaaagcacaggttttctacaaagaacaatctgcttcagctgccatgatgactgttaattccggcattagaaaaattcttccagattccgagatttgtgactttgactttgaaccatgtggttattcaatgaactctgttgaaggcgctgctgtttctacgattcatgttaccccagaagatggtttcagttatgcaagcttcgaaactgttggttatgacttcaaagcggtgaatctgaacgaaatggttcagagggtattggcatgtttcctcccaactgagttttctgttgcagttcatgtggatggtgcaagcaagtcgtttgagcagacctgctttctggatgttaagggatactgtcgtgaagagaggagccacgaagggcttggaatgggtggttctgttgtctaccaaaaattcgggaagactagtgactgtggttcacctagatcaactctaaagtgctggaatgaggaagatgaggaagagtag

SEQ ID NO: 56732 - DNA, 99 bp, Glycine max
  Peptide Sequence Number=SeqID_148417
atggatatggattatcaaaatgaagaagaatgtggtgtgaatgaaccacatgttgattgttcggatgcgttcaatacttatcaggtgtttgaaagctga

SEQ ID NO: 56733 - DNA, 96 bp, Glycine max
  Peptide Sequence Number=SeqID_148418
atggcatttcagggtggtcctggtggaaggcctgattttggtcgtggttccggtggttatggttcaccttgcaattttggatgtcattggagttaa

SEQ ID NO: 56734 - DNA, 684 bp, Glycine max
  Peptide Sequence Number=SeqID_148419
atggattttcaaacacttgagagaaaaaagaagattagcaaatttaaggaatcggcatggaaatgtgtttattttctatctgcagaaatttttgctttggcagtaacatatgatgaaccttggtttactgatacaaggtacttttgggtggggccagggaatcagatatggccagatcaaaagattaaagaggaggggatgttggaagccattgaagtatcaatagaggttaccagaagaaagagaagaaaaggtgccgggggaagttttattctgataccgtttgttcgtgttggatctgtagttttagctcttcatgatgctagtgatgtgtttattgagacaggaaaaatgtccaaatacagtggtgctgaaacaacagctagcattgcatttattctttttgttttgtgttttaccgtgacacggatcatttactacccattctggattcttaggagtacgagctatgaagttgttcacgccttgaaaatggacctggtggatggtccattatattattatgtgttcaattctcttctatatttcttgcaagttcttcatatatattggtgggttctgatgcttaggatgcttgttaaacaaatccaagaaaaaggaaaagttagtgaagatatccgatctgattcagaagatgaagatgaacataaacatgaagaatga

SEQ ID NO: 56735 - DNA, 243 bp, Glycine max
  Peptide Sequence Number=SeqID_148420
atgtcgatgccaatattggatcaatttcatccatgcattcatgattccattgaaaacattgtcgatgtcaaacctgatggtatgagtgaagattcatggtctttggttcgtaaccatttgcttaaagaacttgcaaaatggtcttatgagtatatctacatgctttgtggcagagacaaatttgaggaattaaagtggtacttacttgtggatggattatccatggttaccatggataagtga

SEQ ID NO: 56736 - DNA, 333 bp, Glycine max
  Peptide Sequence Number=SeqID_148421
atgtcattcggtaaaaatcaattgtatatattttccttcttccgcagagcgggaaaaagcagcgcggcgaagtggcaagcagcgaaagcaacaaacgtcgctgttccatcatcgagctctagggttttcccatttcgcgcatggcaaacgccgtggatcaagatcagcaatggctgctcaattgcttgtccgccacactcgaccccaaccccgaggttcgctgtttcgcggaagcttccctcgatcaagcctctcgccaaccaggtctcatttttcacttcagttctctttggcgagaacctaattgaatgcggatttctctccgtgatgtga

SEQ ID NO: 56737 - DNA, 954 bp, Glycine max
  Peptide Sequence Number=SeqID_148422
atggcgattattcattattcagcagcttcacgttgttgcatgccatcgctgcatcgcgcttcgccttctcgctcggttctcgcgccctcaatcttcttcttccgcgacgctgctccgaccctcaggctcgacgtctcggttcggtcccagcctccaggttcggacggcttcggcgaacccatcaataacaaacacgcttctcgtgatgcctccgttgggttatccgcttcttcttcttcgtcggtcatcgattttctcactctctgccaccgcctcaagggaatgcatggctctgtggatgaagagaccacgggtgtctcccaactcactgagttagagactaatcccgctcgtgtaccaagcgggtacagaatcatagctgaagaatgcacattaggaactctcttcattgacattgttctgatttccatgtgtctaagaggcctgatcacaaaaaggaaaggatgggttaatcatgggataaaaggtgctgaatcgattgctgaccatatgtaccgcatggctttaatggcattgattgctggcgatgttccaggattgaatcgagaaagatcagtgagacatttctttgtctgtgagatttgtaattttgtactcagtctagatggtataagcaaatctattgtaggagatataacaccatctgatggtgtgcccaaggctgaaaagagcagaatggagctggaagctttgaacaaaatgtgtgaacttcttggtggagggatgagagctgaggagatcaaagaactttgggaagagtatgaaaacaattcttctgtagaggcaaatcttgttaaggattttgacaaggttatggactatttttgcagtagccgcatagttagttttagagaggttgatattggaagcagaaagggtgatgtattagtggttttcattcattttttattgaggggtggaagtggaaaataa

SEQ ID NO: 56738 - DNA, 288 bp, Glycine max
  Peptide Sequence Number=SeqID_148423
atggattttcaaacacatgagagaaaaaagaagattagaaaatttaaggaatcggcatggaaatgtgtttattttctatctgcagaaatttttgctttggcagcaacatatgatgagccttggtttactgatacaaggtacttttgggtggggccagggaatcagatatggccagatcaaaagattaaagaggagaggatattggaagccattgaagtatcaatagaggttacaagaagaaagagaagaaaaggtgccgggggaagttttattctgataccctattag

SEQ ID NO: 56739 - DNA, 782 bp, Glycine max
  Peptide Sequence Number=SeqID_148424
atggtccaagtgtttctccaaggtggggttgtagatgagtatatcgtcgaagaagactgcaacaaagcggtggaggaaggtgcgaaaggcagttttgtggatgtcgtcggccgccatgggaatttgatggaagccttgatggagaacgcggtggtaggagggccgttggttcctgaaagaggtgagcatatcggtggaggaggggccgatgcaggaaagagggaaacatctgtcgtgagttggactggtgaacccaacaatgtgaaggacatcgtccgggagggcaaaccttctagcatacgagagtgccgccatcaccaaccattactcgaagaggatcaatgtctgtggagggcaatgagaggaatcccatacgtgcaaaaagtcgcgggagcaggcatgccggccagggcgttgagaatcaactggggtgtgtcaggcaagggggtagaaggttcattgttgtctaggagagacaaaggatctgtgggtggggtggtgttgtcgtcagagatgacgagctgtaagcggggacgagaaacgggtggtgcgacggcgatcatggagcttatcctcctgaagtttagcgagagcaatagcttgcggcaacgaaatttgttgcaacgcctggacctcgcggcggagcttggggttcaggcccgaaatgaaatagctcaaaaggaggggatgcgcgagcctgatggtacggttggccaagcgctcaaagtcagagaggtaatcattgacggaacctctctgctggagcttgaacaaggcgccat

SEQ ID NO: 56740 - DNA, 255 bp, Glycine max
  Peptide Sequence Number=SeqID_148425
atggctacaattagaagccgattcggcagaataagtgaagtaaatgatcaatttggcaacataacatttaaatttgaacttgaagtcaataaagacagcataaaagggtgtgggattgataggaagaaggacgtacgtgaggaagaagcaagaaggacgtatacgaggaagaagcaggagtgtccaactggcatgagggctaactcaagatgtgagatcctgtccatgcatcccatgaacacacaggggcattga

SEQ ID NO: 56741 - DNA, 336 bp, Glycine max
  Peptide Sequence Number=SeqID_148426
atgggtgaaggaatcgacttgggaagagaatgttcgaggaagccaacaacaccaacaaagacagcgaatgaaaattcaccatttttggtaatgatttatcaaagtgtgacacattcagaagaacacggtaatggtgaaaatggtgacaagagcgttgaacaaagactaggattggatctcgcatttttcattggacgagcattacccttcagaagaattcaaatttgcgccacttttccacggtgccatgggaaaatggggcatccaaaaactatggagctcatcaatggtaacagacaactctctctctctctagaaaacttcacagctaattga

SEQ ID NO: 56742 - DNA, 261 bp, Glycine max
  Peptide Sequence Number=SeqID_148427
atgatcgaagacatggaactgttgatggagtgttggacctttttccctgatgcaacactcacaaatcatatggctctaaaatctgaccatagcccaattcatgttaatgtttatgggtttgtcaataagagatttaggtttgaaaacatgcggttggccgaagctgatcttgaaaaagttgttcatggtggatgtacgcgtgaattaaatggtcctctgcctgataagctcaaagcttgcgctgatgatttggagtgttag

SEQ ID NO: 56743 - DNA, 327 bp, Glycine max
  Peptide Sequence Number=SeqID_148428
atgcttcaaccatatgggatcaacataggcttaaaagagcactcaaaccgggtgacccccaaggcctatactccaaagagtccgtcagggcctctccctcctgattcagtttatctcgttgcccttaagggtcttagcattaactcgtcgtccttaaagggacttagtattaacttgtcgcccttaaagggacttagcattaactcgtcgcccttaaagggatttagcattaactcgtcgcccttaaagggagttagcattaactcgtcgcccttaaagggagttagcattaactcgtcgcccttaaatggacttatagtcgtgtga

SEQ ID NO: 56744 - DNA, 381 bp, Glycine max
  Peptide Sequence Number=SeqID_148429
atgcttattctcattatcagtatcgtaagatccagcagtttatatactgcaaggagtacaagcgcgagacatctaactgccatagtggaacgcgtaactaactataacaaactaataagcacgtgtcttattgctactcatttgcacgtgttactcgtggggttacaacaaatggataggttgttagttgatataatctcgcagataactgggtttagttactgcgcgagtaggcctcgtcgtggcgacagcaggaagacgacgttcatcgtcgtcaaaggcggcatggatgctgtgggtgctaacaatacctgtgtaattcaaaaaatagcaaagtttgtgtctttcagctcctttcttgtagctcaagctagaaactag

SEQ ID NO: 56745 - DNA, 1290 bp, Glycine max
  Peptide Sequence Number=SeqID_148430
atgacggcccggttccataagattgttgttgctgaccccatggatcgaattagtgatttaccaagtcatttgattgattttattctacaacgcttgcaattgcaagatgtggttagaacgagtttattatcaagtaaatggagatataagtggacttctgtccccaaacttgatttttcaaatgatttttttcaaaagtgtagggatttagaacttcatgaagtttcaagtactattacagaaattcttttgattcacgatggaccattagatgagtttgttctttgcattcccgaaaatgtgccaatcaaaattgaatcccttaacaagtggattctttgtttatcaagaaaagggattaaagaacttgagctttggaaccttcaaacagatccttgtgaaacaccatctcatatcttctcttgtcagggattgacgtatcttcaacttcagaattttaaattatcaactgtgcctaatttttctagctttaaaagtttggtttaccttatcttagttgatattatatttgagtccagtgcaattgatcttatgtttggttgtccatcacttgagatgctctccatttcatactgttctggttttgagtgtatcaatgtgtcctctcctgctctcgaagtcttacatgtacaaggtgaacaagttatcaagtcaatttatttggagaaagctaaaagaatgactgatgtttcactcatggctgataatcctggggataactttgacatggatacaatatcaaatttgatcaaaggcttgtcggaagttgaaagcatgtgtttcacagaaggttacattcagatcttttccacagcttatacccttccaaagagtttgcaaaaaccactcaactgcttagaatctctagaattggaaggtgtgaatttcgacgatacaacagagcttctgtttgttatttccctacttaaaagttctccaaacctagagaaactttttatacagggtaattatatcgctggcgtggatctgccacaaatattggagaagtcaaagtacaatggttgttgccttagtcaccttctgactgtgcatataaaagcttacaaaccctgtgagaatacaatgaacttcatacgttttttgctggctaattccacatcattggagctccttactttctacattgttcctgctcatgatcatcaacaacatcaatattccatatctagtgttggacgagaactgaaacaaatggcacgagcttcaaaaagtgcagtagttgagttcattgatttatcatttgattga

SEQ ID NO: 56746 - DNA, 237 bp, Glycine max
  Peptide Sequence Number=SeqID_148431
atgatggtgacgataacaatgacaacgacaacaattgatgatggtagtggcgacggtgaaaatcatggtgatgaatgcaatgatagtcatggtggtgacagtgacgatgacgaaagtcatgacggcagagcggttgatgatagtgatgatggcggtgatgattatagtggtggttgtagtggtgctcatggtggtgacaacgacaatcatgatgatgaattaattgagatattttag

SEQ ID NO: 56747 - DNA, 232 bp, Glycine max
  Peptide Sequence Number=SeqID_148432
atggacatagagtatgttataggaaaaaaggaaccacctgcaatcactgatgaaagtagccctattatgctatatgagcgcatgaaaaggtctaaagactttcttaaggccattgatgatcagttcatcacttcagataaggctttccaaccagaggaaaagcatgaggaatgtcagggaaccattagagatgccgctatcgctaccggaacacacgtgagcccgcttagag

SEQ ID NO: 56748 - DNA, 429 bp, Glycine max
  Peptide Sequence Number=SeqID_148433
atggttgtcacgacggggaacaagaaaaattttaaaaggagtaggggactcgcatggacgctagttttatcgaacataatcaaagtttcacattttaaaccactcttcacttctcctgcatcaattcatgtccgcccacgctcaccatctctcctttgtcgttgtcgtgctctacaactgatcataaagttaagaaaacatacattgccctctacaccaatccttctcccaacaggggtcagattagatcatgaaggtccaaatttggcgtctggcaagtctacactgcttccgatgtcaaactcacgctatcgatcaactctattgtccgaccatggggacttccttcgaggtgttactgatcaacagaaaaagggagcctcagggaagtggggtgcaatgctgggtagggagggtggtgttggctaa

SEQ ID NO: 56749 - DNA, 291 bp, Glycine max
  Peptide Sequence Number=SeqID_148434
atgtcagcgaactcagcgcaaggatgcttacctcgacaatgccgacgtgcggaggcagcaacaccaccgtcaacttggctgggatggtcaacacccacggcggcgcggtcgatgatgacgaagaagacgaagatgaagaatgaatgcgctgcggctaaggccaggaagaagatgaacgaaggtcaggaagaagaagaacgcgggagggaggagaccaatgaggaagaagcaaaaatggagaggaagaagcaagaacacgggattggaagggagagaaaggagaatgaatag

SEQ ID NO: 56750 - DNA, 1779 bp, Glycine max
  Peptide Sequence Number=SeqID_148435
atggacggccaaacaaaggtcctaaatagggtgcatgagtacggcgcaccaccctctgggacaggtttttccccttttgtggtcatctatggcaaacctctgtcatccattccacactacttgcaaggttcgcccccagttgaggcttcagataccttgtttccaccagagccgccattcatgcgacactacaacggcccacttgcttctcagccagcccatttaccacctacaaatgtggaccatcatccagttgttgaaccgctatctgtgttggactggaagtgggacaattctgtctcacccccaaccaagctggttttggtccaatggtccggtttggctccggaagataccacttgggaaagctatgatgcattgcatgaatcttataaccttgtggacaaggttattctcccaggggaaggagatgttgctccagatgttagagaagtcttggatacgttccgaactgctgctgagctagggagtgattcatttggtgcctatgtgatctctatggcctcaaatgctagtgatgtccttgcagtagagcttttgcagaaggatgcgcgacttgctgttagcggggagttaggaagagcatgtcctggtggaacgctgcgggtggttcctctatttgaaactgtgaaggacctgagaggagctggttcagttatcagaaagcttttgtcaatagattggtaccgccaacacatcattaaaaaccataatgggcatcaagaggttatggttggatattctgattctggtaaagatgccgggcgcttcactgctgcttgggaactttacaaagctcaggaggatgttgtggctgcatgcaatgagtatgatattaaggttactctcttccatggccgtggaggtagtattggccgcggtggtggcccaacatatatggctattcagtctcaaccacccggctctgtcatgggaacccttcgttcaactgagcaaggagagatggtgcaggccaagtttggcttgccacagacagctgtcagacagctagagatatacacaacagctgtgctacttgctacccttcgtccacctcaaccgccacgtgaagaaaaatggcgcaatcttatggaagacatttcaaagatcagctgccaatgttaccgcaatgtagtgtatgaaaatccagagttcctgtcatacttccaggaagccacacctcaatcagagcttggttttctcaacatcggcagccgccccacaaggcgaaagagctcaacaggaattggacacctccgtgccattccttgggtgtttgcatggactcaaaccaggtttgttcttccagcctggcttggagttggagcaggcttgaaagatgcttgtgagaaaggacaaactgaagagctaaaggccatgtacagagagtggcctttctttcaaagcacaatagacttgattgagatggttttgggaaaagcagatattcctattgctaagcactatgatgaagttcttgtctcacaaaagagacaagaacttggaaagcaactgaggaatgaactcatctcaactggcaagtttgttctagcggttagtgggcaggagaaacctcaacagaataatagaagcttaaggaagctgattgagagtagacttccctttctgaaccccatgaatatgttgcaagtagagatactcaagaggctaagatgtgatgatgacaatcttaaagccagagatgccttgcttatcaccataaatggtattgctgctgggatgaggaacactggttaa

SEQ ID NO: 56751 - DNA, 2037 bp, Glycine max
  Peptide Sequence Number=SeqID_148436
atggaactcctccaacagcaatgtggtaaagatagagtttgccggaagccagattttgcccttatgaaaaataagatcccgttgaatggaaaacttaggagtataaatccaagtcaattcagtgaaagtttgagcaatgttgcgatattctgcttcagtactagacctggtagtatagaccagaatgtcatcgaagaacatagcgacgaacttctggagaaagggttgcaaagtgtcattcgttgtggcctgaaaagtggacagtgcattgcagggtgtcattcattgtggcctgaaaagtggaattggcctcgtctcctggatgatggtcttgaggtgtctgaccttcttgatgttggccagcttggagaggccttcgaggatgatccctaccccgctttcttttacattggacacaccgtcaacataaagggtccactagtctggggtggttttgtcatttccgatgaattttgtcagaaagtcaaccatgaattgtgtcttcatgggaccacgtggctttctcaaaacctgcttgatggggtagttcatcttgactaccacttgatgactctggaagtagggcccaagtcgttaggccgagggagctcattcttccctttctcttgtacgaggactgagttgatggcttcgttggctattgagagatataggagcaccagtgctcctagcacgggtcaactcaaaactggcggtgtggctatggttttcttgaaagtcagaaaggcttgttcgcaagctgtgcatctccagtatggcaatgcatttgtcggagtttgcttcaatccaccgatgtgtgatcatgaagctgaggaacttgtcaccgcctaccctgaaattacattttacaggattgaggcgcatgtcgatgcatttcgatctagttgtatccagagtaggcgtctaggaagcttagcacttggaacccggccgttctatcgactcctatcgatgttggatagagggattgagttgcagctagacaagctcttcaatgggtttcaggcctctgttggaggtgtcatctcgcggatctatgtcaaattcaccgcccaggctggcatggtagacggtcagggctcagacttgagctacgtccactgtcatgacctgtggtcattagttcatgtaacctcgggtctcgactctctcgcttgcaaagccgaggagtggactggcgtgagggtagacaatgtcagcggaactaccctggacgaaaaagaccctggacaccatgaaattcgttatgatgatggagacaatcacagggttttcttggttgacgggattgatgcccctgaagtccctgtccgtaaaggactggccggactgtccgccataggaaaagccgccagcaatggtattaattacacctctgatgtgttgggcagatgtccttcgagccttgctcctacgtggtggttgtttggtctcttaacaaactgggctaagtacccaacctatgggtacctccaggtcaaaggcttcctcgagaatcgtggtacgattggccatcaagggtgtgtaatgctcatacctgggtcttatggagagaggcagacgcttgtctggcttgtgcctcttgtccgacttgtgcaagtcagccatggtgcttgctttgcgcttgccgtggttatgtctggcttgacggacttcatttcagaatttagacatttcttcattccccttggctcattcgcacagctcgtccatgctcccggacctgctagtggcgtactgcgcactaagtcgttcgacgacggtgttgaagctgtctatggaccttggttcacctgtgtcaggaaggcgtctaaatgctcatctgaatctgttttcccatcgtaccgctcgaggttgagtggtttccaccccaaggatatgtctgcgtccataatgcggtcgacaaaaggatgccgatggacagtccgtgctgctggatgcgttggggatgtgattccccttgggtgcattcaggcaaggtgggggcggattgcttgtcgctctaaggatgtctga

SEQ ID NO: 56752 - DNA, 365 bp, Glycine max
  Peptide Sequence Number=SeqID_148437
aagagggtggatctgagtatcccagacacgtgccaggagctgatcacaagcaacccaatcacaagggtggtgagacttcaagttcaactgagagcaatggtggcagtcaaaatgtccgttcgtcaataccaatttcaccaaattccagttcttcattagtttcaatgacacgctcgccttccttcaactctagtcaacttgttgctcagaggaaactgtttgcagaatcccaaataggaaggaccagttttaagaggcttttggagccaaaggtccctcaggttcctggaattgctccttatagagttgtccttggatatataaaagataaggcatgtactaaatgtgtcctgtgtagactgtag

SEQ ID NO: 56753 - DNA, 330 bp, Glycine max
  Peptide Sequence Number=SeqID_148438
atggcatttcttttccggaacagcttcttactccattttcaaaaagctttcttctcgttttccactttttcctacggcattgtctctgcggtgaaggtgaagtttccggtgtcaagctttgcggtggtcggtgacagcaaacaagaatcatgtggtgcgaatgaaccacatgttgattgttcggatgcgttcaagacttctcaggtgtttgagtgccgagaggatgttttgcggtgggctcgatccgtggctcatgaaaacggatttgtggcggtgattttaaggtcagacacaaacacaggtagtagaggaaggagtacattgtgttaa

SEQ ID NO: 56754 - DNA, 401 bp, Glycine max
  Peptide Sequence Number=SeqID_148439
cgtttgtgactgctccactctcctccagctcgatctctcctccaacaacctctcaggcgctcccccccgtcgtgttcaacacttgcacttctcttcagtccttcgacatctccagcaacctttttgtcgatgtgttgcctatggacattctcacgcaaatgaaaagcctcaatgagctcgcgatggcacttaattggcaccctcttgttcccaagtttcctaccccacgtgttgaggaggaggagttggagttgggatcgagcacggcgaggcgctcacagaggcatgaagggcataagccggtgaagttctcctgcggctacggcggtggctgcaacatggtgggggttggagaagctgcggcggcgacagaaacggcagtcccagagaaagtgaagtga

SEQ ID NO: 56755 - DNA, 300 bp, Glycine max
  Peptide Sequence Number=SeqID_148440
ttcaagtgatagaggtgtcatcatctgaagaggatcctgaagaggacccagaggagttacctcctgaacctgttatggatgcccttgactttccaaaggatgatgaggacccactccctgaggtggattctccagaggatatcatgtcagcatctgaggcagactctacagaggagagcggccctggagggacagcgaataggctacttcaggttgaagcaacaactcgcctgggcgagttgcagatcaactatgtgcccttatttcctataaacaggcgtgagggggctgaaggaaagg

SEQ ID NO: 56756 - DNA, 349 bp, Glycine max
  Peptide Sequence Number=SeqID_148441
atgggaaagttggatcatctagaggaaaggctcagggccattgaaggaggtgaagattatgcctttgctaacctagaagagttgttcctaatacccaaacatggtcattcccaagttcaaggtgccggactttggcaagtacaaggggactactcgctccaagaatcatctaaagatgaaccttcccgagtccattcttggaaggacctaatggttgccgttgttaggcagtatcaatacaattttgatatggttctggataggatgcaactacggaacatgtgcaaaaagggggacggatcattcaaagaacacgcccaaaaggtggagggatctggcggctcaggtg

SEQ ID NO: 56757 - DNA, 216 bp, Glycine max
  Peptide Sequence Number=SeqID_148442
atgacttctctgcgcagcctggcggcaggctctgcgcttcttttcctgtttgcaccaacgctctacgcagctgaacaggctgcgcccgaagcgccgccagtggatgcgcgcgcctggatcctgatggactacgccagcggtaaagtgctggcggaaggaaatgcggatgagaaactcgatccggcaagcctgaccaaaatcatgaccagctatgtg

SEQ ID NO: 56758 - DNA, 476 bp, Glycine max
  Peptide Sequence Number=SeqID_148443
atggcctctggtaatcgattaccaagggtgtgtaatcgattacagggcttagaaatggtaatcgattacagggctttagaaatggtttccatgtgcagaagttgtgtaactcgagtttgggcactgatcgcgatggcagcgcaattaatccatgatcgcgtggtgatggagtgcctagagggagtttgggagactctcgaaggcaatgagaggtgccgatttcgtggcacgattcgactcactgctacttcattagtacatccgaaggaacccgcacacacacttcagcagactgtggagtgggtactacctacacctactccggagctagttcaagtgatagaggtgtcatcctctgaagaagaccctgaagaggacctagaggagttacctcttgagcttgctgtggatgctcttgactttccagaggatgatgaggacccactccctgatgtggattctccagaggatatcat

SEQ ID NO: 56759 - DNA, 809 bp, Glycine max
  Peptide Sequence Number=SeqID_148444
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgtttgacagctataagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 56760 - DNA, 740 bp, Glycine max
  Peptide Sequence Number=SeqID_148445
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgataccgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 56761 - DNA, 378 bp, Glycine max
  Peptide Sequence Number=SeqID_148446
atgagctacaagaagcactgcaaggttcttggaaatgatgaaatcagtgggagtacagttctttcacggaaatggaaatttaaagaagttagacgttggttaaatgccatgaaagaagagatagattccatggaacataatggtgtttgggaccttgtagaattaccaaagggttgtaagagagttggttgtagcattatgactttggagctacatcatagatgtgaaaaccgtctttctgaacagagatttagaggagaatgtttgtcaaaactggaaatggggttctcagttgaaggaaatgagcatatggtgtgcatactaaagaaatcagtggatacagtccttaacgagaaaatggaaattaaaagaagttag

SEQ ID NO: 56762 - DNA, 324 bp, Glycine max
  Peptide Sequence Number=SeqID_148447
atgcgtagaccacgtctttttcggttttcccgacgttttcctcaaataaacgttggtggcgactccgcgcgtattcctttcttggaacatcgcacccgcgagtcacgagtcgcccttctgccgaaggagtacattagtgagtctgaagttgaaaagggagaaaagagtgaggatgatgaggaggaagtggagaaaacaccagagggagaattgttgatgattaggcggttacttggtgtcatacccaatttcgtttggggacctttgcttgatgacatgcaacttttgtttgatccttataaggtgcttggcacccatcattag

SEQ ID NO: 56763 - DNA, 135 bp, Glycine max
  Peptide Sequence Number=SeqID_148448
atgggcgaggaagagaaaaaaccaaaggaaaataaagtgaaggagaaaaaagcaaatgaagaagaaaagaaagaagagaaaaaaccagaggaatcaaaagatgacaaggaatccaaggaggaatctgcgccgtaa

SEQ ID NO: 56764 - DNA, 297 bp, Glycine max
  Peptide Sequence Number=SeqID_148449
atgcatgaaatggccccgaggaaacttgcctcaaagagatccaggaaggataaggcagccgaaggaactagttccgctcccgagtatgacagtcaccggtttaagagcgctgtacaccagcagcgcttcgaggccatcaagggatggtcatttctccgagagcgacgcgtccagctcagggacgatgagtataccgatttccaggaagaaataggtcgccggtggtgggcatcactggttacccccatggccaagttgtgggatcctctagagtcgacctgcaggcatgcaagctga

SEQ ID NO: 56765 - DNA, 591 bp, Glycine max
  Peptide Sequence Number=SeqID_148450
atggtgaaagttggaacctttcttcgtgccgatcaatcctttattcctgaggaaagctcacatggttcccaatcaagcattgccagtagtagcaaccagatcaagcttattttcgaatatccgtcacctcaggtttttgggcaaaggccgtcgtggcgtatcatggtttctatcagctgtccttcctgttcagctactgacgggattgtggtatccgcgtcacaattcggcacacaagcataccgccggaacatcagcgctggcaagtggctgcgtccctttgccattcgggaaacctgtcggcaactgcttagatcggccaacccgggcgatcgagtgcgggctttcgtattaccagcggcgctaaagggcggatgtgtgcatactggcgattactatgttggcctgataacgccagggtgttcagtcgaatgcgttcgtggagaaaaaaagcgacggctcagtcgaatatgtgatacgactcatatccgggcgaattcgtctgagctcctaccgctcggtctcgatgcggcgacggaggctctagaactagtggggaattcccccggaaagctgcaggaattgatataa

SEQ ID NO: 56766 - DNA, 821 bp, Glycine max
  Peptide Sequence Number=SeqID_148451
atggtgaaagttggaacctcttacgtgccgatcaacgtctcatttttcgccaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagatggtcagcccattgattatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 56767 - DNA, 333 bp, Glycine max
  Peptide Sequence Number=SeqID_148452
atggacccttccagccgatcagggacggtgtcgaggacactgtctgatgtgcgcaagaaggcacaggccatccagaagcagaatactgccccccataagctcctggctgagaagacgaagaaaaagctggaggaagctgcacagtcaggaagcgttgatggcgtcatcgaccctccatccccggtcagatgccacgtgaagtggaagatggcccgcacaaagaagacaggggagatgacgactgagaccgcaaaggaaatcgctaagaagattaatgccatgtaccactgtgtgttttctgtgctggattcgtttgaggagcaggccacatag

SEQ ID NO: 56768 - DNA, 498 bp, Glycine max
  Peptide Sequence Number=SeqID_148453
atggagttggcatgggacggggcgaaatttgggttacctaatgcctcaaatggttttttcatcacacatgcagatgtgactgaaataattttaggtgacaaatgtttaaacatatctgtactgcagctgtggatgatgtttatgaatgattggagtacaagcattggtttttctccagtgtacggtttccttgagccccagtctatacgctgcacaaaggacacatgtgaagaatgtcaaaaggcacattggcaacttcttgtgttgtgtccacgagagaacattatagtatggttctgttctgtacgaagaaagcctgatgttcacattaagtttgcagtgaacaatgcaatgaagaaaatatgcagtaatctccaaggcaaggacaatgcacctccacctccacctcaatggattgaggctaagcatttattgagcgcttatattgcatgtagagccatgtacaacaaggagcatatgagtttggatattatgtga

SEQ ID NO: 56769 - DNA, 357 bp, Glycine max
  Peptide Sequence Number=SeqID_148454
atgtcaggatttacacgcaattctcctcaaatttcagccagcccgcatcaattagaccttgcaccttacgcttcagagccctaccatgctcaatggaacgccccggggcttctccgtgacaagcacacgttgcgttcgagttgtattctcggagaaatggaggttaatgaaccttggctagggttatggctaccattgaattatcaagtagatatgggagcaagtcagcatatgacaacggaatttggggtgaaccctaccggctttttgctgcaaaattcctttttgttggtgtttttggtttgtgctaaaggtggtgttcgtcattggaagtgcggtagacagactttgtggtag

SEQ ID NO: 56770 - DNA, 141 bp, Glycine max
  Peptide Sequence Number=SeqID_148455
atggagcttacacaagttgcagacaagtcatgtttagtccaggaaaaaaaaaggaattggaaaggaggattggtgccatatcttgaagaatttgagtcaagaagaaaggggccaaccaccttaagagctattgaggactaa

SEQ ID NO: 56771 - DNA, 238 bp, Glycine max
  Peptide Sequence Number=SeqID_148456
gatcccacttgtgaagagggctttttccggaggagccctggtgcttaccaacatggatggcgaagagctaccttcacccgggcaggatcatcttgagctaccttctggggtggggacaaaacgtggacagcagaaaccaatcaaggaacggatgcaagtggggatggggtcacgaccgactgatcgttgccctttctatgcgctagacaagcagagaacgtcgctgcaaggcagcccc

SEQ ID NO: 56772 - DNA, 579 bp, Glycine max
  Peptide Sequence Number=SeqID_148457
atgttcaattatcatgagaatggaaaagctcctgatcttgaaagtgtattggctgacttcatgacatatcaagctagctctaaagaatggcaaccttattatcacaatgaagcagaaggattgtctaatctggatgacctgttaatgcaattcaagggtacagtagattcaatgcaacaagcatttaaaagagctgagactcagattggtaagttggtggacgacatgataaagttgtggtcagaagagaagaagagtatgcagagattgaaacccatcaagaaagcattcttcaatgtagaggatcagaaaatctcctttgacctctttgaagcaatgaagcacacagatatcagtgatgcctgttttgaagaagaagaggtggagcaggagatagaattatcagcttcaaccatggtactgcaattccctttggaaaaagatcctaattatgtgatagactgcctagtttgtgatgaagagcttgatgatccaaaagacaaccctattggtcatgataatgagactaaacccgttataattagcagctccttgctgaaggaagaagatgatcaactg

SEQ ID NO: 56773 - DNA, 372 bp, Glycine max
  Peptide Sequence Number=SeqID_148458
atggtgaaagttggaacctcttacgtgccgatcaacgtctcattttcgccaaaagttggcccagggcttcccggtatcaacagggacaccaggatttatttattctgcgaagtgatcttccgtcacagctgtccccctgttcagctactgacggggtggtgcgtaacggcaaaagcacctccggacatcagcggtggcaagtgtagcggtcacgctgcgtggcgtgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 56774 - DNA, 232 bp, Glycine max
  Peptide Sequence Number=SeqID_148459
atggcttacacaagaactcaactcaagacgacgtataaaggttgcatttggcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagg

SEQ ID NO: 56775 - DNA, 174 bp, Glycine max
  Peptide Sequence Number=SeqID_148460
atgggggtgcaaataacacccaggccgacttgggccctccagaatattcctccagaaggctccgaggcgcttccgaaacgtttccgtaacgttttccgtgaagaatttcgcaaaggtttcaaccgttcttcgacgttcttcattcgttcttcatcgttcttcgatcttcaacgg

SEQ ID NO: 56776 - DNA, 156 bp, Glycine max
  Peptide Sequence Number=SeqID_148461
atggataaatttgacatttttgtccctcatcctctcacaaacacatctttgcttattcaacttccaccggaatgtgagtacaagccattgagattactcgtcttgcacgttggtggggggtgccgtaaaacaacgagtaaagttcaaaacaaataa

SEQ ID NO: 56777 - DNA, 543 bp, Glycine max
  Peptide Sequence Number=SeqID_148462
atgtcagttctagaattgtacatagaaaaggatgtggctggtggttcaatgtttcattctgcaaattcccttacatcatgtggaaattatgtatctaatgattacacacaaccgtcaacaaatatgagcaatttaaatcttgacgaagatgatgatcatgatgatgatgattatcttgtgtctaactcatacgttgaagagtcgttagacgaagatgacagtgttgacggtatatcagatacagacaatgaagtccccgacatgattccaccagtaagaattgttcacccagtagaaggtgtacaagcaattgagaatccattttggaatgatgctttgcattataataatatcaactggagccatcctgatgaggaggacatttgtggtttggagatgccatccacttttaatgttggccaagaattatatgttggcatggaatttgatagtaaagatgcggtcaagaatgcggtcaaacaatatgttatgagggtgcatcaaagtttcaaagtggttgaaagcaaatgggacaagtatgtg

SEQ ID NO: 56778 - DNA, 423 bp, Glycine max
  Peptide Sequence Number=SeqID_148463
atgggatcaagtcaaactccttcgcttaaaaagaggttctatcaagtcaaggtcaagagcctagggatcactagtctaaaagagttacggcagttgatgggtcggctccagcggcaagcttttcgcaaagcttacggtaaaatctgggacctagccatggtagaagtctccatagaggccattgcttccctggttcagtgttatgataagctattgaggtgcttcatctttggggatttccagctatcacccatggtagaagaatttgaagagatcctaggatgtcctctagggggaaggagaccatacctcttctcagggttctatccttcattagctagaatttctaagatagtccaaatctcagcgcaggaattagcccacagaaagcaggtagaggcgaatgagccccgttcaccttga

SEQ ID NO: 56779 - DNA, 145 bp, Glycine max
  Peptide Sequence Number=SeqID_148464
ggccgaggtcgcatggtctggagattggcctgaggcccaggcagcagaggcacccgcagaggctcccaacaaggcagatgatgcccacgaggacgaggagatgaccgattttcttgatttcttgggagggagcggagccacatga

SEQ ID NO: 56780 - DNA, 216 bp, Glycine max
  Peptide Sequence Number=SeqID_148465
atgccaaaaggtggctccactcatttaaggttacaggttgtaccatctgtggcgaggctcatgaaacaggccaatgtattcccattgaagaaaacactcaagaagttcattatatgtgtgtcgcaacctacccttcggcgggagggcgacgcgcgactcgcgggtgcgtcttccaagaagggaatacgcgcggagtcgccaccaacgtttatttga

SEQ ID NO: 56781 - DNA, 371 bp, Glycine max
  Peptide Sequence Number=SeqID_148466
agtgtgccgggttacgagaagaaagtgcagctaccgcaaaagcccttgaaaaagaaaccaagagggctcgcagggaagagcatggtcgcgacaaattccgtggagcattatggggcagcaatagtgagctcaagcttcgaagggaagagagagaccgatcacgagcacataacatggttttaaaagaagagttagtcgtttgctcaaggtccaaaagaaacttgtctcaacgtttatgcgagacagagaccaacatgttagctatcatcaccaagtaccaagaagaactaagtctagccacggcacacgagcatagggtagcagacgagtttgcccaagtgtacgcggaagagaggctagaggaagggtga

SEQ ID NO: 56782 - DNA, 204 bp, Glycine max
  Peptide Sequence Number=SeqID_148467
atggtttttagtgattttttacggacaaagcttgatttgagaaaagagggaggtggttgtcgcccagctcgcccaggcgagcaaggttgcttccaccagaaggcaccgccttctgttggaaccccctggaaggcccaagtgggttcggttgctatttgcaccccctttttcactaaatacaccccctttgtgtttttttgttga

SEQ ID NO: 56783 - DNA, 441 bp, Glycine max
  Peptide Sequence Number=SeqID_148468
atgcttccattgatcagaaatcccgacagctggagttgtgttgatccctcaggaaacgatcttgagacgggtgactctgacaggtgcggcttgtacatagaagcagatcctgcccgcctggttgccgtggggagagtttatgagggatccactcttgttcataacactcctttgttgcctggccaagtaaaggtgagtgtggacgaggttaaagatgcatatgctgcagttcctgtacccactgttgaggtttccttagtggggcagacacttcacaccttccttgcttggctgacacatctgatcaagtctttatcaaaccaggtagctgtgtctccgccaaaaccacctccgaagcccgatccggaggtcgatgatccactttatctgatgacattgactatcccaaagcttttcttgaggccttatcaggttagatag

SEQ ID NO: 56784 - DNA, 444 bp, Glycine max
  Peptide Sequence Number=SeqID_148469
atggcgcgcagattcgccagctgggtgcgggcctgccggccttgctggacgcgcaggcggcccagcagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 56785 - DNA, 502 bp, Glycine max
  Peptide Sequence Number=SeqID_148470
gagttgtgcacccacaaaaggaagttcaagggcaatgaaaggattagcatgggcagaaatgtgttagcattgataggtaaatctgttcctcacattcctgagaaatgtaaggacccagatgtggtgattcatatgaggggccaagacatttatagtagccaagatgaggctactacttcaccttcctctaatgaaaatgaagaagcaataggggaagaatctagggaagaaatctatccccaagaagaaggacaacctttaatggttaaggaggagtgtaaggagacacttgttagcactgccacacctcttgggcttgaggttattccccaagtaaaggagttgttggatgagggtttggttcgtaagagcttaaatccttgtgctttgttggtgcccaaaataggtgtcaagggaaggagcccagaatatgaagaacctcgggatttgaggtcaaatcctttccaaggtggaggggatgatgcaatcctaccccgcaagg

SEQ ID NO: 56786 - DNA, 348 bp, Glycine max
  Peptide Sequence Number=SeqID_148471
atgggggcgtattctgcggacgaaaagttgttggtccatttctttcaagacagcttggccggagcagctgtagcatggtataccaatctggaagcttcccagatccgatcaaaaaccttggaggacttggcaactgccgatttcatttggcgtaccagtacaatacggtggatactcaccgttgttatttctttaggaatccagcttcagagtagactaaaggagagcagtccattaggaatacccaaagatggagagcactcgatagcccaagtcataccgcccatgatgaagagggcgagagatcacaattgggatacgttacccacgttctactataaaagctga

SEQ ID NO: 56787 - DNA, 273 bp, Glycine max
  Peptide Sequence Number=SeqID_148472
atgggagagacacatgaagtaccccgagaccacactctagttaacttagagcctcacctcggatatgtctctgaggggcaagcatttggtggcatacccctgtcaaacactttggggggacctcagtattgcccacaaccactacccttacattttgcattggaaagactgcctcctgccatggtggaaagggagaaatttgatcatatagaggaaaggatgagggctatgttcaacgaccggcaagtgcatcggatcgcgcaagtagtataa

SEQ ID NO: 56788 - DNA, 542 bp, Glycine max
  Peptide Sequence Number=SeqID_148473
atgtcagcggttcgagtccgcttatctccaactccacctttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgaatccacgggcaggcaagagacaacctgcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgg

SEQ ID NO: 56789 - DNA, 807 bp, Glycine max
  Peptide Sequence Number=SeqID_148474
atgaggggcactgtacatgagcctcaagcgaacctaagggcagatcaaaaatttcttacctctcatgtccaatcttttgaatgtgggatgatcggccctctcgatgagtcaatctcttataagggtggacccttgggtactagtacctatcgccttcagaggactacacgtcctcgccttcagagggttgcatgtccttgccttcagaggaatacacgtccttaccttcaaagggttacaggtcctcgccttcagaggactatacgtcctccccttcagaggactacacgtcctcgccttcagagaactacacgtccaagacttcagaggactactcgtccacgccttcagagggctacacgccttctccttcagaggaccacatgtccacaccatcagaggactacacacccttgccatcagagggctacacgccatcaccttcagaggactacacgtcctcgccttgagagggtagcacgccctcgccttcagaaggatactcgccctcgccttcaaaggactgcacaccctcgccttcagagggctacatgccctcgccttcagaggactgcatgtcctcgccttcagagggctgcacgccctcgccttcagagggctacacgtcctccccttcgtagggctacgcgccctcacattcagagggctacacgtactcgcctacagagggctacacgctctcaccttcagaggactacacgtcctcgccatcaaagggctgcacgcccctcgcttcagaggactgcacggcccttgcctttgaggactacacgtcctcgcctttag

SEQ ID NO: 56790 - DNA, 1084 bp, Glycine max
  Peptide Sequence Number=SeqID_148475
atggaagaaggagcttcaccaccaagaggagccttggataagaagcttggagaggatgcttcaatggaggaaaagaaagagggagagaaagagagaggggggagcacgaaattgaaggaagaaaaagggagagaagttggccttcccttggatctctggcccaatctacttagagtcttctatccaatgcccttgcggggtaagattgcatcagcatcagcacgcaggcaatgggtacctgtcactgttgccaatgatgagccagtggtacctgcggacttgcctgtggtagttgcggctgaccctatggtagctgccgatgagccgatggtagatgctgatgtacaagacactgttgcagacaccggtgcaaaggttgctgcagatgagtctgagagatttccaagtggaccgaccgacccatcagtgcttactaagtatgctgagcatgttgcagccagcgtatggactggaaaggaacatcctgaattgaagttagcctcccatgggaggaaggtgcagaaattaggtaggattgtccctgcaattgaggggctagttgctgggacaggactaagtcctttgatcgcgtgttcagtagacatcgacgatcggggacttatatcctcatttgtggagaggtggcaccgggagactagtagtttccatcttcctatgggggaggttaccatcaccttggacgacatggcgtctcttcttcatctgcccatcattggcgacttcaaaaccttccaacctctacacgttgatgaggcggtgctgatgttggttgacttactactggccagacattggacagctgcagctcgtgcctatcttcttcatcttctgggttgcactttttttgctaacaaaaatgcaacccatgttcatgttgtcttcatagacgctctgcatgacctcagtcagactaggaggtatgcatggggagttgctgccctcgtgcatatgtacgatcacttgaatgatgcttgtatcagcactagccgacaacttgctggttacatcaccctcttacagtgcaacgctgatccggactacgacgaggtgtcatcacgtgcat

SEQ ID NO: 56791 - DNA, 177 bp, Glycine max
  Peptide Sequence Number=SeqID_148476
gaggattgccatgcgattgctgagaggttggagcgtcatctcaacctagggatagtcacgccaggcacatcgacacatgaggtcatcgaacaatgcctcaggattgccaagggtgtcacagaagaccgcattgtgtatgtgaggtctcgacataggcggcgcacggatcaaccatag

SEQ ID NO: 56792 - DNA, 986 bp, Glycine max
  Peptide Sequence Number=SeqID_148477
gactacacgtcctcgccatcagaggactacacgtcctcgcctttggagggctgcacatcctaaccatcgaaggactacacgtcctcgccttgagaggactacaagtcctcacctttagagggctacactcccttgccatcaaaggactacgcgtcctcgtctttagagggctacgcgccctcgctttcgttggattacacgtcctcaacttcagaggactacacgtcctcgcctttcgagggctacacaccctcgccatcagaccactacacgtcctcaccttcacagggctatacgtcgtcgcctttagagaactacaagtcctcgcctttggagggctggacgccattgccgttagaggacaacacgtcctcgccttcagaggacaacacgtcctcacctttagagggatacacatcctcaccttcagaggactacacgtcctcgccttcagtggactgcacgtcgtcaccttcaaagggctacacgactggacatcctcaccttcaaagggctacacatcctcgccttcagatgacttcacatcctcgcctttggagggctgcacgccctcgtcgtcagaggactacacaggattgcactccctcaccatcataggactagacgtcctccccttcgaaggactacacgtcctcaatttcagaggactgcacgtcctcacctttggaggactacacgtcctctcctttagagggctacacgtcctcgcctttagaggacaacacttcctcgcctttagagggctgcaccccctcgcctttagaggactacacgtcctcgcctttagagggctgcacgtcctaaccctcggaggagtacacgtcctcgccttcagagcactacacgtccacacctttagagggctacacgccctcgccatgagaggactaggcgtcctcgccttcagagggctacgcgccctcgccttcgttggactacacgtcctcaacttcagaggactacac

SEQ ID NO: 56793 - DNA, 658 bp, Glycine max
  Peptide Sequence Number=SeqID_148478
aggactacacctcgtcaccatcatagggctacacgctctcaccttcaaaggactacacgtcctcacttttggaggactacacgccctcacctttagagggctacgtgccctcgccatcagaggactactcgtcctcgccttcagtgggctacacgccctcgccatcagaggactaggcgtcctcgccttcaaagggcaacacgctctcgccttaagaggactacacattctcgccttcagagggttgcacgccctcgccttcaccggactacacgtcctcgccttcagagggatgcacgccctcgccgttggaggactacacgtcctcaccttcagaggattacacgttctcaccttcagaggactacacgcccttgccttcaaagggctacacgccctcgccttcaaaggactacacgtcctagcattcagagggctacacgtcctcaccttcaaaggactacacgtcctcacctttagagggctacacgccctcgcctttagaggactggacgtcctctcctttagagggctacacgccctcgccttaagaggacaactcatcctcgccttcagcgggttgcacaccctcgccttcagaggactactagtcctcgccttcagagtgctgcacgccctcgcctttggaggactacac

SEQ ID NO: 56794 - DNA, 543 bp, Glycine max
  Peptide Sequence Number=SeqID_148479
atggcttcgcttaaaaagaggttctatcaagtcaagatcaagagcctagggatcaccaatctaaaagagttggggcagttgatgggtcagctccagtggcaagcttttcgcaaagcttacggtaaaatctgggacctagccatggtagaagtctccacagaggccattgcctccctcgcccagtattatgatcagccgttgaggtgcttcacctttggggacttccagctatcacctatgaatttccaagatagtccaaatcttggcgcaggaattagaccacaggaagcaagtcgaaaatggggtggcgaatgggccctgttcatagacattctcgcactattgatctttggaggagtcctctttccaaatgtggatgggttggtggacctagcagcgattgacgcttttcttgcctatcatgaccacaaggaaagcccagtcgttgctatgctagccgacctctatgacacctttgaccgaagatgtcctttaatggtgattttccacaatggagatgcagcggaagataaagcagaagag

SEQ ID NO: 56795 - DNA, 162 bp, Glycine max
  Peptide Sequence Number=SeqID_148480
atgaagcatagctccaaactcgaaggtggaggacacatgaacacgctaggcaattacattcatggggctccgaaaaaagtggacaatggaggattgcacttgaaggcaatcatgaagcatagctccaaactcgaaggtggaggacacatgaacaagcgctag

SEQ ID NO: 56796 - DNA, 711 bp, Glycine max
  Peptide Sequence Number=SeqID_148481
atgatgccccgggtgctggcgcgcctgcagccctttggcctgccttgcatcgtggtggacgacggcagcgatagcagtacgcggcagcagttggagcggctggcggcggaaaccgctaatctgaccttaatccgcttaccacagaacgcgggcaaaggcgcagcggtgatccgtgggctacaggccgcagcgcaagccggtttcagccacacggtgcaggtcgatgccgatggtcagcacgccatcgaagatattccgcaactgttggcgctggcgcaggcccatcccgaagcgctgatttccgggcaaccgatttacgacgactccatcccgcgttcccgcctctacgggcgctggataacccacgtctgggtatggattgaaacgctgtcgctgcagttgaaagacagcatgtgcggttttcgcgtctacccggtgacgccaacgctacagctggcgcagcgcgtgtcactcggccagcgaatggattttgataccgaagtgatggtgcgcctctactggcagggaaataccagctattttgcgccaacccgcgtgacctacccgccggacggtttgtcgcattttgatgccatcaaagataactgccgcatctcgctgatgcacacgcgtctgttcctcggcatgctgccgcggatcccctcgctgttgtttcgccgcgcctcgccgcactgggcgcgtcagcaggag

SEQ ID NO: 56797 - DNA, 258 bp, Glycine max
  Peptide Sequence Number=SeqID_148482
atgatgattggatgtggaattacttggatgttgtggaagcttgggaggattgatggggacccggcgttgagaggaacgaggataagggctacgtgggagtacgtgagctcagttggaggtgggcaacaggggatggtggagtggtacttggagatatgtcgtgggggtcaggagaccttggggacgtcaggtggggtgctattgcccaaaaccaagcttgaccaatcccgacccaacccgggcgtggtcagtcagtga

SEQ ID NO: 56798 - DNA, 222 bp, Glycine max
  Peptide Sequence Number=SeqID_148483
gtttttacaaggttgaaagaaatctcaaggaccgcaggttgcttggggactggaggtaggcacggtcagttgcgatgcacatctctctataaaggttacccaaaagagcagctcccatgcataagtgctgcactctctaaggtctctcaaaaattgcaaatatctcattggcacccttttgctgcttttgtcaacaaacatcacgcctcctatgaatcttaa

SEQ ID NO: 56799 - DNA, 369 bp, Glycine max
  Peptide Sequence Number=SeqID_148484
atggtgaaagttggaacctcttacgtgccgatcaacgtctcattttcgccaaaagttggcccagggcttcccggttcaaaggacaccaggatttatttattctgcgaagtgatcttccgtcacagctgtcctcctgttcgtgaaatcggggtgtatccgctcacaatcggcaacaagcaccagccggacatcagcgcgcaagtggctgcccgctttccattcgggaaaccatgtcggtgccaactgattaagggaaggccacgcgatcggggagaggcctttcgtattgggcgaaaggcggagtgtatacggcttaatgttggcactgatgagggtgtcagtgaagtgctttccatgtggcaggagtaa

SEQ ID NO: 56800 - DNA, 322 bp, Glycine max
  Peptide Sequence Number=SeqID_148485
gatatgaaccagcagaagattggtacagttgagatggtggaacgactctacagacttgagatgattcttatcaagtctaagtacaagtctgattttgctgctaatagaaagaaactagatcctaaggctgtcacttctgtatttttgagttttaaactaaacaccaaaggattcattatgtttgatcttaaaaccaaggccatatctgcctttaggaatgtgatcttctataaggatttttttcctttcattggtcaagataaacctgatgttgttattgtccttcctattccttcttctcatgccattgatcaacctgatg

SEQ ID NO: 56801 - DNA, 476 bp, Glycine max
  Peptide Sequence Number=SeqID_148486
tggaactttaatcgctcctcaacgtctctttgcggaagttggcgaagggatcggcaacgagggactaaccattcatttattcgatatccgtcacctcgagctgtccctcctgttcagtactgaggaattgttatccgtaatcggcaaaagctaccgccggacatcagcgctggcaagtgtaaagcggtgcacgccaacccgggcgatcgagtgcgggcctttgcgtattgccggcgaaagggcggagtgtatactgcaggcttactatgttggctgtaacgccagggtgtttcccagtgaagtgcttcatgtggcaggaaaaaaaggctgcacggtgccagcagaatatgtgaatacggactcactattccggcgaattcctcgctcactgactcctaccgctcggtcgttcatgcggcgacggaaggcttacgaactggggcggaattcccggagctgcaggaattacgatgaat

SEQ ID NO: 56802 - DNA, 141 bp, Glycine max
  Peptide Sequence Number=SeqID_148487
atgcagaaagaaaaagagaaggcaaaaacgctcaaagcatgttcgcattttggtgaagaaaacaccgagactatttttagtctcacagttgtcaagaactacgtaggtctgagttcctcatcacaaattgaggatacgtag

SEQ ID NO: 56803 - DNA, 177 bp, Glycine max
  Peptide Sequence Number=SeqID_148488
atgggaacgctgcacgactttggccccaaagaggactggggcacattttctgtgggagccttacacagcaactgttttgtcgatgttgcctcccatttgtttggttggtactgtggcgtggtgcgcagtggtgccactcatttgtttccatgttgtagagtggcaccaacccgatag

SEQ ID NO: 56804 - DNA, 546 bp, Glycine max
  Peptide Sequence Number=SeqID_148489
atgaagcacttcactgacaccctcatcagtgccaacataggaacaaaagctggtaccgggccccccctcgaggtcgacggtatcgataagcttgatatttcgttgacgtcagctagtgcatcaaacagaaggcctgctgggaattcgccgcagaacacaactgcactaggcgtcaaccaagacgcttctagctcaaacccttctactccagctccttggggttcacctctggagggcttcaagggacgtgaaggctctgtattgccttcagatgatatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 56805 - DNA, 207 bp, Glycine max
  Peptide Sequence Number=SeqID_148490
atggctaccctgcctgtcggtacttcctgctgccgagtgccggtgactccgtggcggcgctatgcccgttcccagaccagcttttcattggacagcgtgtcttctccgtcccaacggtacgccacgaggggaccgcccgccgcggccgaccaatccaggcatgcgagcttcccgctctcgatcctgggctgccccttgaaccaatga

SEQ ID NO: 56806 - DNA, 478 bp, Glycine max
  Peptide Sequence Number=SeqID_148491
atgggaacaaatcaaactggaaaaaggttttatcaagtcaagattaagggcctagatatcaccagcattaaggagttaggacggatgatgggacctctccaaatgcaagccttccgcaaggcgtacagaaagattttagatttgaccatagcagagatatccacggaagccgttgtatctctcacccaatactatgaccagcctttgagatgcttcatgtttggagacttccaattagtatcgactgtcgaagaatttgaggagattctaggatgtcctcttgggggaaggaaaccgtatcttttctccgggtttcttccctccttgagcaagattgtagttgtggtcagggattcggcaagagagttggatcgtgtaaagcaaactcgaaacggcgtaagtgggcctactacggaagtacttagaaggcaaggcaaaggatatggcgaatcaagaggagtgggtcccgtttatggat

SEQ ID NO: 56807 - DNA, 300 bp, Glycine max
  Peptide Sequence Number=SeqID_148492
atggcgatcgcacccacaaagacacccagtggaactgaagaagtccaacagggccctggggtttccagctttggttacgggcctctgtcggccctacagggcgcccgtttcccccagcaagattgtgcccgcaagacacctagtggacccgaagaaggccaacagggtcttggagttgccatctctaaatacgggtctctgtcagttctagggagtgcctgtcgcccccagcaaggtcatcaggccccccctaccaatcgagctttcatcaagaagtactgcgcccccaggcaggcgtag

SEQ ID NO: 56808 - DNA, 168 bp, Glycine max
  Peptide Sequence Number=SeqID_148493
atgaggagagggttaggggatgaagaggagaggtttcagtttggtatcagttcagctaaatgggagatgttacaaacacttcaacccacggtggctttatccactacaaaggcagagtacatggctctcgaagaagcagtacaagaagaaactaaagggcctgattaa

SEQ ID NO: 56809 - DNA, 393 bp, Glycine max
  Peptide Sequence Number=SeqID_148494
atgggcatgtttgcccctggtatgacgaaaggtgcgggtaaccataagttgacgaaagttgcgggtaaccataaggtaaccctcgcatgtcacttgacttcacgggtcggacaacaaaaggtgcagaagacgattttagtctccgcgcgtcaacgtgggctcgtttgccccttgttgaggaaaggggcgggtaaccataaaggacgacaaaagttgcagaagacgatgttagtctccgcgtcaacaggctcgtttgcccctagcttgacgaaaggtgcgagtaaccagaaagtaacgccgcatgtcacctgtcttcacgggtcaggacgacaaaaggtgcagaagacgatgatcagtctctgcgcgtcaacggactcgtttgcccctggatga

SEQ ID NO: 56810 - DNA, 824 bp, Glycine max
  Peptide Sequence Number=SeqID_148495
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtgaacttcagtgtccttatctataaagagacatacttggcctggccacacaggaagatgggaggcttgttggaggtatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 56811 - DNA, 189 bp, Glycine max
  Peptide Sequence Number=SeqID_148496
atgaagttggaagcttacttggatcgaagatgcttcgtagagattaacagaagatgccagaaggatgcacaaatgcaatgcgcaagtatttgggagagagagattgtaagcgcaaatagacgcactcatcgagttgtgcagatgaaaattcttgcaactctcgctaagccgggctcatggccggcttag

SEQ ID NO: 56812 - DNA, 291 bp, Glycine max
  Peptide Sequence Number=SeqID_148497
atgattcatttggttaaggccagacgggggcattgggttcacctaagcaatagcgctggtagcggcaactgcaatcgtattggcttccattatcttcttcatgctcatcatggcctccatcattgtggccattcgctctttcatggcctccatgtcagccttcctctattcttgcacctcctctacttcactcattactctagctctagcacgagttcggcaccacatacaccagttagcccttcgtccattaagcatgaacgcaagttaggctcagaggcaattaattaa

SEQ ID NO: 56813 - DNA, 855 bp, Glycine max
  Peptide Sequence Number=SeqID_148498
gaacttaccgtgaccactagcaaattgatcaagggcgataccctgaccgaaaccagcaatgcggcagatggttttaacccggcaactgaagtcagcaactacagctatacgtcagaccgcgtcgctaaaccggtctataacaaatacaaaagcgcgaccaacaaaccaaaggtcttcggttactacaccgactggtctcagtacgatggccgcctgcagggcagcgatgcgaaagataaccgcggacgcggctacgacctgaccaacgtctcccctaccgcttacgataaaatcatcgttggcttcgtcggcgtaaccggcttccataaagtggatggtctgtatcgcgatgtggtagccgaaggggctgagcagtgcggcaaagtcaaatatgaaccgaccttcctcgacccgtggggcgacttccagtcttacgttaacgttggccacagcgtcagcggctgggatgtcgatccgaaaaccgtaacccagacaaacaccaaaggcctgctcggcggtctgcgcgacctgcaagcgaaagccaaacaacagggccacaacctggtgctgtccatgagcatcggcggctggagcatgagcaacggttttcatgaaaccgcggcatctgattcctcgcgtaaaatcttcgctaaaggcgtggtgaagctgttcaaacagttcccgatgttcagcgaagtggatatcgactgggaatacccgaatgccgaaggcgccggcaacccctacggcccggaagatggtgaaaactatgcgttacttattgccgaactgcgtaagcagctggattctgccggcctgagcgatgtcaaaatctctatcgccagctccgccgtg

SEQ ID NO: 56814 - DNA, 732 bp, Glycine max
  Peptide Sequence Number=SeqID_148499
gatgttctcactgctgctattggacgtccagagcaccctggacgtgttcgtgttgctggggccggtgtcaccatcaagcaatactttagatcggctccacggatgtcccacagctcttcctccctgcctcctgaagaattgcaacagttgacccagcaaatcagggaccagctagaggagtccatcacagaaaaagtgacgcggcagctcatggcatccttcatcctggtgcagtcccagatgcaatctcagggacttgcactgcctcccgagcctctggttggtccctctggtcctcaagtaagcacaaaggggagttgtgttgatccctcaggaaacgatcctgagacggctgactcagataggtgcggcttgtacatcgaagcagatcctgcccgcctggttaccctggggagagtttatgagggatccactgttgttcataacactcctttgttgcttagccaagtaaagatgggtgtggaggaggtagttgtgtctctagcaaaaccacctccaaagcccgatccagaggtcgatgatccgctttatctgatgacattgaccatcccagagcttttcttgaggccttatcaggttacatgggatgccaccgtgttcggggtctttaatccagattttctgctctacataaagcatgaagacctctccaaaatcgcacacggtggtcaatgtctcaacatatcagtgttacagttgtggattctgtaa

SEQ ID NO: 56815 - DNA, 1049 bp, Glycine max
  Peptide Sequence Number=SeqID_148500
atgtctcaacatcaaagagggccaagaaatctgggaaaaaggtgcctgaaaatgtccctgatgcaccattggacaacatctcagtccactccattggcaatgctgaaaggtggaaattcgtgtatcaacggagacttgccttggaaagagaactgggaagagctgccttggattgcaaggagatcatggacctcatcaaggctgctggactactgaaaacagtcaccaagttgggagactgttatgaaagcctagtcagggaatttattgtcaacattccctctgacataacaaacagaaaaagtgatgattatcaaagagtgtttgtcagaggaaagtgtgttagattctcccctgctgtgatcaacaaatacctgggcagaccaacagatggagtgatggatattgctgtctctgagcatcaaattgccaaggaaatcactgccaaacgagtccagcattggccaaagaaagggaagctttctgcagggaagctaagtgtgaagtatgcaattctgcacaggattggagctgcaaactgggtacccaccaatcatacttccactgttgccacagcattcagaatcatttgctgtcaaattaccattgccttcccaactgtattgtgtggcattatgttgagtcaacaccccaatattttaaactacactgactctgtgatgaagagagaatctcctctatccctgcattacaaattgtttgaggggacacatgtcccagacattgtctcgacatcagggaaagctgcttcaggtgctgtgtccaaggatgccttgattgctgaactcaaggacacatgcaaggtgctggaagcaaccatcaaagccaccacagagaagaagatggagctagaacggctgatcaaaaggctctcagaaagtggcattgatgatggtgaagcagccgaggaagaagaagcagctgagcaagaagaagaagaagctgaggaagaagaagaagaagccgatgacgaagatgcagcagaggatacagaatccgatgatgatgattctgaagccaccccatga

SEQ ID NO: 56816 - DNA, 198 bp, Glycine max
  Peptide Sequence Number=SeqID_148501
atggatggattcattgaaccgatgtgtcgcaacctacccttttgcgggcgagcgaggcgaggctcacgggtcgacaaaagcggggctcttgctcctacgtaccctccattgaagaggaaatcagacctacatagttcttttttaagggtgaatcaagtggttctttttacttggaaggtgtccattttaaggcgttag

SEQ ID NO: 56817 - DNA, 426 bp, Glycine max
  Peptide Sequence Number=SeqID_148502
atgaagcacttcactgacaccctcatcagtgccaacatatttgaacttccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 56818 - DNA, 282 bp, Glycine max
  Peptide Sequence Number=SeqID_148503
atgtaccctcccttgttctctttgaacctagtggatgtaccctccactagaactgatccacaagagatgtaccctctcttgctctcagtcaaacccaaggaatgggaagaatcaaaagaattctcagactatgtcgttttgaattctttgacaagggagaagggagacacaaaagaattcaggcggttagtcattggcgaattctttttggcaaagggagaggagaatgaaaagatgaatagcacaagttttcaaggtttggaaaaccagaaaacttcataa

SEQ ID NO: 56819 - DNA, 441 bp, Glycine max
  Peptide Sequence Number=SeqID_148504
atgtacatgatgaggttgtcaactctcaatgagtacgggagtggagttattgacatcctcattgggagtgtacgccacattgggtggtatatagttgagaggcaagccatatggcgggaaggcgtgctcgttttgaatttgcacatcatggggccgttcgtacttcccaaatctttgcctaccatatctgagaggaaaacgcaaggatcatgcatgagcaaacatgaaaacaaaagacaggagagcccgaaaaattatctcttcttgcttgcacattcggggatgcagtgccccatgtgtgtagttaagaaggtgatatggacctttcggcttcccgtgacaaaagacgagaccaacatacaacacatgcgtgatgacatgatgcagatgcgcaaaagcgcaacagggagatgtacacaacatggcaatatcctcaaataa

SEQ ID NO: 56820 - DNA, 297 bp, Glycine max
  Peptide Sequence Number=SeqID_148505
atgtctcttgccactttatttggtaagttgcaggaacacgagatggaactattgagattgcaccaaaatgaagaaaatgacaagaaaaagaaaggaattgctcttaaagcatcatcctcaattcaagaagaaagtgatcaggataatgatgcagatgatgatgatgatctaagtttctttaaaaagatggaaaaatctgaaaagaaaaatcatagtgagaagaaactaaagaaagcatacatcacatgggatgaaaatgatttgaatcctctgatgattctgaaaatgaagagataa

SEQ ID NO: 56821 - DNA, 76 bp, Glycine max
  Peptide Sequence Number=SeqID_148506
atggaaggaaactcacaaacacctcgcacttcgaaggagcatgctgcgttaagcgagtttatccatactcatttat

SEQ ID NO: 56822 - DNA, 816 bp, Glycine max
  Peptide Sequence Number=SeqID_148507
atggaactcttcgccgctcaggcgaaagatgtcgacattattgtgaccaccgcgctgattccgggtaaacctgcgccgaagcttatcacccgtgagatggtggattctatgaagccgggcagcgtgattgtcgacctggcggcgcaaaacggcggtaactgtgagtacaccgttgctaatcaggtgacgaccaccgccaacggcgtgaaggtgatcggctataccgatctgccaggccgcctgccaacgcagtcgtctcagctgtacggcaccaacctggttaacctgctgaagctgctgtgcaaagagaaagacggaaacgtcaccgttgatttcgacgatgtcgtggtgcgcggtgttaccgttgtccgtgatggtgaaatcacctggccggcaccgccgattcaggtttctgctcagcctcaggccgcgccgaaagcggcgccagagccaaaagaacccgctaaaccggcgtctccatggcgtaaatacgccatcatggcgctggtcattatcctgttcggctggctggctgacgtcgcgccgaaagagttcctcggccactttaccgtcttcgcgctctcctgcgtggtcggttactacgtggtgtggaacgtctcccacgcgttgcacacgccgctgatgtcggtaaccaacgccatctccgggattatcgtggtcggggcgttactgcagattggtcacggcggctggatcagcttcctgagctttattgcggtgctgatcgccagtatcaatattttcggtggtttcaccgtgactcagcgcatgctgaaaatgtttcgtaaaggctaa

SEQ ID NO: 56823 - DNA, 522 bp, Glycine max
  Peptide Sequence Number=SeqID_148508
atggataatgaagagggcgtgcaggaacagatgaaggccgatctatcagccttaaaagatcaaatggcttccatctcggaggtcatgctaaaactccagaaaactatagaggataaagccacggcaaccgcctccagtacagttagggaagcgaagccggtgctagagcccgccttaaatctgggccgagacagaaacacggcagtgtttggtcggaggtatagcccgcaagcttacccctatggcttgcctctggacttcgctccctgtgccgccccggaagatttaagccaagcccctaccttcgaggggcaactcccaccttataacgactatcccgtgcaagaagatgaggaaggagatacccatctcggccccctgctccaccttaaaaatccgtccccccatgaactaccccaaccaaacatagttcgtcatgtcccggcttcacccgcacccgtaaaagaatctgttcccttcgcgaaaataaaggaaagattggggcgcttgaagagaggttaa

SEQ ID NO: 56824 - DNA, 270 bp, Glycine max
  Peptide Sequence Number=SeqID_148509
atgaaaatacaaaaaaaaggggttcccgtggatcctaagagattgaaggttatttctgagtggcccactccactaagtgttgagggaagaagcctagagcttcaagaaccgctggatttaaggtcaaatccttttcaaggggggggaatgatgcaatcctaccccctaagggcattggatagaagactccaagaagattgggccagagatgcaagagaaggccctagggttctcatgagccttagggtagattttgggcccatgggctaa

SEQ ID NO: 56825 - DNA, 357 bp, Glycine max
  Peptide Sequence Number=SeqID_148510
atgtcgatctccccctacggaagtatcaattggggtcgcgcccacaagacacccagtggacccggagaagtccaacagggccctggggtttctagctcgggttacgggcctttgtcagtcgtacaaggtgtctgtccctcccagcaaggatcgcgccccaagacacccagtggacccggagaagttcaacagggtcttggggtttctagctttgattacgggcctttgtcattaggccccccattaaccgggttttcatcaagaagtactgcacccctaggcaggcgtagggcgagacaccacagcagcctggggatggctgatagcgggcaacaggcacaccgccaccacctctag

SEQ ID NO: 56826 - DNA, 171 bp, Glycine max
  Peptide Sequence Number=SeqID_148511
atggatgccagtgtatcaggggtcgttaatccagatcttcctgtacagcctaaatcagaagacctcttctcgctacaggtggcaattgtctcagaggtacttaacataaacaggcatactactgagtgcggatctactatgtcatgcactggatgtccaccatcattttag

SEQ ID NO: 56827 - DNA, 764 bp, Glycine max
  Peptide Sequence Number=SeqID_148512
gaggcagcacaatcaactggttcctcgatggaaggaaggaaaagagggagttctcttctcatgtgaggactacccaaacgtttcgttgatagggacgaggggttgtattaactacaatcgcgcacttgctataagacagttagggtaccccatgaggggagaaccgacggaagagagcctctcgcctttccttgtgagagattttggcgcgcaaagtttcaagattgtacaaagagtccacaaggcgtgggaaagtccattaaggaaagataaagaacttaggggcatccgaaatggcatcatcggtggttatcatgaatggctaagagttcatacacgagggttagattggctctccaagttgaaaattatcaacgaggagaacttcgaagctccggaagaggatgaagaattccaagctctaaaaacagagctaggaaaggcaagactcgccaaagaaaaattcaagttagtcgctacaaacatccagaaagagtgtgccgagttacgagaggaaaatgcggctaccgcaagagccctcaaacgagaaaccaagagggctcgcaaggaagagcatggccgggataaattccaaggagctttgttgggcagcaacaatgagctcaagcttcggagggaggaaagagaccagtcacgagtacatggcatggtcttaaaggaggagttagctgcttgctcaagatccaagaggagtttggcccaacacttagaagccacagagcaaagcatgctagctataatag

SEQ ID NO: 56828 - DNA, 1008 bp, Glycine max
  Peptide Sequence Number=SeqID_148513
ttttgggacttgagtgttttgtgagccaccttgatgttaccctaacatcaagtgttggacctgagtgtgtagagttgatctctattgttcagagagcaatctctggttgtatacagtggctgttagatcttcgaactaatactattctagtggatttcctccctggcttggatgtaatgaaaactaaaggaaatgagtttgaggattactttttgaagcgtgagttgctcatgggaatatatgcgaagggttttgaaaggccttctcccatccaagaagaaagcatttcgattgcttttactggtagtgacattcttgctagggctaagaacggaactggcaaaacagctgcattttgcattcctgcattggataaaattgaccaggacaataatgttagtcaaggttcagctggagttgcagtaacaagccgaactttcaagtttgaagggcacatcaattgttatactggtcccaacccgagaattggcattgtagacttctcaagtgtgcaaagagcttggaaagcacttgaaaattcaagttatggttacaacagaatattagatcttgccaagaaaggtgtttgtattctgaaagattgtgctatgcttgttatggatgaggccgataagcttatgtccccagagtttcaaccttctatagagcagctgattcattttcttcctacaactcgtcaaatcttgatgtttttagcaacatttcctgttactgtaaaggatttcaaggataggtatcttcgaaaaccttatgtattcgtggaagagagacagaaagtccactgtctaaatactcttttttctaagctgcaaataacccagtctatcatcttctgcaattcagtaaatcgggttgaactccttgccaagaaaatcacagaacttgggtattcatgtatctacattcatgcaaagatgttgcaagaccatcgtaacagagtgtttcatgacttccgcaatggcgcatgtcgaaatcttgtttgtactg

SEQ ID NO: 56829 - DNA, 423 bp, Glycine max
  Peptide Sequence Number=SeqID_148514
atgactaggggcaatccaggtgttttaaaaccctttgatcctaaaatagatagaacctttcatagattagttaggcatagtgtgcatcctggtcattctgtgcattttgagcattctgcgcattctgttgagggtgattctgaatattctgattttgagcattccactaccaattttcatactaagaacatggatcaacctgcacctcgtgagaggactcttagggagatggctgcacctgatttcacttatgaaagcttgtgcattcaatatcctgatgagggtgttccatattgtcgcaacctacccttcggcgggagggcgacgcatggctcgcgggtgcgtgttccaagaaaggaatacgcgcagagtcgccaccaacgtttatttgaggaaaacgttggaaaaccagaaaagacgtga

SEQ ID NO: 56830 - DNA, 504 bp, Glycine max
  Peptide Sequence Number=SeqID_148515
atgatttacgcttttgatacctactattatgagaattacgcctacacagtctgtctggcattcaaagactgggaagatgatctggagacagcagcttacagtgaaaaaactcctataacttctgactacgaaagtggagctttttacaaacgggaacttccatgtattctaagtttattatcaaagattgatctcaaaaatggagatattctgttagtagatggttatgtgactctcaataatgaaggtaagattggactcggaggatatttatatgaaaaattagaagaaaaatatcctgttgtgggaattgcaaaaaatgaattctccgctcctgactctcagcggagaacaatctataggggggaaaccatactgctgctaaatcctaagaatctggcaaaaataccaataaaagcagcattgaaggtaacctttggaggtgctgaagaaaccataaatgatacaataggaacaaacaagacccctgtagaaactccatag

SEQ ID NO: 56831 - DNA, 261 bp, Glycine max
  Peptide Sequence Number=SeqID_148516
atgggagcagaagacgacgttagtctccgcgtgctaccaggattttcgtcttacagacagcaaaaaagaatgtttatacggataacaactcggatagcaaaaaagaatgtttatacggataaccactcgggtatttccgcccgtcagcgtgactcaaatgtcagtatgacagatcttgtgcgcgcggaagatgacgtaaatctccgtgtgtcaacgggcttgtcggccgcgattgacgaagggcgtaggagacgacgttag

SEQ ID NO: 56832 - DNA, 523 bp, Glycine max
  Peptide Sequence Number=SeqID_148517
gcttttcatcttacagacagcaaaaaagaatgtttatacggataaccactcgggtatttccgcccgtcaacgtgactcaaatgtcagtatgacagatcttgtgagcgcggaagatgacacagcaaaaaagaatgtttatacggataaccactcgggtatttccgcccgtcaacgtgactcaaatgtcagtatgacagatcttgtgagcgcggaagatgacacagcaaaaaagaatgtttatacggataaccactcgggtatttccgcccgtcaacgtgactcaaatgtcagtatgacagatcttgtgagcgcggaagatgacgtaaatctccgcgtgtcaacgggcttgtcggccgcgattgacgaagggccagaagacgacgttagtctctgcgtgctatccaggcttttcgtcttacagacagcaaaaaagaatgtttatacgcataaccactcgggtatttccgcccggcaacgtgactcaaatgtcaatatgacagatctggtgagcgtggaagatgac

SEQ ID NO: 56833 - DNA, 982 bp, Glycine max
  Peptide Sequence Number=SeqID_148518
agaacgccgaactgagagacatcaacatagccaccaccaaggccttggagcaagagaccaagagggcccacaaggaagaacatggctggaacaagttccgaggggctctgtggggcagtaacagggaacttaagctccgaagagaagaaagggaccaatcgcgagtagatggcatgattctgaaggacgaattgaagacttgcctaagcaagtacaaagaagaattaaatttggccaccgcccacgagcacaaagtggcagacgaatacgcacgagtgtacgcaaaaaaggaggctagaggacgggtgattaacttaatacatcaagaagcgacaatatggatggaccggtttgctcttactttgaacgggagtcaagaacttccccgattactggcaaaggccaaagcaatggcaaacgcatactccacccccgaggaagtccacgggctcctcagctattgtcagcatatgatagacttcgccataactaaacgcaccccaaggcatccctatcacaccagatccaagtctaggatgatgggtgacctagaggaagtgcaggaacagatgaaagctgacatgtcaactttggaagaacaaatggcttctatgatggaggccatgctgggaatgaaacaactaatggagagtaacggggccaccgccgccgccgttagcatggctgccgaggcagacccaactctctcgactactacacaccatcccgttccaaacattgtgggacgaaggaaaagcacaccggggcatgtcagcaacccccatccaaggtacaaccgaggtgcttacccctacgatttaccacccaactactcaccaccagccatgcatgaagatgtgggtcacgttactcccttcatccttgaaggggagcctcctcggcatcctaatagggtccacgagaatcctcgagagcgcactcagggagacgtcgactcctactccccgtttcacgctgaggg

SEQ ID NO: 56834 - DNA, 279 bp, Glycine max
  Peptide Sequence Number=SeqID_148519
atggcattagcgtgtgacttttgtaaggagacaacccatggggtattagaaataccaagatgtgcacatgtgcaatttttggcaccccaaaatgctttgagtatgcatgtatgtaaatttagccaaggagatgtgtgtgatgttgtatgccatttttgttttaagagtagtgtcccactggtaaaactaactttccaaatgtttgccttcgcaggaaatggccccaaggaagcttgcctcaaagaggtccaggaaggacaaggcagccgaaggaactag

SEQ ID NO: 56835 - DNA, 420 bp, Glycine max
  Peptide Sequence Number=SeqID_148520
atgaacgaagatcaatggacgtatgactacgcgatgtcacaagaagttcatatggattatgattatgataatgaagaagaatgtggggtgaatgaaccacatttcgattgttcaaatgcttttaatacgtctcagtgggctcgaacagttgcccatgaaaatggatttgttgcagtgattatgaggtctgacacagataccggtagcagaggaagaagttcatttgtcttaattgggtgtgaaatgagtggtacatacaagtgttggaataaagaattcgttagaaaagacactgggagtaggaaatgtggttgtcccttcaggcttcgtgggaaaccagtgcatggaggggaaggttggatggtgaagttgatctgtgggatcgcctccttgttgttattgtcactgacagagacctag

SEQ ID NO: 56836 - DNA, 234 bp, Glycine max
  Peptide Sequence Number=SeqID_148521
atgtctcctccacctctagaacctcacaatcactcacagactcatcccatgctctcaggacggcttcctcttctcgctcagttctctcggatgaactcaagcagtgcgcttagcgggattagcccttggccagcgaacatgcacaactcatccttctatcagattcatcctcgcactcagctgcaagagtggtgcgctcagcggatggctcaccaagccagcagattggcttag

SEQ ID NO: 56837 - DNA, 61 bp, Glycine max
  Peptide Sequence Number=SeqID_148522
ggtgtttgctcctacgtatcctcaatttgtgatgaggaactcagacctacgtagttcttga

SEQ ID NO: 56838 - DNA, 276 bp, Glycine max
  Peptide Sequence Number=SeqID_148523
atggcggctaacctaccaaaccatcaacgttcggaaagaggacaaccccaaaaatcaacaaagctaatatatctacaaacggcccccacttctcttggctcgccatatcccttgccttgccttccaactgcaatcttgctcaaggaaggaagcaagccggagaaaagatacggttttctccccctaagagggcatcctaatatttcctcaaactcttcaatagatggtaccatttggaagtccccaaacgtgaaacacctcaacggctggtcatag

SEQ ID NO: 56839 - DNA, 183 bp, Glycine max
  Peptide Sequence Number=SeqID_148524
atgccaaaagatagggggacttgtcttgatttcagggattgtcatcatcaaaaagggggagattgtagacaaaggatcaagctgaatgttttgatgatgcgaaagtttcacatgagtctcaaagttttattcaagacaaagaaattaaagatattcaagatggatgatcaagacagtctctag

SEQ ID NO: 56840 - DNA, 117 bp, Glycine max
  Peptide Sequence Number=SeqID_148525
atggaaaaaggtgtcgagggaaggagcctagagtatgaagaacctcgggatttgagttcaaatcctgtccaaggtggaggggatgatgctatcctaccccccaagggtattggatag

SEQ ID NO: 56841 - DNA, 468 bp, Glycine max
  Peptide Sequence Number=SeqID_148526
atggctccgaagaaactttccacgaagaggtctagaagagacgttgcagcggaagggtccagtgccacccccgagtttgatagtcatcgtttccggagcgccgagctccagcagcgcttcgaggccatcaaaggatggtcgttccacaaagagaggcatgtccagctcagggaggatcagtatacggactttcaggaggagatagctcgctggcgttggacgtcactggaaggccagcaatgtgagttcagccagaggaggaacagggccgacgggttcgacgaggaggccattgcccagctgttatgcacaccagggcaggatttcgcccggaccgctgcagggaggcgggtgcggatcatgcgcaccagcatgaccactttgacccagacgtggatgacattgcagctcagcaatgtcttgcctaacgatcataactccgatctccctctgccgaagtgccagttg

SEQ ID NO: 56842 - DNA, 222 bp, Glycine max
  Peptide Sequence Number=SeqID_148527
atggtatcttttgtcaatcaatccaagtattgcaaagagttaatccacaaatttgacatggaaaatgctaagcacatggctacaccaatgagcactgcttgctatctagataaagatgaaaccagtcagtcaatagatgttaagcaaaatcgagaagcggaagtatatgttgaacactaccaggttttgaaattattggatgaagccaaatcatgtctataa

SEQ ID NO: 56843 - DNA, 443 bp, Glycine max
  Peptide Sequence Number=SeqID_148528
cgagcattcactaagcgcgacactcaatggctaagcgcgaggaagaatccagaagaagatgagttgtcaggttcactgagtgcaccgccccaggtcatcaagtgcaccgctttagctcatccgctaagcgagataagcacgttgagccaaaaatcactaacgtgcactaagcacacgagcacgaacaaggccacctatttaagcctgaaatcagatttgcaaatagagtttggagtttttcttgaagaagcctctgcatgcacgagattctggccctggcttgaagctttttcatgtttaggatgttctagagagataaaggtccaagttccaaagagttctgagagattttgctgtgtgaagatctgcagagatgcgagttcgaagcggaagccgtttccggactatggaaagctaaatcctctattggatcttccctgtag

SEQ ID NO: 56844 - DNA, 102 bp, Glycine max
  Peptide Sequence Number=SeqID_148529
atggtcaggggtaagagggctatgaaagaaaggatcagagaggctcaaagagtgtttaagaaaacaaatatgctttggcttggagggggtagcaagggataa

SEQ ID NO: 56845 - DNA, 438 bp, Glycine max
  Peptide Sequence Number=SeqID_148530
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatccatttcagtgcttacactatgctgggggaagctgagctacagctttaccttgcttag

SEQ ID NO: 56846 - DNA, 426 bp, Glycine max
  Peptide Sequence Number=SeqID_148531
atggcccgagttatgttggggaacggttatgaacccgggatgggtttaggcaaagacaacggcggcataactagcctgataaaaaaccaaggaaatcgtgggaagtatggtttaggctataagcccactcaggcggacataaaaagaagcatcgcgggaaggaagaacagtggtcaagtgttcgcgatatgcgaagatgatgttccgagtaccttggatttggtacgaccatgccctcctgatttccagctgggaaattggcgagtggaggaacgctccggcatttacgctacgagcataatatccgatgacgagtcccccaaaggtactaatacctgggacccgcctatcgacttcgagcaagaaatgaatcaaacggaagatgaaggaaatgaggatgtaggacttccccccccccagaactag

SEQ ID NO: 56847 - DNA, 258 bp, Glycine max
  Peptide Sequence Number=SeqID_148532
atgactagttttgcacgtagtttccaaatcatcattgtcacgcatgccttatggaataatgtggaagttcggcccgagaccgacacctcgtcacccaaatttgttttgccccagatatcaagattgggttcccacgatgaaagactccatcaaaacacaaccttagacctttttgaaccttggcctgtaaaaaagggaatcctcattctttctcccgaagcaaaggacagcggaatctcctcaagggagagcgaatag

SEQ ID NO: 56848 - DNA, 405 bp, Glycine max
  Peptide Sequence Number=SeqID_148533
atggtgctgaagctatcattccccggtcaccagtctacgattggcagtaccgcatcgattgggagacatagaaagcgatcgtttacacaaattgatccatcccgaataagatggcaaccgcatgtgctagagcaacagcgtcaagcttggcatgataggcagttacgtcataaacctatttcaaaggctaccagacttgggacaaaggaaatgaactacaacaaaggacttcaacttaagaacaaggataaccaggaatcagagcagaattcacccagcagctctgttctcagtaggaaagtcgcgtgggttcaaagtcctaagctaggaggaagaccggcatctgagaactcctctaatgctgctaaggaaggacttggccggctaggaatccgcctgacctaa

SEQ ID NO: 56849 - DNA, 369 bp, Glycine max
  Peptide Sequence Number=SeqID_148534
atgacggccctcgccttcgatgaggatctacacgctctcaccttagaggatacacgtcccgccttaagggtcatgtaccctcaccttcagaggactgcacgtcctcgccttcaaaagtcactgtaccttcaccttagagggccacacgccctcgccttcaaaggactacatcgtcctcaccttcagaggactacacgtccttgccttcaaagggtcatggactacacgccctcaccttcagaggactacacgtcctcgccatcagaggactacactgtccccaccttcagagggctacacgccttcgccttcagaggactacatgtcccccttttcaaagggctacacgccctcgcccttaaagggtga

SEQ ID NO: 56850 - DNA, 115 bp, Glycine max
  Peptide Sequence Number=SeqID_148535
atggcgactaagatgaagcgatgcccattggaagccttgggttcggtggccccgatcacgtctatgccccacatagagaatggccaaggtgctgccaagatgtttaatggtacag

SEQ ID NO: 56851 - DNA, 465 bp, Glycine max
  Peptide Sequence Number=SeqID_148536
atgagaaagcgcagaaagttgaatatcattcagaatgatggtcaatcacaagcaaaagagcaatcaattgaaagctctactgaagtgaaccaaaataacaactctatacttgaagaaaatgcacaatttgaaggagaacaacacatacaagaagatagtcatgttcagtctcatacttctcttgaaagtgcaagtgaaagatcaactaaaggtaagaagagaaccagaggttatacacatatgctagatgtgtgggacttgccagatggagaattcatacttgttgaagtagatcattggggcaatcctatgggttgggaagggaaaactatactgaatgcaattgggagcttggtaaggagacaccaatgtgctcctatcaattttcttagttggaaagacatgcctaaggactatattactgacatggttgaatcaattcaggtctggtataaaactttataa

SEQ ID NO: 56852 - DNA, 639 bp, Glycine max
  Peptide Sequence Number=SeqID_148537
atgttggtggacttattgatggtctttacagaggctgccaaggctgagacagggcagtgtcgtggaccgtacgtacgcctgcaatgggtacgtgatatatacgagcgccgatgccaagaaggtcattggacagctgcggttcacgcatatcttcttcatcttctgggttgcactctgtttgctaacaagagtgcaaccaatgtccatgttgtgtatttggaggcccttcgtggccttagtcagaccgggaggtacacctggggagtggctgctctggtgcatatgtacgaccagctgaatgatgctctatcagcagcagccgacagcttggcgtgctggatttacgagcactttccctcagtcgcggagtccactgctgatcaggactacgacgaggattccccgcatgctcgtaggtggattgcgacgaagaagattgtgaagagcataaagagggtcgtgcggcaatttggatgcacccagaccattcttgctccgcccgttgattcatgggtgttgtatgatgatatacacgacaggtggatgcactactcggatcatatgcttccagcaggtgaggtgtgcgctgtgccagcgactacatggactggttcttccgcatctcccatcctttcatga

SEQ ID NO: 56853 - DNA, 135 bp, Glycine max
  Peptide Sequence Number=SeqID_148538
ggtaggttgcgacagttggtgactccactggggattgtgatgcaatcctaccccgcaagggcattggatagaaacctccaagtagattgggccagatatgcaagagaaggccctagggttcttatgagccttagg

SEQ ID NO: 56854 - DNA, 243 bp, Glycine max
  Peptide Sequence Number=SeqID_148539
atgcaacagggacaggcaaatatcctcatagctaggttccctgaccctaactatggtgttaaaacgggttcctctcggtgtgggttttcaatggagaacaatgatggtttgtggtggctaatggtggatgtgggtgatggagaaagtacttggaactttagaaatggatttggaagaaagaaagaagaagaaatggcatttttcctaagctacaagaaagcaaaggctgaaatgcttaaataa

SEQ ID NO: 56855 - DNA, 264 bp, Glycine max
  Peptide Sequence Number=SeqID_148540
atgatccaagagctggtagcccgcggagataccttacggttatccgcacctcgtcattcagtgaccccaagtgtgattgatgagcagaggccaatgtggtcatctgcgccctttccggagatgtcagcatcttccagtggagactttctcaagtctcacaagttatctagaactacaggcggcgggcccgatgacacgcagagataccttacggttatctgcacccttgtgtcatccagaggcggcgggcccgatgatacgtga

SEQ ID NO: 56856 - DNA, 228 bp, Glycine max
  Peptide Sequence Number=SeqID_148541
atggtggtcacagctcgaccggagagggtggtatctgcggattacatggagtggtttttccgcatatcacacccattcatgataccgacccaggcaggtgaccaaccgagagatgcaccagctactgaccttgaggactacatacagctgcccaacccccaggttccagtagcatttgacccccctccacatgtggatgattacgagggatatgaggcgattgcatag

SEQ ID NO: 56857 - DNA, 358 bp, Glycine max
  Peptide Sequence Number=SeqID_148542
aggattgcgcgtcctcaccttcgtagggctacaggcccttacctttaaagggctacacgccctcgccatcagaggactacacgtcctcacctttgtagggctagacgccctcaccatcagagggcttcacgccctcaccatcagaggattgcatgtcctcaccatcagaggactgcatgtcctcaccttcagagggctgcacgtcctcaccctcagaggattgcacgtcctcaccctcagaggactgcatgccctcaccttcagaggactacacgtcctcaccttcagaggactacacgtcctcacatcagaggactacacgtcctcaccttcagaggactacgcgtcctcaccttag

SEQ ID NO: 56858 - DNA, 360 bp, Glycine max
  Peptide Sequence Number=SeqID_148543
atgcgtggggtgctaataccttccccgtgcgtaaatacaactcccgaacctttcacacttaaaaatcgtagaccacaccttttccggtttttccgacattttcctcgaataaatgttggtggcgactacgtgcgttttcctcccttggaagacgcacccgtgagccctcgcgtcgccctccctccgaagggaaggccaattggtgttagggaacaaattcatgatgcatcccttgacatttgtgagactcctcgttttcgcacaaaaatgccttcaatatgtgaacaagcagaggtggatggcgtacatgcaattcgtcaaaatcatggtgaaggtttatgggagaacaatgctctttaa

SEQ ID NO: 56859 - DNA, 348 bp, Glycine max
  Peptide Sequence Number=SeqID_148544
atgatcaacctagtagaagttgcagttcttcactgcccaagcagtccgataagtgccctagagagcatcaatattcaagcctggcaatttatccaatctttcctgcttgagctaaggcagccccaatgcttctctaataattctcttgattgcatcacacggtataagctcaaaatttctgggcctgtccaatgtggtcctggggatggtatgggggtggtaccctgtgtaccagccccgtactcttttaagcagggcaatgcaaaagcctcttgtgcatctgttgcattaaaatgggtcaaactcctgacctcacttcaacaattgcagtttgaagggatactctaa

SEQ ID NO: 56860 - DNA, 387 bp, Glycine max
  Peptide Sequence Number=SeqID_148545
atggtgttaatttcgagtgctccagtggcgtatcatggtttctatcagctgttccctcctgttcagctactgacggggaatggtgttatccgctccaattcggcacacaagcataccagccggagcatagcggcgccgctttccattcgaaccatgtcaggctgcgcaactgcattaatgggaatcggccaacgcgatcggtgcgggccgggtgtcccagtcgacagtgcttcatgtggcagaaaaaacgacggccagtcagaatatgtgaatacaggactcactataggttccgcttcctcgctcactgagctcctacctcgcgtcgatggcggcgagcgctcagaactagtggcttaccccaacggggcggagatttccggatag

SEQ ID NO: 56861 - DNA, 882 bp, Glycine max
  Peptide Sequence Number=SeqID_148546
atggccaagttcgatccagagatagtcctcgaattttatgccaatgcttggcctacagaggaaggcgtccaagatatgaggtcctgggtgagggtgctggaagagggtcaggagtgcgaatatggccagaggaggaaccggtccgatgggttcgatgaggaggccatcgcccagttgctgtgtataccggggcaggattttgcccggactgctgccgggagacgggtgtggatcatgcgcaccaagatgaccaccctgactcagatatggatgactttgctgctcagcaacatcctgcccagcgatcataattccgaactccccctgccgaagtgtcagctggtgtacgccatcctgacacggatgagcattcatgtggctcagttaatcatgctgatgccatctatatatttgcaggactctgctagtcgtttggagtcccttgtcgcacctagcaaggtgattcggccgcccatcacccgagcttttattgagaagtattgcacgcagagacaggtccagggggatgctccgcaggccgcagacgcgccgccacctaatcaggccggtccagccgaattgtttgatacgaagcagtatttgcggcatttggttcgccagcaggtggccaaccaccgggcacatgtacagacccatgattgtctttaccagatgagcctcagcctgcagagcaagggttttacttcttttccgtgccctactccggaccagttcagggcagaggtcgcatggcctggagattggcctgaggcccgggcaggagaggcatcaacagaggctcccgacgaggcagatgaggcccgcgaggacgaggagatgaccgatttacttgatttcttaggaggaagcggggccacatga

SEQ ID NO: 56862 - DNA, 408 bp, Glycine max
  Peptide Sequence Number=SeqID_148547
atggcaggagctggtgacaatggtggtgtatatcatcaactggacggatctcaacgcttattattggacccgatgactatacaaatgcaacgtttgttgaaccgtaacaaagaagagctctacatgcgaatagtcaaatcttccttatttactcttaaacctctatctcctagagaagtgtgtgatgcccaaatcagaatgagagaaaagagagaacaagagaaagaaaatagtgaggcaccacagaggaataggaaaaagaagagtgatacacccgagggaaagagtgatacacataagagagagagtgatacacatgagagaaaatttaattattttgcagaggctagtgaagtgaggaaagtgttgcctgctcatgaaccactatatctacagtatgcaaagaca

SEQ ID NO: 56863 - DNA, 675 bp, Glycine max
  Peptide Sequence Number=SeqID_148548
gtggacccttgggtactagtacctatcttcttcagaggacttcacgtcctcgcctttagagggctgcatgtcctcgccttcagagggctacacaccctcgcctttagagggctgcacgccctcgcattcagaggactagacgtcctcgcattcagaggcatgcatgccctcaccttcaaagggcgacacgtcctcaacgtcagaggcatgcacaccctcaccttcaaagggcgacacatcctcaacttcagagtgctgcacgccctcgcctttagagggctacgcgtcctcgccttcattcctaggccaccccctgatcctggaggagggccaactatgcaagtacaactagaggaggaggctatcgtgcagctactatgcatactggggcaagatttcacccgtgtcgctgcaaagagacgagtgcggatcatgcgcaccaacatgaccattcttacacagatatggatgacattgctacttagcaacattctatccagcgaccgcaataccaatctccccctgcagaagtatcagttgggatcgtgcccacaaggcacccagtggacccgaaggagtccgacagggccctggggttttcagctctggttacgggcctctgtcagtcctatagggtgcccgtccccccagcaaggtcacgccatcatgacatag

SEQ ID NO: 56864 - DNA, 480 bp, Glycine max
  Peptide Sequence Number=SeqID_148549
atggcgcctaccaggcaccctttggatccagataagtccaacagggccctgggatttcctacactgatcacaagactctgccagtcgttcggagtccccgttgcacctaccaaggtgattcggccgcctatcacccgggcttttattgagaagtactgtacccagagacaggctcaaggtgatgctccacaggccgcaggcacgccaccaccacctcatcaggctggccaggctggggcatttgacatggagcagtatttacggcatttgttgagcctcagcatgcagagccagggcttcgcttctttttcatgccctaatccagaccagttcaaggccgaggtcgcatggcccggagattggcccgaggcccaagcaggagaggcacccccagaagctcccggcggtggagaagaggcccacgaggacgaggagatggccgatttgcttgacttcttgggagggagtggagatacatga

SEQ ID NO: 56865 - DNA, 216 bp, Glycine max
  Peptide Sequence Number=SeqID_148550
atgaatattgatgaacaagattccaaaggaaatgataaaggaaacaagaagagtcctccagaagaagtaaaatccaatgatgaacttccaagagcatggaaagcttcaagagatcatcccctcgacaacattattggtgatatctcaaaaggggtaacaactagacattctcttaaagatttatgcaataatatggacttttgtatctatgattga

SEQ ID NO: 56866 - DNA, 458 bp, Glycine max
  Peptide Sequence Number=SeqID_148551
atggttagactattaccacttcaagatagtctaacatcatataccccatccccgtcttctatgtctatcccagttaggcctcccgatgttgcacatacaccatctccacctccgattgaagctagaccatcttcatctcatgttaatgcacgtggaccatctctggtacctgcatccacaccatctccatcctccattgatgcatgtggaccgtccccaatacctacatccacaccttccccatcttcgcctatgggcaacatgcctatagatgaagctgttgtaaatttggcgatggaagacccctctcttaataattgtcctatggttacgtttcgtccatctaaggttgtggcaaaggctgtcactttgtccattaggcaacaatttggtcagccttggcctacatggggagcgattccaaaagaacatcaaaaacttttttttagtgttttaag

SEQ ID NO: 56867 - DNA, 450 bp, Glycine max
  Peptide Sequence Number=SeqID_148552
atggaaacctgtcccgcggtagaagaattgcttcagcggctcatggattgcgggcagcttgaagtgtccataggagggggaaagaaccacaaatttgcatgcagtcggaagagaagaaggttcctcctaacccccaaggccctagtgatatgttttactaggaaagggatcggctccacacccatataccctcggacgacacccaagccaacaccatttgcatatcaaagtaataaggccgttccgtggaagtatacccctcccgcgtccagcgaaaaagttgcaaccgaagttgactccctatcagctaaggtaaccaacatcaccggcctcagtggcgtaacccgcagtggtcgggtgttcgcttcccctcacccggcggaattgccctctaaagggaaagcgcccatggtccaagagcccacagatgtagccaccccctcgaaagaa

SEQ ID NO: 56868 - DNA, 204 bp, Glycine max
  Peptide Sequence Number=SeqID_148553
atgctgacatctccggaaagggcgcagatgaccatattggtctctgcttatcaatcacacttggggattgacgaggtgcggataaccgtaaggtgtctccgcgggctaccagctcttggtcatggcaacagaaagcggtgtcggtcgacaaaagcgaggcttttgctcctacgtatcctccatgaggaactcatacctacgtag

SEQ ID NO: 56869 - DNA, 1148 bp, Glycine max
  Peptide Sequence Number=SeqID_148554
agatcttagagttaaccatagcagaggtgtccatagaagccattgcatcacttacccaatactacgaccagcccttgagatgcttcacattcggggacttccaattggtaccaaccattgaagaatttgaggaaattctaggatgtcctctcgggggaaggaaaccctatctttcctccgggtgtctcccctctttgagcagaattgcaactgtggtcaaggattcagccagaggtttggaccgcataaaacagactcggaacggcatagcgggcctgccacagaagtacctagaagacaaggcgaagggtatggccaatcaaggagactgggtcccgtttatggatgtgttagctttgctaatttttggggtcgtcctctttccaaacgtggatggtttgatagacctagcggcaatcgacgctttcattgcctaccaccatagcaaggaaagtccggtggtagctgtcttggcggatctatttgacacatttgaccgaaggggcgaaaagagtagcgcacggatcatctgttgcttacccgccctctgtgtttggagaatagattgggaccagctcttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccttgtgagggatttcggcgcacaaaattccaagactatacaaagaatccataaggcgtgggaaaccccgttaaagaaagatcaagagcttagaggcattcgtaatggcatcattggtgggtaccacgaatggctgaaagttcatataggaggtttagattggctcgccaagttaaaagtcgtcagcaaagagagttttgaagcaccggaagaggacgaagaagtccaaactctcaaaagcgagttaggaaaggcaaaacttgccaaggagaagttcaagttggccgctacacacgttcggaaggagtgtgccgggttacgggaagagaatgcaattactgcaagagcccttgaacaagagacctaa

SEQ ID NO: 56870 - DNA, 564 bp, Glycine max
  Peptide Sequence Number=SeqID_148555
atggcttcccgtaagagaaaagccacaacttcagtgtcccaagctagatgcctgagatcgatacgcaaacaatgtgcttggccaaaagatcctttcggaaaggaatgtgaaacttttgatgttgactccctcaacaccttcttgcatacaccagtggtcttagagcaaggggagagcttgcccgcttactccaggttttgtaggttgaggtcagatcctcaagagttggtagcccggttatgtatccctgggaggggatttgagcttaatgtcgatggcttgcctctaaagatcttaaggaagaatcttactactctggcccaggcctggagtgttttatctttctctaacctagccccgacatcccacacttttgatattactttggacagggctaagttgatctatgggcttatcatgaagatggatatgaacctaggatccctaatcttaggtcagatttctcttattgcccagcatgactcctcgaggctaggttttccagctcttatcactgccctgtgcaaggcccgaggagtccacatcagattctctgacccttga

SEQ ID NO: 56871 - DNA, 198 bp, Glycine max
  Peptide Sequence Number=SeqID_148556
ggggaggaggttgccgcccagctcgcccaggcgaccttagctcgcccaggcgagctgggcggcaacctcctccccctttttcctataaaaaggctgaagggggctgttctaaggatccctgagccccttggctatcaaatccgtgaaggttcttcgacgttcttcattcgttcttcatcgttcttcgatcttcaacgg

SEQ ID NO: 56872 - DNA, 726 bp, Glycine max
  Peptide Sequence Number=SeqID_148557
atggcttctccacctgcctcccctcctcctcctcctcctgctccttctgacgcatcggcttcgccgtctgccatgaagcggacacacaaagcctcacgtctacgatccttgtctactagaccacctggtgctgagagaccagtggtccatgttgatcctgctatcggcaaggccgatggtccccataggaagaaattaagaacatacttgggaattgtggcacgtgataaggtggacgtcacctacgagaactggaaggaggtccctactcctcagaaggacctgatttgggaggatattaagaggcttctaacagtaggacgaaaaggaagttacttcagaccatgggcgagagatggagccgatctggacggtgtggaggacactgtctgtgagaaatacggcatcaggaaggaaaaatgggcccagttttgccagactcgcagagacccttcttgggaggatgtgcgcaaaaaggcacaggccatccagaagcagaacactaccccgcacgttttgtctcgtgggggttatgactatttggagcagaagctcctggctgagaagaccaagaagaagctggaggaagttgcacagacaggaagcgttgatggcatcatcgaccctccatccccggtgagatgccacgtgaagtggaagatggcccgcacgaagaaatcaggggacatgacgactgaggccgcaaaggaaatcgttgcgaagatc

SEQ ID NO: 56873 - DNA, 711 bp, Glycine max
  Peptide Sequence Number=SeqID_148558
atggaggtgtcccatgtgcaagttcaggacatatctgaagaggattacaacgaacaaatgaaggttgtgtatcctcaggctgaggaggagttaattgatttcttgaacagatgcaaactcgaaaacaagattgtgatgctctgccctcgctgcagtgcaatatgtgataaggagctactgagggcctcaagaaataccaagttgttaacaagggggcaaagcaggaccaacgtttcgataaagaaatctggtcgaaggaatactttcgctcctcctggttcagttccggtcgaaaaatggatgcaccagggactcataaggttcaacaaagggatcatggaagtaggtggttcgagtggaacgaagcaagttggcccacaagaggctaataagtactcttataggaacaattacaaaggaaagaatcctatgacgaggacccaatggcgcaggttccagcgtcagaagaaattggcccaacagaatctacaaacgggccagtataaagaagtatctaggaggccggtaaaggagagactcctgcctccagtggatgaagacaagatggaggatgaggatctactggattctgagccagatttcgatgtcatctgtgtggtatctatcttgccatctgaatatgatgtccaatctgaagttactgagatcgaaagtgagttcgatcattttgatatggctgacccaaagcca

SEQ ID NO: 56874 - DNA, 1503 bp, Glycine max
  Peptide Sequence Number=SeqID_148559
atgactaccccactgctgatcgcccagacgcctgaccttcaactgcatctgctgcccgccatggctaaccgtcacggactgataaccggcgcgaccggcaccggtaaaaccgtgacgctgcaaaagctggcagaatccttctccgccatcggcgtgccggtgtttatggccgatgtcaaaggcgatctttccggcattgcggccgcaggcgacggctcggaaaagctgctggcgcggctggcgaagattggcgtcaccgactggcaggcgcagaaaaatccggtgatgctgtgggatatcttcggccagcagggccatccggtgcgcgcaacggtgtccgatctcggcccgctgctgctggcgcggctgctcagccttaacgaggtgcagtccggcgtgctgcaaattatcttccgtatcgccgacgatcagggcctgctgttgctggacttcaaagatttgcgcgccatgacgcaatatatcggtgacaacgccaaagcatttcagacgcagtacggcaatatcagcagcgcctcggtgggcgccattcagcgcggcctgctggcgctggagcagcaaggggcagaacacttctttggtgaaccgatgctggatatccgtgactggatgcgctgcgacgctgacggcaaaggcttcatcaatatcctggcggcggaaaagctttatcagcagccgaaactctacgccaccagcctgctgtggctgctggcggaactgtatgaacagctgccggaagccggcgatctggaaaaaccaaagatggtgttcttctttgacgaagcgcatctgctgtttaacgacgcgccgccggtgttgctggagaaagtggaacaggtgattcgcctgattcgctcgaaaggcgttggcgtgtactttgtcacgcagaatccggcggacataccggataatgtgctcggtcagctgggtaaccgcgtgcagcatgcgctgcgtgccttcacgccgaaagaccagaaagcggtgaaaagcgccgccgaaacgatgcgcgccaacccggcgttcaataccgtggaggcgattcaggcgctgggcaccggcgaggcgctgatctctttcctcgatgagaaaggcagtccgtcgatggtgcagcgcgccatggtgatcgcgccgggctcgcgcatggggccggccactcctgatgaacgcaacagcctgatcaaccattcgccgctgtacggcaaatacgacagtgccgtcgatcgcgaatcggcgttcgaaatgttgcagcaaggcgtacaggccgcgccgcagcaggccgatgcgccgcccggcaaaggcaatagcgtggcggtggatgacggcattctgggcgggctgaaagagattctgttcggcagcaccgggccgcgcggcggcaagcgcgacggcgtggtacagagcgtggcgaaaagcgcggcgcgccaggtgaccaatcagatcatccgcggcgtgctgggcagtctgctcggtggacgccgccgttaa

SEQ ID NO: 56875 - DNA, 621 bp, Glycine max
  Peptide Sequence Number=SeqID_148560
atgatcttaaaagaagagttagtcgcttgcgcaaggtccaaaaggagtttggctcaacacttggaagccacggagcaaagcatgctagctatcatagggcagtacaaggaagagttgaaccagtctgtgacccatgaacaaaagctagtggaggattttgcacaagtgtacgccgaaaaagaagcaagagggagggtgattgatgcattgcatcaagaagcgactatgtggatggatagattcgccttgaccttgaatggaagtcaagacctcccgcgtctattagccaaagcaaaagccatggccgaaaggataaagccacggcaaccgcctccagtacagttaggggaagcggagccggtgctgcagcccgtcttaaatccgggccgagacagaaacacagcagtgtttggtcgaaggtatagtccgcaagcttacccctatggcttgcctccggacttcactcctcgtgtcaccccggaagatttaagccaagcccctactttcgaggggcaactcccaccttatgacgactatcccaagcaagacgatgaggaaggagatacccatctcggccccctgctccacctcaaagatccgtccccccatgaactaccctaa

SEQ ID NO: 56876 - DNA, 500 bp, Glycine max
  Peptide Sequence Number=SeqID_148561
atggctttgcagttagctgacagaactatgaagcatccttatggcattgttgaagatgtattcgtaaggctgacaaatttctctttcgagttgactttgtgggtgcaagatgatgaagtgcagtttaatgtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccc

SEQ ID NO: 56877 - DNA, 345 bp, Glycine max
  Peptide Sequence Number=SeqID_148562
atgcagtcggcggatgaagaaggacctaaaaagcctaaacccttagtaatacacttcaccagggacatgactccccaaagacctcaacaccccttggcagtgtcgggcggtagatctgttccgtatccttacgagaacagtcgtgcagttccgtggaggtatgcccctcccagcggtaggaaggaagaagctaccgatatcagctcactatcggccaaagtgaccaatatcaccgggctgagtggcataacctgcagcggtcgcgtgttcgtaccccctagcctgccgatacagcccgcaatcactaaagggaaagcaaggatggccgaaggaaaaaatgtcaag

SEQ ID NO: 56878 - DNA, 130 bp, Glycine max
  Peptide Sequence Number=SeqID_148563
ggtatgagatgaggaaatcacgatttgaggctaagttgctcgctatgcaagcagagtttccacaagcaacatattggttggatcaaattcctaagagtaaatggactcaggcctacgatgaaggaaaacg

SEQ ID NO: 56879 - DNA, 612 bp, Glycine max
  Peptide Sequence Number=SeqID_148564
atgactactccacccaactctcctcatcctcctcctcctcctactgatgcaacatcacaatcgctatctagcttgaagcggacaagaaaagccacacaactaagatcattggtgactagaccagctggggcagagagactcgtggtccatgtcaatcctgcgaccaagaaggccgacggtcctcacaaaaagaagttaaaaacatatttggggatcatcactcgtgataaggtcgatgtgacatacgagaattggaagcaagtccctactgctcagaagcatttgatatggcaggatattcaggatatgcggaaaaatgcactggccatccagaagcaaagcactgccccccatgtgttaacaccccagtcgtgtgcatgctgctggaactggtgtgacgatcaagcaatactttggaccggttccaaggtcctctcgcacatcttcctccatggatccctaagacttggagtagctgactcaacaaatcagggactagttggaggagttgatcacagaaaaactgacttgatagctaatgttatccttcaaccatatgcaatcccagtttcagttacagatgcaatcacagggacttgcactacctcctga

SEQ ID NO: 56880 - DNA, 215 bp, Glycine max
  Peptide Sequence Number=SeqID_148565
catcccatgatgttgccgaggtgaggaacgttgttgacgtaagggtcggcactggggatgagaatgttgcgcttccttcgacgggaagcttcgtctctttcaaattctcttccattggaaaagaatttgattgcgttggctggagagatgaagccgttgcaccgacgctgagattgagaaatggagggatttggggtttagggtttagagtttag

SEQ ID NO: 56881 - DNA, 429 bp, Glycine max
  Peptide Sequence Number=SeqID_148566
atgaagacaaaagctcgcagcagaatcactgacaatatagtaagtgaaactgagcaagaggctccataccaagatgatgagcttatggcagacagaggtagaggtggtggtcgtagaacatttaattgtggtagaagacatggtcttagtttgggagctccaattaccaccaacccttccacctcatccattcacatatcaaccttagagttaatgattcatgtcgttgcaccgactccaaacacacttcctacagctcaagaccaaccaaatactacctttgtaagggagtcaattcccattacccctattacagatgcttcaccttcagcaccaaatgattctcttacacctgagtacccaccagatccaaattgtgaacatattgttgatcagaggcctttcattcgtgcatataaagaagagtaa

SEQ ID NO: 56882 - DNA, 219 bp, Glycine max
  Peptide Sequence Number=SeqID_148567
aaccatctacagatgtattgttggaagatgggggcatacgcaagaggaaatcagcctatttgtggaaaacgtcagaaaaaccgaaggaaccggtcatgaagaatattccagattcaggagttgtattttcgtttgaggaaggtattagcacctctcacgtcgacaaaagcggggctcttgctcctacgttccctccatcgaagaggaaatcagacctac

SEQ ID NO: 56883 - DNA, 153 bp, Glycine max
  Peptide Sequence Number=SeqID_148568
atgactcctgttcttgataactcacttttcacactaaatcggcaaagcttaaaggcatgtaacccaccatcttctcacagtagaacaccgctgcattctattcgaagccatatcagaattatactgatactgcctaatgaagacaaccattag

SEQ ID NO: 56884 - DNA, 377 bp, Glycine max
  Peptide Sequence Number=SeqID_148569
atggtacgaacccaggctgccgggaaaggaggaacgtgccgtcaaagatttcgggcggatagggtatggcccggccgtattagccagtgtttcaccagtgctggaatagtgtctgaggaggaggtggccgcaatagaagaggagttccctcaaaacccaccaagttttgtgcaaccatgccaccccgattcccaagtggggaactggcgcgtgataaaccagtcagaaatctataccgcagattcaatatgtgagggtcgattctttgaggaacctagcaacgagggtttgtcaatcgatttcgatcgagatataagccaaacgataaacgaggaagaggaagaggaagaggacgtcctgtcaccagagttggagag

SEQ ID NO: 56885 - DNA, 291 bp, Glycine max
  Peptide Sequence Number=SeqID_148570
atggtgaaagttggaacctcttacgtgccgatcaacgtctcattttcgccaaaagttggcccagggcttcccggtatcaacagggacatccaggatttatttatgaggacgcgaatgtgttcggtcacagctgtccctcctgttcagctactgacgggaatggctgaacgcaactgttgggaagggcgatcggtgcgggcctttgctattacgccagctggcgaaagggggatgtgctgcaaggcgattaagttgggtaacgccagggtgttcccagtcacgacgttgtaa

SEQ ID NO: 56886 - DNA, 938 bp, Glycine max
  Peptide Sequence Number=SeqID_148571
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgtccgaggctgtgctacggatgaaatatgggcgatgaaagaatataaagtggactcgtcctggactaagtccattgttatccctaacaatgggttttccccaatatgcatcaccaaagatggtggaattattggatcaaaggaagtggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 56887 - DNA, 723 bp, Glycine max
  Peptide Sequence Number=SeqID_148572
atgaaccagattcttaacgccacttaccgctacaccgatgacccgcgccgcggctacagcggcaccagtccgcaggcgcgcaacggcttcgcggaaatcgctattgacggccagccgccgtacaccgtcaaggtcgacgcagagggccgctggagctggacgccgcccgccgactggacgccaggcgaacacatcgtgtcggtgcgcatgattgacgccgccggcaacatcggtgaccccgctcagttcattcaggtggtcgactacacggcgccggacgcgccgcgcctgctcaatatgtacgatgaccagggcgacatcaccggcagcttcgacgccggacgcatgaccgacgaccgtcgcccgaccctgaccggcgtcgccgaaaagggcaccgtggtatacctgaaagagggcgatacggtgatcggcagcgcgcaggccgacgccaaaaccggcatctggacgctggagccggacgccgacctgagcgacggcacccaccagctgacgctggtggcggttgaaacctttaacggcaagctgcgtgagggtgaaccgtctgaaccgttcgaactgctgattggccgcgacgggtctgccgccacggtgatttcccacgcggtggatgatgccggcccggtcactggctcgctgctgagcggcgcgctcaccgacgacgctacgccgcaactgcacggcagcgccccggcgggcagcacg

SEQ ID NO: 56888 - DNA, 789 bp, Glycine max
  Peptide Sequence Number=SeqID_148573
tcggagtaccaaggaagtgtttggaggaaagggcaaaggacttggcaaatcaaggtgaatgggctttcttttattgacatcttggcgcttttgatctttggagttgtcctctttccgaatatggaagggttagtggacctagcagtgattgacgctttcctcgcctttcatcatggcaaggaaagcccggtcgtcgccattttggccaagtatgacacgttcaaccggagatgtgaaaagagtgacacaagaattttttttgttgtgcactggctctctatgtgtggctggtttcacacccttttctccaagaaggtaggcctgtctatccgctacaaggaaggaagaatcaggattctatcttcatgcgaaggatgtccaaatgttcccttgatgggaacaaggggttgtattaattataatcccgtcctcgccataagacagcttggctaccccatgagaggagtgccatcagacgaaagcatcacgcctttcatcgcacgggtttcagtgaccacaacgcgagggtactccaaggagttcgcaaggcatgggatgcggcgtgaagaaaggacagagagcttaggggaagcaactgtgagagacgataaggttaaagcttcggaagaaagtgatgaggtacaagccctaaaggcaaagcttgaaagagctcgggtagttaaagagaagttcaaggcagcaatagtgagctcaagctccgaagaggtgaaaggaatcatcacgggtcaaaggcatgatcttgaagaacgagctaaaggcttgccttag

SEQ ID NO: 56889 - DNA, 429 bp, Glycine max
  Peptide Sequence Number=SeqID_148574
atggtggaagaatttgaagagatcctaggatgtcctctagggggaaggagaccataccctttctcagggttctatccctcattagctagaatttctaagatagtccaaatctcagcgcaggaattagaccacagaaagcaagtcgaaaatggggtggttggaatacagagaaaatgtttggaggcaaaagcaagaatcttggcagaaatcgacgcttttctcacctatcatgaccacaaggaaagctcggttgtcgctatgctagccgacttatatgacaccttcgaccgaagatgtgagaagagcagtacgaggattgtttgttgtacttcatctctttatgtatggttggtttcacacctttttcgccaagaggtgaggcatgcttgcctgatagaaagccacctttttcgtcaagaacttccctga

SEQ ID NO: 56890 - DNA, 393 bp, Glycine max
  Peptide Sequence Number=SeqID_148575
atgaaggaaaatagagcgaaattggccgtattatctatgaggatgtcgatgtgtggtaaaggaaaattatccttggggactggcccgattcaggtcccgataatccacacacattcgtactttcccatccttcttagggatcggtacaatgttggcgacccatttctgggtaccgagcgacggccagaaaaccagcgtcaaattgcttcttcacttcttctttttatctttcaaagatgtttcgggcttcatccttctcagtttctgctttacccggggaacactcgggatttagaggtaaatccggtgttgtacaatgtcagaactcaaaccgggcatatcttggtacgaccaagcaaagatgtcttggtagtctctcagcagggttattaa

SEQ ID NO: 56891 - DNA, 571 bp, Glycine max
  Peptide Sequence Number=SeqID_148576
cgtcggcgcgagctgggtcgaggcccaggtcaatgccgtctcggtgccgttcatcgatacgccgtacgggcagggcgaaccggcgctggagttcgagtattcggacgcggcgaaagcgctgccggtttatcgccgtggcgaaaacgaagccgcatttttcgcccgctgggacgatcgggacgccgagtttgcgctggtcgatgcggaatacgcggtattgctggtgccgaaaatcattaaaccggcgctgaagtcgctgggcgaagcgaaaaacatcgacgggctgatcgcctactatgaccgcattttcaccttctacaatgcgctgaccggcgtctcgttcgaggccgaacacgaatccgatcgcaatattcgcaaccgctactttatgaaggccgataaacacggcgccggcgccgcgtattacggcgggcgctggacggcggaaaccagcaactcggtcagcagcttctggctgacgccgaaagacagcaactggggcagcctgcatgagattgcgcacggctatcaggggcactttatgggcgacaaatattttctccaccggtga

SEQ ID NO: 56892 - DNA, 633 bp, Glycine max
  Peptide Sequence Number=SeqID_148577
atggtcattgaccagtcccttttccatgacttaaccaaattacccagtgacggtgtaccatttgaaggtacactgaatgacgactggaaatttgatttctctgcccatgatgcccgccagttggtttgcaccaacaatgcggatatgaccggacgtcttcttgccgggtcattggcttttgaaagccgcatccttcactatttaattgtgcgtattttgcttccacggtcttccaaccttgcccagcttgtcactctctttttccgccattttcaaattcctcttgattctgaaccttatgttccaatcaagcgatcttttttaattggtgctgttgtgattgcttcttttggttaccgcaaagagcgtgatggctcttgggtcaaaaagggtgttccacctgctgatgatgaaggccacataccagttgaagataattccactcttcttcaaaggcttatggacaagtttgatggacttcagacttttgttggtgacaagtttgatgccatggaattgcaagttgacatgcggttcgatgctatggaatcaaggatcactagggttgaagaagatgtctccttcatccgaacttgctttgatccaccaccaccgcctccttcatcctcttag

SEQ ID NO: 56893 - DNA, 207 bp, Glycine max
  Peptide Sequence Number=SeqID_148578
gcaatggtgcgcgtaacatgtttagcaaccatgttagcttcagtgcggctcctttacgtgcattttcgggagggacttcctctagtaactcgtggcataactcatcccaatgcctccatcgttcaaccaatgcagtgatcaatgcaggatcaattttacactgtttgattaaggcaatatgttggaacccggtagacgataataatg

SEQ ID NO: 56894 - DNA, 249 bp, Glycine max
  Peptide Sequence Number=SeqID_148579
atggaattattaagattctacaccattttacatgaagaaaatgacaagaaaaagaatggaattgctcttaaagcctcatcttcaatccaagaagaatgtgataaggaaaatgatctagatgaagatgatgatctaagcctttttgtaaaaagattcaacaagtttctcaaagtaagaggaaatcaaaggcgacccaattttaaatctaaaagaaggataaacttcttcctctactccaaagtgctttga

SEQ ID NO: 56895 - DNA, 408 bp, Glycine max
  Peptide Sequence Number=SeqID_148580
atgggtaaagcggaggaggtacaagagaagatgaaggccgacatgaaggccatgaaagagcaaatggccacgatgatggaggccatgatgagcatgaggaagataatggaagccaatgcagttgcagttgccgccaccagggctgtttctaaggtgaacccgatgcccccatctgatctcaaccaaatgaaccatccaacctcagatatggcgggcaaagatttgggaagtacaggcggcccccatgatgtgcaaattcaaaatgagcacgccttcccgacatatggtttgcctctcaactatacgccacctaatgtggcgtacactcccaataagaatgtcaattactccactcatatacccattgagagccaacaaccccaaactgatcatgcacatgtctcttaa

SEQ ID NO: 56896 - DNA, 101 bp, Glycine max
  Peptide Sequence Number=SeqID_148581
ttctatttctcgatggaggcaagggatataactcagcggtagagtgtcaccttgacgtggtggaagttatcagttcgagcctgattatcaataaaaccaat

SEQ ID NO: 56897 - DNA, 720 bp, Glycine max
  Peptide Sequence Number=SeqID_148582
atggcatgtattgttgacaagataaaaaccatcgacggatctaaagaaactctaaaacttgctataaggataaccgatctctggtttgttgggacaccgggtaggtctgaacaagctgagatgatcattgttgactctgacagtgatcagatccacgtggtctataagcaagaccagttaaagtcatggaaaatggatttgaaggaaggttgtgatttttcagatatcattgctggccaattacagtttgacctattagtagacatcattggtgttgttgacgaggttgtctttcatcagatttcacctagaagtaagagagttgtttttaagcttatgaatttgagtaacgaattggtgttgtgcactctatgggacgattattgtgtccaatttatggaatgtttggatcagcatgagaatgaagggcctcttattatgttgttgaccaatgccagaattaaagagggccagggatcctatccatgctcgattagcaattctttgaaggcttctaaactgactattaatgagccactgacaccaattgaagaattcaatcagaagctttcagaattgggcattgagatccggtcagttttgacacgtcattcccagtggagttcacagccttcaggttctgttcagttatcatcaagggagacattcatttccaagtcagaggcaaagagcatttatgagataaacaacctttgtgaa

SEQ ID NO: 56898 - DNA, 276 bp, Glycine max
  Peptide Sequence Number=SeqID_148583
atgacagtatgcatactggggcaagatttcacccgtgccgctgcaaaaagacgagtgcggatcatgcgcaccaatatgaccactcttacatggatatggatgacgttgttatttagcaacattctgcccagcgactacaatgccaatctccccctgcagatggatcgcgcccacaagacgcccagtggacccaaagaagtccaacagggccctggggtttacagctctggttgcgggcctctgtcagtcctacagggtgcccgttcccccagcgag

SEQ ID NO: 56899 - DNA, 900 bp, Glycine max
  Peptide Sequence Number=SeqID_148584
gggaaaggaaaacctttccatttggggtcaagtgtggccagtgcaaagtatgcaaatgcgcaatggatgacacgtcgattaaggattctagcatggacaacatgtggtcatggccacatagggctattgtgcccgagatgtggggccattgggcttgtgagggagaagaagtcttcgtgtatgaactctcctcaaagattggatgatcacatagagtggtatttgggaaatgatcgtatggagggaccatccttgggcgtatggcaccaagttgtggctttgagtcacaccccaacttggcaaccccaactaaatgtgagacattatcttgttggtgagagcttgccattgtatcatggtgagggattgaatggagtggctacgttaagcactaccactgaagatggacttgcttatggaagaagaaccttccgaggatatctcatgattttagacgagttgcgcagccactctgctgtagtccaagagacggttgcgcgtgagctggaggagcaccacagcaactggacctactcgaagtcaatggtagtgcttgacatgacatggaacatggcattcatagtggtctgggcggtgatgctcgcctacactgtcaaggacaaccctaacatgccgatccactgggacaaggaatttgctaccaacctccaatatgacgatgtcaacgatagcgacaaggacgatgttggaacctctgagagttcctcttcctctagtatgtccacctcatgcagccatacaagaattgcgtgtaactgtccgtgtgctacctcctcaagattgtatgttgatgtgatccttactatgagtggatttcttgatacaggtcatagagtttggatgacgctacttccagggagggaagataagtcagggtag

SEQ ID NO: 56900 - DNA, 528 bp, Glycine max
  Peptide Sequence Number=SeqID_148585
atgactaggggcaatccaggtgatttacaaccctttgatcctgaaatagatagaacctttcgtagattagttaggcatagtgtgcatcctgatcattctgtgcattttgaacattctgagcattcagttgagggtgattctgaatattctaattttgaacattccgctactaatttttatactgagaacatggctcaacctccacctcgtaagaggactctaagggagatggctgcacctgatttcacttatgaaagcttgtgcattcaatatcttgatgagtgtgttccatatgttctcaagactggactaatacatttgctgcccaagttttatggtcttgcaggtgaagatcctcttaagcatcttaaggagttccatattgtttgttccaccatgaagccccctgatgtccaggaagatcatatctttctaaaggcttttcctcattctctggagggagtggcaaaagattggctatactaccttgctcccagttccatttttagctgggatgaccttaaaagg

SEQ ID NO: 56901 - DNA, 424 bp, Glycine max
  Peptide Sequence Number=SeqID_148586
gctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatggaatttggtgatattgttgttcattttaacattcttgtaggcctaggatcttcttcaccaatggattcctttgcttcttggaagatgaatggcagtggaatggagaaggaagagagagaggagacgccacttcaaggagaagatgagtctagaagaaactcaccaccatag

SEQ ID NO: 56902 - DNA, 126 bp, Glycine max
  Peptide Sequence Number=SeqID_148587
atgtctcattttcaagagtttttcaaaggaacaagcaatgacagcttatggtggccaaaggtggtcgtggatggtggaggaggagttgttagggattgggtgggcgtttggagagaaaaagagtga

SEQ ID NO: 56903 - DNA, 378 bp, Glycine max
  Peptide Sequence Number=SeqID_148588
atgaccggccctctcgatgagtcgatctctttatttctcataagggtggacccttgggtactagtacctatcttcttcaaagggctacatgtcctcgccattagaggactacaagtcctcaccttcagaggattacaagtcctcaccttcagaggactgcacgtcctcgccttcagaggactgcacgtcctcgccatcagaaggctgcacgtcctcgtcatcagagggctgcacgtcctgaccttcagaggactgcacgtcctcaccttcagaggactgcccgtcctcaccttcagagggttgcacgccctcaccttcagagggtcatgtatcttcaccttcagaggactacacgtcctcacctccagaggactacat

SEQ ID NO: 56904 - DNA, 489 bp, Glycine max
  Peptide Sequence Number=SeqID_148589
ttaccctcaccgttgagaggactacacgtcctcgccttgagaggactacacgtcctcaccatcagagggctgcacgccctcacctccagaggaccacatgtcctcgccttgagagggctacacgccctcaccttgggtactagttaccctcaccgtgagaggactacacgtcctcgccttgagaggactacatgtcctcaccatcagagggctgcacgccctcacctccagaggactacatgtcctcgccttgagagggctaccgccctcaccttgggactacacgtcctcgccatcagagggctgcacgccctcacctccagaggacctacatgtcctcgccttgagagaggctacacgccctcaccttgggtactagttaccctcaccttgagaggactaaacgtcctcgccttgagaggactacatgtcctcaccatcagagggctgcacgccctccctccagaggactacacgtcctctccttga

SEQ ID NO: 56905 - DNA, 309 bp, Glycine max
  Peptide Sequence Number=SeqID_148590
atggccttcattattggaggggctagcgtgaacgccaccaaagaggatgggccatcgcgggcaaagagtttaggagaggtagctacttccagacgcttcatctaccaatcgctgcaagcggcgtgtatggtctcccgtggcggaggcgaaagggacgagtgtttgtttcacctcggggagtcacacgacatggaaacctgtcccgcggtagaagaattgcttcaacggttcatggattgtgggcagcttgaagtgtccataggagggagggaagaaccacaaatttgcatgcagtcagaagagaagaag

SEQ ID NO: 56906 - DNA, 195 bp, Glycine max
  Peptide Sequence Number=SeqID_148591
atgattgaggatgagtgggagagggtgcagttggatgagtggaggtggattcagatgaggtctgatttaaggcagcagcagagaaaccaggaggaacagagggagctgaaagggaatttggaggaaggtatttgggaaagtgaaggtgtagaggctgaaacaggaggagataggtcaggattgaggctgaaatag

SEQ ID NO: 56907 - DNA, 342 bp, Glycine max
  Peptide Sequence Number=SeqID_148592
atggataagagcttgaaggatgaaaaagatgagtggagggagaggaagagaaggagcacgaaattttgtgcctcaattgagggccttctcttgcatctctggcccaatcttcttggagtcttctatccaatgcccttgaggggtaggattgcatcacacatcccctactactatgaaattgagcttatggacaagcttcaatggcttagacaagggagtatgagtgttgaagtgtctaggcaacagatggaactactccttttgagagttgggcttagggaggaggaaagaacaagtatttctaggttccttagtgggcttaatatggaagtgaaggacaag

SEQ ID NO: 56908 - DNA, 246 bp, Glycine max
  Peptide Sequence Number=SeqID_148593
atgcacaaaaaaagatcttctgcaagtgatttgattcctattgatttggagattaacaccacttgtagaaggcataatcaggagagaattataaattttttgcaggacttagaggcagcagcaattccagaggaagaacctcaatcttctgaggcatcttctagttttccaattgcagaacattctcatttagatcctagtgaagactacatcatggctgaagagcccaagaagagtttactctag

SEQ ID NO: 56909 - DNA, 1089 bp, Glycine max
  Peptide Sequence Number=SeqID_148594
atggaagtctcaccatcagaggactatatgtcctcgccttcagaggactacacgggcgtcggcattagaggacgacacgtgctcaccatcagagggttccacgccctcgccttcagaggactacccgtcctcaccttcagaggactacacgtcctcttattcagaggactacacgtcctattattcagaggactacacaccctcgccttcagaggaatggacattttcaccttcagagggctacacgccctcaccttcagaggactacatgtcctcgccttcagaggacttcatgtcctcaccatcaaaggacaacacgtcctcgtcattagagggttgcacgccctcgtgttaagagagttgcacgcccacgccttcaaagggatacatttcctcacctttagaggactacacgtcctcgccttcagaggattgcacgccctccccagcaggggaggactacacgtcctcccctgcagaggactacacgtgctcccctgcagaggactacacatcctcgacttcagaggactacacgtcctcgccttcagaggaatggacgtcctgaccttaagagggctacacgccctcactttcagaagactatacgtcctccctttcagagggttacacgcccttgcctttagagggctacacgccctcatttcaagaggactacacgtcctcaccttcagagggctacacgccctaaacttcagaggcctacacgtcctcgccatcagagggctgcatgccctcaccatcagaggactacacgtcctcgacatcagaggactacacgtccttgccttcagaggactacacaacctcgccttcagaggactacaagtcctcaccttcagaggactacataggactacacgtcctcgccatcagaggattggacgtcctgaccttaagagggctacacgccctcacattaagaggactggacgtcctaaccttctgagggctacacgccctcacttgcagaggactatacgtcctccctttcagagggcaacaagccctcaccttcagagggctacacgtcctcgccatcagagggctgcatgccctcaccattag

SEQ ID NO: 56910 - DNA, 50 bp, Glycine max
  Peptide Sequence Number=SeqID_148595
atggctagacatgatacatgtcggggtttggtttggctcaaggataacag

SEQ ID NO: 56911 - DNA, 507 bp, Glycine max
  Peptide Sequence Number=SeqID_148596
atgggaacaaatcaaaccggaaaaatattttatcaagtcaagattaagggcctagatgtcaccagccttaaggagttggggcggttgatgggacctctccaaatgcaagccttccgcaaggcgtacggaaagattttagatttgaccatagcagagatattcacggaagttgttgtatcactcacccaatactatgaccagcctttgagatgcttcacgtttggagacttccaattagtaccgactgttgaagaattggaggagattctaggatgtcctcttgggggaagaaaaccgtatcttttctctgggtttcttccctccttgagcaagattgcagatgtgattagggatacggcaagagagttggatcataagtacttggaaggcaaggcaaggaagagcatggccgagacaaattctgtggagctttctggggcagcaatagtgagctcaagcttcgaagggaagagagagaccaatcacgagcacatagcatggtcttga

SEQ ID NO: 56912 - DNA, 598 bp, Glycine max
  Peptide Sequence Number=SeqID_148597
caacatcctgcccaacgatcataattccgacctccctctgccgaagtgtcaactggtgtatgccatcctgacacggatgagcgttcatgtggctcagttgatcgctgatgccatttatctatttgcaggtatgccacctaccaggcaccctctagaaccagataagtctaacagggccctgggttttccggcattgatcacgggtctctgccagtcgttcggggttcctgtcacacctagtaagatgattcgatcgccgatcacccgggctttcatagagaagtactgcacaactagacaggcacagggtggcgacccgcaggccccagacgcaccgtcgccacctcctcaggctgacccagctgggtcatttgacacggagcggtatttacggcatttggttcgccagcaggcggccaaccacagggcacacgtgcagacccatgactgcctctaccagctcagccttagcctgcagagccagggggaggcacccgcaaaggcaaccgcagaggctcctgacgatgcagatgaggcccgcatggacgaggagatgaccgatttgcttgatttcttgggagggagcggagccacatga

SEQ ID NO: 56913 - DNA, 537 bp, Glycine max
  Peptide Sequence Number=SeqID_148598
atgtttatacggataaccactcgggtatttccgcccgtcagcgtgactcaaaatgtcagtatgacagatgttgtgagcgcggaagatgacagagcaaaaaagaaagcttatacggataaccactcgggtatttccgcccgtcaacgtgactcaattgtgagtatgacagatcatacagcaaaaaagaatgtttatacggataaccacttgggtatttccgcccgtcagcgtgactcaaatgtgagtatgacagatcttgtgatcgcggaagatgacgtaaatctccgcgtgtcaacaggcttgtcggccgcgattgacgaagggcgcagaagagacgttagtctctgcgtgctattcaggcttttcgtcttacagacagcaaaaaagaatgtttatacggataaccactcgggtatttccgctcatcagcgtgactcaaatgtgcagtatgacagatgtgtgagcgcggaagatgacgtaaatctccgcgtgccaacgggcttgtcggctgagattgacgaaggtgggatcctctag

SEQ ID NO: 56914 - DNA, 579 bp, Glycine max
  Peptide Sequence Number=SeqID_148599
tgcaactatgttcatgtggtgtacctagacgcttttcgcgacctgggtcagagtggtggttatgcttggggagttgccgcgctggttcatatgtataaccagttagatgaggcttctaggaccaccacacgacagattgtggggtacctgactctgttacaggcgcatatgaagggaatcacaggagcaccgtacagggcacgttgtgatgctttgaccgtcatagatgtgtcctggttgccttacactgagcatcggggggttagggcctttgagctgatttcatcattccagagcatccctccgccgcctgttagtgctcgattgtcacatgatgatatagatgacaggtggatgcattttgtggaccacgtactagctgtgggtgagctttgtctagtgcatgggcaagtatctgcggattacatggagaggtttttccggatatctcacccattcatgataccgatccaggcaggtgaccagcccagagatgcacctgccgcagaccctgaggagtacatgcagccgcccagcccccaggtaccagtggcatttgacccccctccacatgcagtg

SEQ ID NO: 56915 - DNA, 342 bp, Glycine max
  Peptide Sequence Number=SeqID_148600
cttgggaggattgatggggacccggtgttgagagaaacgaggatatgggctacgtgggagtacgtgagctcagatggaggtgggcagcaggggatggagaccttgggggacgtcagtggggtgctattgcccaaaaccaagcttgaccaatcccgacccaccccggggcatagtcggtcagtgagaacctgtgatgtacctaaacaggcgagctcctggcagtcaacagataaaaggaaaacaagaccacaaagcaaggaggcttgtggtggctggccagctgaggctaagatggtctctggtaatcgattaccaaggggtgtaatcgattaccaggcttga

SEQ ID NO: 56916 - DNA, 696 bp, Glycine max
  Peptide Sequence Number=SeqID_148601
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcgtacgaatgagtctgattgtaagtgttgctttgtggcggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 56917 - DNA, 321 bp, Glycine max
  Peptide Sequence Number=SeqID_148602
atggtggcccaagcccgggctgttgatatgctcgtggagacgtcatcatcgcgattgtggatggcagcgcgcgcccttggcgtgcctcggcacctgcgcgctcctggcgtcggcctgtgggctccccattcggcccgtcttgaaacacggaccaaggagtctgacatgtgtgcgagtcaacgggcgagtaaacccggttcgagtgagagcatacctgtcgggaccccgaaagatggtgaactatgccctgagccggggcgaagccagaggaaactctggtggaggcccgcagcgatactgacgtgcaaatcgttcgtctga

SEQ ID NO: 56918 - DNA, 279 bp, Glycine max
  Peptide Sequence Number=SeqID_148603
atggaggttgaggaaccttggttggggttatggctaccattgaattatcgagtggatatgggatcaagtttagcatatgacaacggaatttggggtgaaccctacaggctttttgctgcaaaattcctttatgttggtgttttttggtttgtgctaaaggtggtcttcgtcattggaagtgcggtagacaggctttgtggaatggcagtcacagcatgggcctgtccctcattctcaccctcttcatttgccccagttttctcattcgtcctagtatga

SEQ ID NO: 56919 - DNA, 696 bp, Glycine max
  Peptide Sequence Number=SeqID_148604
atgaaacttcctttttaccctgaattggttaaagccttttattctaacttggaaattcaagaagattccttgattttcgaagtttatgggattaagatggtcatagaccaatcccttttctttgaactcactcaattatccagtgacggtgtaccatttgagggtacacttgatgatgagtggaagtttgatttttctgtttttgatgcccgtcggatggtttgcaccaaccaagcggatatgaccggaaggcttcttgctggttcattggcattcgaatgccgcatcatgcactacttgattgtgcgcatcctacttcctagatcatccaaccttgcacagccctttgtcaaagtcaagagatccttctctatcggtgcgaatgtagtctcctattttggatactgcaaagagagagatggttcttgggtaaagaaagacgctctagtacaagccacagaagaccgctctccatcatcacctcctcagagagatgattcttcatctcttatgcacaacatacttgatagattgaatggactccacactttcgtcggagagagctttgacttgttggatagccgtattgatgccatggatgcacgatttgcagggatggacacacgtatcaccaaacttgaggaggatgttagttatgttcatcagtgctttgatcttccaccaccatcctcatag

SEQ ID NO: 56920 - DNA, 345 bp, Glycine max
  Peptide Sequence Number=SeqID_148605
atggcagtgcacctgatccgtgatcgcgtcatgatggagtgcctagagggtgtttgggagaccctcgagggcaatgagaggtgccaattccgcggcacagttcgactcactgctacatcgcttgtgtcatcctccgaagaggatcctgaaggggacccagaggagttatctcctgaacctgctatggatgcccctgacttaccagaggatgatgaggacccacttcctaatgttgattctttagaggatattatgccagcacctgaggtagactctacagaggagagtggtcctagagggatggcgaatagcgatgactcttcatcacagcagaagactccttag

SEQ ID NO: 56921 - DNA, 400 bp, Glycine max
  Peptide Sequence Number=SeqID_148606
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatctgccggaaatcgtcgtggtattcactccagagcgatgaaaacgtttcagttgcgcagcctgaatggcgaatgggacgcgccctgtag

SEQ ID NO: 56922 - DNA, 408 bp, Glycine max
  Peptide Sequence Number=SeqID_148607
atgttgagtcaacatcccaatattttaaactacactgactctgtgatgaagagagaatctcctctatccctgcattacaaactgtttgaggggacacatgtcccagacattgtctcgacatcagggaaagctgctgactcaggtgctgtgtccaaggatgctctgattgctgaactcaaggacacatgcaaggtgctggaagcaaccatcaaagccaccatcaaagccaccacagagaagaagatggagctggaacggctgatcaaaaggctctcagaaagtggcattgatgatggagaagcagttgaggaagaagaagaagcagctgaggaagaagatgctgcagcagaggaagaggcagatgcagcagaggatacagaatcagatgattctgaagccaccccatga

SEQ ID NO: 56923 - DNA, 258 bp, Glycine max
  Peptide Sequence Number=SeqID_148608
atgtcctcgccttcagagggctgcacaccatcgccttcagggggctacacatcctggcctttagaggactacacctcctcgccttcagagggcttcacatcctcgccttcagagggctactcgccctcgccttcagaggactccacgtctccgccttcagaggcctgcacgccctcgccttcagaggactacaggtcctcgtcttcaaaggactacacgtcctcgccttcagagggctggatgccctcacctttatag

SEQ ID NO: 56924 - DNA, 499 bp, Glycine max
  Peptide Sequence Number=SeqID_148609
ctgtacctcccgttcagcttctgacggggtggtgcgtgagggcaaaagcaacaccggacctcaacgctggcaagtggcgcgtcccattccccattcaggctgcgcaactgttggtaagcgcgatcggtgcgggcctctttgctattacgccagctggcgaaagggggatgtgctgcaaggcgattaagttgggtaacgccagggttttcccagtcacgacgttgaattcgatacttggcatgaggctactaaactcagaaaatgatgaagagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 56925 - DNA, 513 bp, Glycine max
  Peptide Sequence Number=SeqID_148610
atgacgtacgaagacctcttgccgtccctcatcgccaaccatttggtcgtggtaactcccggaaaggtcctccaaccccctttccctaaagtggatcggcccaatgtgagaaccaacccgctcgccaatcatggagggggagcggttaacgccgttgagtccgataggccgtgcaggtctaaacctttaaaggatgtggcaacccctaggaggtttatctttgaggccctacaaaagggaggtgtgattccccatagtgggcataaggaggattcctgtttgctgcattctggcgagctgcatgacatggaaacgtgtttgggagtagaggaattgttacagcggatgatagatcaaggtcgactggaagttggcagtgaaggaagagaagagcagcatatatgcatgcagtccacggatgggagcagtgttgtgaagcccaaacccttggtgatatacttcaccaagggcacagcttcgcaaaaacccggacaccccttagcagctaaacct

SEQ ID NO: 56926 - DNA, 126 bp, Glycine max
  Peptide Sequence Number=SeqID_148611
atggggacctctaagggggaaaaaagggtggtggttgccgcccagctcgcccaggcgagctgggttgcttccaccagaaggcaccaccttctgttggatgatcctggaaggcccaagtgggcctga

SEQ ID NO: 56927 - DNA, 183 bp, Glycine max
  Peptide Sequence Number=SeqID_148612
atgtcaggaaaagctataagagaaatcttagttaggtggttggatgaccttaggcagaacaacaaggaggaggtgaagcaaaagctaaggagaatgaaacccgagacgtcgctgaagatcaaggaggaggtgaaaaagcagtttgacatcgatttcttggtggtggttcgataccccgagtga

SEQ ID NO: 56928 - DNA, 885 bp, Glycine max
  Peptide Sequence Number=SeqID_148613
atgacatccttcagccagcttcagtcacagatgcaatctcagggacttgtagtgcctcctgagcctctggttggtcctggtccctccggtcctcgggtgagcacaaatgggagttgtgttgatccctcaggaagcgatcctaagacgggtgactctgacaggtgcggcttgtacatagaagtagatcctgcccgcctggttgccgtggggagagtttatgagggatccactcttgttcataacactcatttgttgcctggccaagtaaaggtgagtgtggacgagattaaagatgcagatgctgcagttcctgtacccactgatgaggtttccttagtggggcaggcacttcacaccttccttgcttggccgacacatttggtcaagtctttatcacaccaggtagctgtgtctccgccaaaaccacctccgaagcccgatccggaggtcgatgatccgctttatctgatgacattgaccatcccagagcttttcttgaggccttatcaggttagatgggatgccaccgtgtttggggtcgttaatccagatttccccctgtacataaagcacgaagacctctccgaaatcgcacacgatggtcgatgtctcagcatatcagtgttacagttgtggattctgcatctcactgaaacatgtatgcgagcggggaattctgatatctatggattcctcgagcctcagtccattcagaggtctgggcaatcgcagtttgaatcagaaagttacataaagagttggatgcagagttcacaacgcgatgtgtatcttggagcctacctaaatgggccagacaactaccttaaggagattattaatagtgtaatagacaaaaaggaactattgagtgcggctactatgtga

SEQ ID NO: 56929 - DNA, 474 bp, Glycine max
  Peptide Sequence Number=SeqID_148614
atgcagcgcagtagctggcagcgcctgctggacggtggcagcatcagccacctgttctcctggctgacgctcacgccagagcagattgcgcaggcacagggcatctccaccgtacgcgcccggcagatctggcatcgctttaacctgacgcgccagcagccgctgcgccgctggatcagcgcgctgggcttaccgctgccgcgcacggcgctacaggcgttgcccgatacgcagtggtcgcagctgctggcgcgttcagccgacagctggcagcagctgccgggtatcggcagcgtactggcacagcggctggtgatgatgctgcaggatgcacgcctgcagtcgctgattcactttctacagcagcagaatatcccggcgcagccgtcagtgctcggggtgggggtaattgaaaatcggcagaccgaggcggaagcgcagcgccagcaggcgggcgaagaagccgaacagtag

SEQ ID NO: 56930 - DNA, 217 bp, Glycine max
  Peptide Sequence Number=SeqID_148615
atgaaaagtgataaagcctcacaagatatacactttatctctcaagcttgtagtgagcttcaaaacaaggaaagggaaacaaagctcaaaagggctatcaaaggaattaattcaaggaagcatcaacaagaatcaagccaaggttattgtgcaagcaatcaatggggcaaaacataccaaatgattatgatgatggatggctcaaattctcacaaag

SEQ ID NO: 56931 - DNA, 183 bp, Glycine max
  Peptide Sequence Number=SeqID_148616
atgagccctaagagaataaaggtcattcctgagtggcccactccaccaagtgttgagagaaggagcccagagtatgaagaacctcgggatttgaggtcaaatcctttccaaggtggagggaatgatgcaaatcctatcccgcaaagggcattggatagaaagactccaagtagattgggctag

SEQ ID NO: 56932 - DNA, 1107 bp, Glycine max
  Peptide Sequence Number=SeqID_148617
atggtagaatcatacaagaagcgaaaaggatcttcctccaccaccgctgctgctggccatcgccgccaaggaacctctagagacacaaccgcaccaattcctccatccatttcatctcctcgatcatctacattattttcttcagatgatcaacgtcaaaggtattattctcaattttgcaatagagtcattctagaccctaagtaccttgaccttgaattttttgatggcgaaacatttgattgttaccaagtgtttcaaaattctgctttgactgattttatgtctttggaactgccttactttcctgaattagttaaggtcttctataataacttgaaaattcaggatggtattatttactctgaggtgcataatattcccattattattgatcaatccttgttcttttccttgacaaaactgcccaatcaagttgttccttttgagggcacccttgttgatgactggaaatttgattattctagtcatgatgctcgccgcatggtctgcaatgaccaggctgatatgaccgacaggttacttgttgggtcattaacttttgattgtctcatcatgcattatatcattgttcgtattttacttcctcgatcttcaaaccttgctcaagcctctgaggaggatttgattctgatgtgggcctttcaaaccggtcgtcagatcgactgggccatttggttcgatattgaatgcataaggcattacgagccaatgcacctctcccttaccctcaattggtcactctgtttctccgtcattttcaaatttcgcttgatgatgaaccattttttcaagtcaagcgttcctttgctattggtgctggtgcagtcatttcttttggataccaaaaatgcacttcctccacaagatgagcgtactccttctcctcctcctccacgagacgattcagccctcatgactgaagttctttccgagttacggggtcttcgtacttatgttggagaacgttttgattcattggataatcgctttgtcagaatggatatttgtctcacacagcttgaagaagatgtgggttatattcgccagagcttcgatcttccaccaccacctccaccttcttag

SEQ ID NO: 56933 - DNA, 381 bp, Glycine max
  Peptide Sequence Number=SeqID_148618
atggctgctagtgatcatgctattttgcgtgatcgggctcatgtgcctacaaagaggagtctactagagctttcctcacaagatgcactattggcacagaacaagctgctagctaaccagctagaatcattgacagagacatttactgcaaatgaggtgaattatatggggaatcagcacagactaggatttaatgcaggaggatttacaagttaccagcaaggttccaattttaatcagaatcaagggcaatggaggtctcatcctggaaaccaattcaataaagacaaaggaggatcatccaacatgcctcaaaatcaagggtctagcctttatgagagaacaaccaagctgttggagactttggctcagttcatgcag

SEQ ID NO: 56934 - DNA, 1131 bp, Glycine max
  Peptide Sequence Number=SeqID_148619
gtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctgggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctc

SEQ ID NO: 56935 - DNA, 417 bp, Glycine max
  Peptide Sequence Number=SeqID_148620
atgaagcacttcactgacaccctcatcagtgccaacatagcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 56936 - DNA, 330 bp, Glycine max
  Peptide Sequence Number=SeqID_148621
atgtcatgtattgtttgtagggatcgtgcccgcaagacacctagtgaacccgaagaaggccaacagggtcttcgagttgccagctctaaatacgggtttctgtcagttctagggagtgcctgtcacccccagcaagtactgtgcccccaggcaggcgcagggcgaaacaccacagcaacattgggatggccggtagcgggcattagacacaccgccaccacctctagagttcacctcagctcatccacaaaaaggttagagtgttgcctacgacacatggccgaccagcaggctaccaagtccaaagccaaagataagcaaaagtactag

SEQ ID NO: 56937 - DNA, 453 bp, Glycine max
  Peptide Sequence Number=SeqID_148622
atggtctacaatgaccatgctgatatgaccggtagattgcttgctgggtcattcaccattaagtgtcgcatcatgcattatgtcctttgtcgagttctgcttcccaagtccaccaatcttgctcaagtctctgaggaggattcaatcttgttatgggcttttcaaaccggtcgtcaaattgactgggcccatcttgttaggtaccgagtgcataaggcattatgggccaatgcacctcttctgtatcctcatcttgttaccttgtttcttcagcatttcaatgttcctttaaaggatgaaccttttgttaaggttaaaagatcttttgctattggtgttggtgctgttacttctttcggataccgaaaaaatatggatggtcaatgggtgcataagcaagacctaccacctctcattcccaatgaatgcacaccgtctccaccaccgcaatga

SEQ ID NO: 56938 - DNA, 114 bp, Glycine max
  Peptide Sequence Number=SeqID_148623
atggggtatgagatgaggaaaccacaatttgagactaagttgctcgctatgcgaacagagtttccacaagcagcagattggttggatcaaattcctaagagtaaatggatttag

SEQ ID NO: 56939 - DNA, 732 bp, Glycine max
  Peptide Sequence Number=SeqID_148624
atgcggatcatgcgcaccagcatgaccaccctgacccagacgtggatgacattgctgctcagcaatgtcttgcctagcgatcataactctgatctccctctgccaaagtgtcaattggtatatgccatcctgacacggatgagggtccacgtggcccaggtgattgctgacgccatctatttgtttacaggtatgccacccaccaggcaccctctagacccggataagtctaacagggccctggggtttccagcattgatcacaggcttctgccagtcattcggagttcctgtcacccctagtaaggtgatccgaccgccgatcacccgggccttcatcgagaagtattgcatgcctaggcaggtgcagggtgatgcacctcaggccgtagacgcaccgccaccacctcatcagggagatcccgctggatcactaggcatggagcgttatctacagcacttgcttcgccagcaggcgaccaaccactgggggcaggtgcagatacatgagtgtctctaccggttcagcctcagtcagcaggggcagggtttcactccttttgcgtgccctactccagagcaatttggggctgaggtcgcatggcccgaagattggcccgaggcccaggcaggggaggcgcctacaggatcccctggcgatgcagaggaggctcgtatggatgaggagatgacggatttgctcagtttcttgggaggaagcggagccacgtga

SEQ ID NO: 56940 - DNA, 135 bp, Glycine max
  Peptide Sequence Number=SeqID_148625
atgccacctatagtagttatgactcttgaaggcataggtcacatcttagacctcactcccataggagagaaaaggaaagaaagcctcaggaggctaacattaacctcccatacttccaagggaaggacaatgtag

SEQ ID NO: 56941 - DNA, 225 bp, Glycine max
  Peptide Sequence Number=SeqID_148626
atgtcaggtcccgaaggcggtaggctacttgtcgcagctccgaacaggaagttgctgaacatgactgcatgtggttcccttgactggctttccgaggagacctcgctcagagttgcgggtagaggtgctgtgggtgaggggttcatatgtgatgaccagttagtactgagggtcttggtaggaccacggcacactgacatctttgcggggtacgttgactgctga

SEQ ID NO: 56942 - DNA, 600 bp, Glycine max
  Peptide Sequence Number=SeqID_148627
atggcgactagactagttggagcagagagacccctggtccatgtggatcctgctaccaggaaagcggatggttcccacagaaagaagttaagaacatatttggggatcatcactcgtgataaggatgtgcaaaagaaggcacagaccatccagaaacaaaacactgcccttcacgtgttgtctcttaggggttatgaatatttagaaaataagttgatggataagaagagaaagagaaaactagaggaagttgctcaatccagaagcactgacactgtgattaatcctccatctcccatcagacggcacgcgaagtggaagatggctcgcacgaagaaaactagccaaatgatgtctgaggcaacaaaggaaattgctgagaagattgattcgttggaggaggaggcctcacaaggttcgtttgtcgcccatggacgtcaggatgtactgactactgccattgggcaaccagaacaccctggtcttgtgcgtgttgttgaagccggtttgacgatcaagcaatactttggaccagctccaaggacctccaacacgtcttcctccatgactcccgaagatctggagcagctgacgcaataa

SEQ ID NO: 56943 - DNA, 359 bp, Glycine max
  Peptide Sequence Number=SeqID_148628
atgtcaggatttacacacgattctcctcaattttcagccagcccgcatcaattagaccttgcaccttacgcttcaggcccctacaatgctcaatggaatgccccggggcttctccatgacaagcacacgttgcgttcgagtcgtattctcggagaaatggaggttgatgaaccttggttagggctttctcgctgcaaaattcatttcttggttggtgttttggtttacgctaaaggtggtgtttgtcattggaagtgcagtagtaatgacattgttgggttggtgggaaacatggctgtattggaatggcagtcacagcacgggcttctccttcatcctcaccctcttcatttgcccca

SEQ ID NO: 56944 - DNA, 468 bp, Glycine max
  Peptide Sequence Number=SeqID_148629
atggctgaagagcaaccaaggagggtgacccttgaagattattctagcatcgctgtgccacagttctttacaagcattgcaaggccagagagaagccaagaggtggctgcattcattcaaaggttgcatgttgtgctatttgtggtggtgctcatgagtcaggctgctgtattcccactgaggatcatgcacatgaagttaactacatgggaaaccaacctagacaaaattttaatgcaagtggattctcaggatttcagcagggccaaaattataactagtagtatggacagtggagagctcatcctggtttcaatatcaaatcacaaaagccctgagtcggccactaaaaatttagagatccaggtggggcagttggccaagcaaattgctaacacttcttccaacaaatttggagcaaacacagagaacaatcccaaggaagagtgtaaagctgtgatgacctga

SEQ ID NO: 56945 - DNA, 222 bp, Glycine max
  Peptide Sequence Number=SeqID_148630
aagaagtctgaagcaggcccagcccaacacgtgcgtcacgcgctaagcgtgcaaggcagtacaggcgctaagcgaggtgttaagcttgaagatgcagaatccattacgcgtgctaagcgagggccacacgctaagcgcgcgatccaacagaaacacacgctaagcctgcagctcacgctaagcgcgcgatctaaacgcgctaagcgcgaggtgtcgcgctaa

SEQ ID NO: 56946 - DNA, 315 bp, Glycine max
  Peptide Sequence Number=SeqID_148631
atgggctcatacatagcccacgggcccaaaatctatcctaaggctcatgagaaccctagggctttctcctgtatctctgactcaatcttcttggagtcttctatccaatgcccttgggggttgagcttagctcatcagtgggctaagcgtgcatcctccgctaagcgcagctttagcgcgcttagcgcaacagaagaatttggcagagcatcaatttcaagtccgcgcgctaagcacgagatcagtgcgctaagcgtggtagttgtcttcaaccaagctcagcgcacagctggcactaagctcaaatccacttag

SEQ ID NO: 56947 - DNA, 345 bp, Glycine max
  Peptide Sequence Number=SeqID_148632
atgataacaaaaggtgatgacaaaaatctcaaaggtcaatccaagaatgagttcaagatgttcaagatagaatcaagaacacttcaagattcaagaggaaagttgaagaacacttcaagattcaagaggaaagttgaattcaagaatcaagaatcaagattcaaggatcaagcttcaagaatcaaaatcaagattcaagaatcaagagaagacttaataaagataagtatgaaaaggttttttcaaaaacttagtagcacatggatttttctcaaaacatgtttaccaaagagtttttaccctctggtaattgataaccaaattgttgtaatcgattaccagtag

SEQ ID NO: 56948 - DNA, 555 bp, Glycine max
  Peptide Sequence Number=SeqID_148633
atggcatataatgctagctctaaagaaaatcaaaatgtaatgaacagtcaagaaattgatgtggccaagagctactccatagaaaagtctcaagggacacttgagttagaactctacaatcaaggtgaagcagaaaaaggtgccaatttggataacttgttgatgcaattcagagaaacaactgaatcaactcaattagcatttacaagtgtagaaattcaggttgccagaatagaagaagaccttgtagagactgaagcccaagaggaaatccctaccaaagagcatggattaagagaaaaagatgaaatgaaaggtaaggaaaaagcacaacaatgggaagagtacttacaacaagatattcaacaagaaagtatgctccaaatcaatacccttcctcatcaattgattgtcaagaagcaaaggcatggagagcaaaagagagcattaagtgtctttctctcccagatcaccaacccctcttctgcaatgagttggcatacaattccaaaatacatgaagttcatggaattcctagctaaaaagtggaactga

SEQ ID NO: 56949 - DNA, 216 bp, Glycine max
  Peptide Sequence Number=SeqID_148634
atggcttcctatggtggtgagtggcatctccaatcatctttcttccttcaccattccggttacattgatattaaagaagcaaaggactccattgatgaagaagatccaaggcctacaagctccacatggagctacatcatgcagtatcaagagcatcttcgtctaggtgatgttcttttgcttcctctatctttttgtttggtgaattcactttaa

SEQ ID NO: 56950 - DNA, 279 bp, Glycine max
  Peptide Sequence Number=SeqID_148635
atggagagaagccataacttcaacaatgagaagagatctcaagaagtttctccaacacttaaatgctataagtgtaatcaactcggtcacataaaggcaaactgcccctcaaatgagtcatggctcgagaagaatgagaagaaaagctataaagaaagaagatccaagaaggtgtatattgcttgggacgacaatgactcatccgatggttcggagaaggagatcaaccttctatccaaggattatgaaagtgatgagaacatctctcaagaattttaa

SEQ ID NO: 56951 - DNA, 385 bp, Glycine max
  Peptide Sequence Number=SeqID_148636
agggctgcacgccctcgccttcaaagggctacacgccctcacctttagaggactacacgtcctcaccttcagaggactacatgtcctcaccttcaaaggactacacgtccacaccttcaaagggctacacgccatcacctttagaggactacacttcctcacctttagaggactacaagtcctcacctttagaggactacacgtcctcgcctttagagggctccacgccttcgcattcagagggctacatgtcctcgccttcagaggactacacgtcctcgcctttagagggctccacgccctctccttcatagggctatacgccctcgccttcagagggctccgcatctgcgccttcaaagaactcaagatcctcagcccttaa

SEQ ID NO: 56952 - DNA, 385 bp, Glycine max
  Peptide Sequence Number=SeqID_148637
tgagcttaagcttcgaagggctgagagagaccaattgagagttgagggcatgatattggaagataagctaaaggcttgtcaaaggtcaaagagaagtttgtccgaccaattgagcaagatggaagaaaacatgggggccatcattgaccaatacaaggaaaaactaagtctagcagcaacccatgaacaaaagctagaaaatgagtatgcaaaggtatcggtcctgttcgccttcaccttaaatgggagtcaagagcttccaagactgctagccaaagctaaagcaatggcagacgtgtactcggcccccgaggaagttcatgggctcctcgattattgtcagcacatgatcgatcagatggcccacataattaggagtcactaa

SEQ ID NO: 56953 - DNA, 1171 bp, Glycine max
  Peptide Sequence Number=SeqID_148638
atgaacaaacctgaacaagtgtgggaaaaaacttggcattggttaagtgatgatattgtatatagtcattgcagatcattaaacactccaggattacatattgatgactccaatctgatgaatctggtattgcttgaagttgaacagctgttacaggccaatcaaagatcacttaaagactatccttccatgtcatatcctgagaacgcaaatttactaacacatgcagacaacgacctcattttgtctgagctcaatttcaacaacgaagaacttagatcagaattcttgaaccttttttctcaaatgacagaccaacaagcaaaaatttataaccaaattattcaggctgtcaataaaaatgaaggtggaatgtttttcttatatggatatggaggaacaggaaaaacatttatttggaagacacttgcagcctcattaagagctgacaataaaatagttattatggttgcttctagcaacatagcttctttgttattgcctggaggaaaaacaacacattcaaaattaaaaattcttgttccgatatttgaagactcaacatgcaatattcatcaaggaacacaattggctgaattattgaatgaaacaagtcttatcatctgggatgaagcccccatggctcacaaattctgttttgaagcacttgatcaaagtctaagagatgttattaaggcgaaatcaagttctgataaaatctttggtggtaaagttatggtatttggtggagatttccggcagattctgccagtcattcttaggggtagccgctctgatattgttaatgcaactattaattcatcttatctatggaatcattgccatgttttgacactatcgaaaaacatgcgtttagaagccaatacagatgcaacagacagagaagaaactacagcttttgcagagtggatccttaatattggtgatggaattgctggccagcaaaatgatggttatggttcaattgaaattccaaaagatctgttaatcacagaatatgatgacccactctctacaatagttaattctacatttccaaatttatctcaccatcataccaatcctgaatactttcaaaccaaagccatattagcttccacaaatgaaaccgtacaacgaattaatgattatatactatcattgataccag

SEQ ID NO: 56954 - DNA, 411 bp, Glycine max
  Peptide Sequence Number=SeqID_148639
atgaaagattgcaaaaatacaagtggtaaggatgtctccttcacctctaggatctcacaatcactcacaaactcatctcaagctgtcaaaccggctcctgcttcaagctctggtggccttgttcgtgctcatgcgcttagcgcacgtatggaccgcttagcacacgttagtgattttgggcttagcgtgcctttctcgcttagcggattaactgaagtgcccaggagtgttgcgcttagcggattgctcgctaagccagtagattggcttagcgagaaaacaactgttgtgcttggcgcactgatctcacgcttagtgtgcatccatcatattgatgctctactagattcttctgttgcgctaagcgcgctgaagctgcgcttagctgtggatgagcgcttagcccactga

SEQ ID NO: 56955 - DNA, 226 bp, Glycine max
  Peptide Sequence Number=SeqID_148640
atggcgtcatcgacgactatcacaatgcaagctttgaaagcaaagctcaaaaagacaagagtggtgaaagagaagctgaagacgacattcactagggtcaggaaagagtgtgatgagctaaaagatatcaacatgaccatggttgaagcgttagagtgggaaacaaaaagggcccgaaaggaagaatggagcaagaaaaagtttcgaggggctttgtggggcagca

SEQ ID NO: 56956 - DNA, 207 bp, Glycine max
  Peptide Sequence Number=SeqID_148641
atgggggagatgcttgccacccagctcgcccaggcaagctcagctcgcccaggcgagctaggttgcttcctccagaagcaaccgccttctggaggaatctattggaaggcccaaaacttcacggattgtgatacaatgctttcttttgacttccggcatgtgacggaacttcacgaattgcctaacgatgggtgccaagtaccttga

SEQ ID NO: 56957 - DNA, 279 bp, Glycine max
  Peptide Sequence Number=SeqID_148642
atgggctcacaagattgcttaaaggcctatgagaactccaagatttacaaggagaaagtgaagaggtttcatgactctatgattcttaggaaagagttccatattgaccaaaaagtgttcttgtttaactcttgcctcaagcttattaccgttaccggcaaagtcttcaaagtgaatggtcaccaactcaatctttttcatgagggtcctcaagtggaagaggagtgtgttgcggacctctctttggtcttgccaattttatgtcatgatgtgccttga

SEQ ID NO: 56958 - DNA, 732 bp, Glycine max
  Peptide Sequence Number=SeqID_148643
atggaggcctctagtggaaaatattcctatggtcaaggcaatccatttgaactggaaatatctcaacagttgacacacaaatctgaaaatcatgaacagactagtcatgcattggatattcaaagtgaaagaaaattgtcatcctcaatagttcaaaactttgacccaatgaaagcatctcagttgggttatctcacggtcaaacctggtaaagagaagggtataagaagaaagaggaagagtctcggtgccaaattagtggcattgtctaaagtttcaagtagtcaaagtggtaattctacaccctcatctcctttatcccctactccctctgctacacctaaatgtaactggccaatgtctctggacaaggggcaaccccctgaggctcttagttcaatgacacaggtggctacccaacattctgccaatgatcaagcttctgccactgttgttgtgtcaaatatattgaagcctgcttctacacaaaggtgcgctaataattgtggaaaggctacgaaggtgattgacaactatgagggttttgcgatttctcgaaccatgcaacaactcaaggaagaagtggttcgacaattccaaagagggttgctacatccttttctaactcaagcggtttgcgacagtcacacaaacctcaatggcgggttgagtggcactatgaggaggagaggacaggccgggggagataggtctttcgagcctgagcgatga

SEQ ID NO: 56959 - DNA, 527 bp, Glycine max
  Peptide Sequence Number=SeqID_148644
gtatgccacccaccaggcaccctctagacccggataagcctaacaaggccctggggttttcagcgttgatcatgggcctctgccagtcattcggggttcctgtcacacctagtaaggtgatccggccgccgatcacccgagccttcattgagaagtattgcatgcctaggcaggcgcagggtgatgcgccacaggccgcaggcgcactaccgccacctcatcaggctaatcccaccgggtcattaggcatggagcggtatctacagcacttggttcgccaacaggcggccaaccaccgggggcaggtacagatacatgagtgtctctaccagctcagcctcagtcaacagggccagggttttgctccttttgcatgccctactccagatcagtttagggctgaggttgcatggcccagagattggcccgaggaccagacagaggaggcacttgcaggagctcccgacgatgcagaggacgcccgcatggatgaggagatgacacccctgtcgaccataaaaagataa

SEQ ID NO: 56960 - DNA, 270 bp, Glycine max
  Peptide Sequence Number=SeqID_148645
atggatttcgaaatctgccctattatgcagaaaattgctgtcaaatttgtgcagcagaatttttgttcatgtgtagaaaatgcttgtgcattgttggttatgggaaagcttgtaggggttgatggggacccggtgctgagaggaacgaggataagggctacgtgggagtacgtgagctcagttgaaggtgggcaactggggatggtgggttcatgtttgatttgtgaaagtggaagagttgatttgcgccatcgcccgatcgccacctag

SEQ ID NO: 56961 - DNA, 177 bp, Glycine max
  Peptide Sequence Number=SeqID_148646
atggcatttggtggacctaaagctcgcccaggcgagctgagacttagccatgaagtaactggctctcccaggcaagctggttacttaacatggaagtcttttggtggcctaggcaagctaggggctagcctggttcggctagcaagaatcaaaacatcagtaaatgatagtccctga

SEQ ID NO: 56962 - DNA, 309 bp, Glycine max
  Peptide Sequence Number=SeqID_148647
atggccacaatgatggaggccatgatgagcatgaagaagataatggaggtcaatgcggctgtagttgccattaccagtgccgttgctgaggtggacccggctcccccatctggcctcaaccaaataaatcatcccatctcggatatgcatgccttcccatcatatggcttgcctcccaattatacaccacccaatgtggtgcacactcccaatgagaatgtcaatgactccactcccatactcattgagagccagcaacctcaatctgatcatgcacctatccctcaacccatggggggggacacatga

SEQ ID NO: 56963 - DNA, 228 bp, Glycine max
  Peptide Sequence Number=SeqID_148648
atggagcttattcagaatatggctgcaagtgatcatgcaatcttgcatgatcgcactcaaattcccacaaagagaagcctgttggagctttcctctcaagatgcattactggcacaaaataagttgctatctaagcagcttgagacattgaccgaaacattgagtaagttgcctaatcaattgcaggttggaggttgcagcatattgttagtcgatgaatacaactaa

SEQ ID NO: 56964 - DNA, 231 bp, Glycine max
  Peptide Sequence Number=SeqID_148649
atggcagcggaatggagaaggaagagagagaggagaatccacttcaaggagaagatgagtctagaagaagttcaccaccataggaggccatggataagagcttggaggaagaaggagatgaatgaagggagaggaagagaacaacacgaaattttgtgctctaaaagagctctgaaatctaaacccactaatccaagatcaagtccaagattatccactaagtgtgcttag

SEQ ID NO: 56965 - DNA, 300 bp, Glycine max
  Peptide Sequence Number=SeqID_148650
atggtgcatattgagaaattatccaaaaacatgtgtagtttgggaaaagataggagagagaaggtctccattggagcttggaggcctaagatcttcttcatcaatagattcctttgcttcttggaagatgaatggcagcagaatggagaaagggagagagagaggagacgccatttcaaggagaagatgagtctagaagaagctcaccatcataggaggccatggataagagcttggaggaagaaggagatgaatgaagggagaaggagagaagagcacgaaattttgtgctctaaatga

SEQ ID NO: 56966 - DNA, 267 bp, Glycine max
  Peptide Sequence Number=SeqID_148651
atggaaagtaaaagagtagggaagaagaaaacaaacacacaagagtttttatactggttcggcaacaacccgagcctacctccaggccccaagcgacctgcggtccttgagatttctttcaacctttggatgtaccctccactagaactgatccacaagagatgtaccctctcttgttctcagtcaaacccaagtagatgtaccctctacttgtaccacaaaggatgtaccctccaatgtgttaagacaaagatcacaggctgttaa

SEQ ID NO: 56967 - DNA, 109 bp, Glycine max
  Peptide Sequence Number=SeqID_148652
atgacgccaacgtcattacgtcggctcggcggctccttatcagaatcttactccctacaccttgccactgtcattctgctcccacgaacaaggttcgtgatcatcacag

SEQ ID NO: 56968 - DNA, 1146 bp, Glycine max
  Peptide Sequence Number=SeqID_148653
atggaggccaatctaagactgcgagcatccgctaagcgcaacactcctgcgctaagcgcgaggaagaattcagaagaagatgagctgtacaggttcgctaagcgcaccgcttcagttcatccgctaagcgagaaaggcgtgctaagccaaaaatcactaactttggactgggattcagagctttgcatgtctagggtttctagagagagaaaggtccaagttccaaagagttttgagagattttgctgtgtgaagatctgcagagaccaaatcttgaagcaggagccggcttcttggtatggaaagctaaatcccctattggatcttccctgtagggctgagttgttgtgctttcatgaggaattggggtgcgataagttagttgagtatgtgtgtctcaatgcggtcctggttgagtttagtcttacaagaggaatctacggacgatgcttgatcaggattaggctaaactatcatgaggaatcgggttccccgagtgttcgatactcggttcttaccgttttatactacttgtgtgatccggtgcacttgccggaatcccgaacagttgtgctaatgctagctaagaacagtgtgaaggaaggatctcctttcttcatatccatctcaaaaacaccacctaacaccatggaggaattcttgaaaaggacaaaaactaacaagccacctaagtcggatgagagactgacttacaaaaccaaattgaggtacgatgagtatactcccttgaacgcatcacaagggagaatattgaatgagatcatgaatgtaaagctacaggatgtcagccttgatgtcaagaaaagaattacagatctcgatatgacagaccacattgcaatgaacaatgcaaaaggtcaagaagtcacaactgttactagagataaggttgttctagagaatgctcgccaagatatcaacataaagctccagaaagggagacaaaaactcatctataggccattcaaacaatgcgtgaaagaggcacgcaagggaagtctaaaccgctacacatggcagaagacccctacctttgaccttcgacaacaaggatatggacatgctgactttgaataccctgagagttgtaatctcgatagttcatttggccatgaagttccttag

SEQ ID NO: 56969 - DNA, 225 bp, Glycine max
  Peptide Sequence Number=SeqID_148654
atggggcactcagcaaacagtgaagtggcgaaactgcccttcagcaattcttcttccggaaactttccggaaaaattctttccggaacttttccggaagaaccttcttccggaagaagaatttgtgtcttctggaagtactcacagacaacttccggaagaacgtcatccggaatgtttccggaagaagcttcttccggaatctgttggtggtcccgtgaagtga

SEQ ID NO: 56970 - DNA, 423 bp, Glycine max
  Peptide Sequence Number=SeqID_148655
atgtctatttggcacacctcagtccacgtaagcaacccaatgtggcaaaatggagagtttgtgccgccggagaagccggtgatgatgtcacggaggagtgaaattgagaatagggagattgccggtgagagatggaagaaaggggaggcggagaggggggagtttgtttctggaaaatggagaaaggaggagctactgttagtagcaaaaatccggcaaagtgctactgagtctcctaatccaaaacctgaggttggagagattgacactagcccaccttttcagtctgttaaagatgctgtctctctatttggtgaaggtgctttctctggtgaaaaacctatctttaagaaggcaaaaccttattctgctgaggagacacttgactctgttaacagtgcatacttgttgtccttgtcatag

SEQ ID NO: 56971 - DNA, 1104 bp, Glycine max
  Peptide Sequence Number=SeqID_148656
atggtccaaaaagcaattgacaaagggagattgaaattcaaagagaaaccaatgaaggttgatactaatccattccacatccaggctaattatattgaacccatgcagatcatgatgatgggagctttgattggaacgccaaagatgagtacgcctttatctaaagaggaggggaatgaaggatccagttctcgttttaaagcattcgaagtaagtgatttggaacttcgaagaggaggaactactgaaggttccaagaaaggattctatgaataccgaaattctccatgggtgaataggaacatgtcaataacccagtggaggaggcatcagagaatgacaagggatgcaatattggagatgcaacaaagaaatgattccttggaagccatttatggagtaatttggatattacccgcagagtatgctgaagatgatcaaaataggcacatattgagagattatgtcaaggaagactattttgatgatccttgtctaaggccaaagaatgctacagtcttcgatccacctagtgatgacatgagctatcacatgaagtcactccacttgacaactatggtagaagatcaagtcattaataagattttggtggatggaggggatgcattcaacatcttaccaagatctatgctgtggagaggggtcatttgtttggatgtttctataggtagcaggagaagacctacaatgcttttgaagcttttcttttggaacaaagatggaaaacttgaaatggtagaagctggaagtggccaagtagtggctagaactgctcttttcaaagttgaagattccttctatgtgaacaacaaagttatgacttccttagaagcatactcgaactatatggctcgactatcagcttacataatcgataacaagaaacaggcggctactacaactgttgaaaacaaggaaataactattgcggtcgtcgaaattggagaaacatctactgaaactgtcgaaatcaaggaaaagatggatattaaagccattgaaagaagcattgagatagaaagaaagatggatactgatgccatcgaagaaaagaagaaaatgttggacaaaaaagaaaaatga

SEQ ID NO: 56972 - DNA, 366 bp, Glycine max
  Peptide Sequence Number=SeqID_148657
atgggttctccacctgcctccactcctcctcctcttcctcctccttctcctccttctcctcctcctcctcctcctacttcggacgcatcggcttcaccgtctgccgtgaagcggacatgcaaagcctcacgtctacgatcgttgtccactagaccaccaggtgctgagagaccagtggtgcatgttgatcctgctaccgggaaggtcgacggtccccacaggaagaaattaagaacatatttggggattgtggtgcgtgataaggtggacatcacctacgagaactggaaggaggtccctactgctcagaagaacctgatttgggaggatattcaggcggatttgatatctcagaggcttctgaca

SEQ ID NO: 56973 - DNA, 438 bp, Glycine max
  Peptide Sequence Number=SeqID_148658
atgatgaaggatgcgatctacggtcacaactctgcagtgcccaggctccattttcaactttcttcttcacttcctcaactcctcacattttttttctctgctactggatgtccttttcatcttcatttacatggctatttacagaaaagagccaagaggtgtagacaaatttgcccaagtgttttgatgataacaatgatgacaacaaaagatgatgacaaaggtgatgaacaaaaagctcaaagatcaaagaacaactcaagtgaatcaaagaacatctcaagtgaatcaagaacaagtcaagagttcaagaatcaagaagaattcaagactcaagaagaaagcctagaatcaagaatcatgattcaagattcaagatctcaagaatcaagatcaagatcaagattcaagactcaagattcaagaatgaagaaatga

SEQ ID NO: 56974 - DNA, 339 bp, Glycine max
  Peptide Sequence Number=SeqID_148659
atggtggaaccatcaaagaagcgcacgggatcttcgactcgaagccaacgacattccgaggctcaagaaacgcagattccctcctctatttcctcttcctcattgttctcatcagaagaacaacggatacggtacacaaatcttttctcttctcattccattatcgatccaaaattcattgacatggatttcttttccaatgagagttttgaacgcattcaggcatttcaaaactcaaacctcattcctttcatgtctttaaaattgcctgtttattctgaattagttaatgctttctattctaacctcgaaattcaagaaaacactttgatttctgag

SEQ ID NO: 56975 - DNA, 1365 bp, Glycine max
  Peptide Sequence Number=SeqID_148660
atgactccattaccaaggccacagagtgccttagggagggaagcacttatcaagaagggtagggttgaagacttgtctattctccacaagtttgtacgctttcacttgatggaaaaccttccattcaacttgcctcacactatttacatcaacatcctcagaaatccgaagggcttaggaggtgttgatgatatctactatgttgccctaatcaacaacatgctatgggatcaaagagtctttcatgtttttgaaaagatggacaatgactccaaacacactgtcataaccaaagctgaagagaagtcaattccacaaaggttgatagacctcagtgaaactattgatgataaagaagaaatgcacaaactattttctagaagtgaaagcaacaaggagagtgttgcctcatcatcatcaggcaatgagtcctttgaaggctctcatgtctcccctctccgcaagcgtccattttctacaccaaaacaatgtccaactccatcccctatccacttagagaatccatcaactaaggtcacaccagcaatagcatggagaaacctccaaaagtacaaggataagaggagcactcaaaacaatatccctaaagatctatttgagaaatataggagggatccttcacaagaagtggaaccacttaaaaactactctatgcttggtggaccacatgcacaaatgtacattcgaaataaagcatctgtctatcaaccaggactatacatctcaaaggccaccgaaatcaaagttgttgtagatatggtgtccatttgggatactgctaagaaaaaaggcttcaaattgtactataataaagaaatgccttcaaggaaagtgaaagttgaactaacgtatcactttggtgatgcttgtgcatgtttcaccaaggatgctaacaactacacattcatcaaatgcctaatgagtcttccaattgttcaacacaaaactacttatgatctctccaagatggacaaacatgaagtcatagatcatgtgactaagctccatgatactcaaaaggagaaaaaagatgaagaagtagaactagctgctactactacgaaggggaaatttgcttttatccaagttgaagcttttgctaaaactatggacaacaacattgtgcatgaggtcattattgatcttacaaacactggtgtcatggacaaaactccaaaggcttgcaatgcagctctagctgataaggatcagatgactatgttaggagctattgttgcacttatccctattcttgcatcggcacctgcaccctcaccccttaaaccaatccccctaccaccaccctcgtcacctccacctagtcaacctccaccaccacctcaa

SEQ ID NO: 56976 - DNA, 780 bp, Glycine max
  Peptide Sequence Number=SeqID_148661
atgaagaaaaagaaacaagcaaccactaagccatcgggtgaattttcttccattgattctccttcaccagaaaagccacttgtaattgatagtatggccagaagaggaggagaaggaaatataccagctatgaggactcttggtgactatgcttatcaacaaggaccaaagcattacaataaaatagtcattcctcctttcagtaacaagggttgcagtaccatgggagcttctgacgaagatgctgaagctatctacctcagagctttcctattctttttggcagattcatcagtgcaaaatcagccattgctactttttcccaagggtctgatgaacctctttgtgaaacatgggagagatttaagtcttcactgtgaaggtactatgatgtctaagggcccggaggaagcaattctaatcattaactccattgcaaccagtgattatcagagtcaccacgatagggctttgattcaaagaaaagaggaggcccattatttgcagaatcaaaccagacctcatcagaacttccaaggaaactaccaaggctacaaaggtccttctaacaactttgatgcaggtccttcaaatacgggtccacaacaacaacaacaagctcaactagatagaatggcggggctcacgggtgcgctttccaaaggaggaaagatgcgtggagtcgccaccaacgtcgacaaaagcggggcttttgctcctacgtaccctcctttggagaggaaatcagacctacgtagttcttccttatgcgtggatcaa

SEQ ID NO: 56977 - DNA, 420 bp, Glycine max
  Peptide Sequence Number=SeqID_148662
atggcggtgcgtctgttgcccgctgctggccatccccaggctgctgtggtgttttgccctgagcctgcctggagacgcagcccttgctggagagctggaaacccagggccctgttggacttctccgggtccactgggtgtctttgtgggtgcgattcctgcaaacaatagatgggggagattggcattatggtcgccgggcagaatgttgctaaatagcaacgtcatccacgtaagggtggtcatgttggtgcgcatggtccgcactcatctttttgcagcggcacgggggaaatcttgccccggtatgcatagtagatgtgtgatagcctccctctctggatgtgctcgcacaattggtcgctctctaatatcagggggtggcccagggactgataaaaggaaactactggccccttaa

SEQ ID NO: 56978 - DNA, 507 bp, Glycine max
  Peptide Sequence Number=SeqID_148663
atggactggaaaatctttttattgcgcgtcacggtcgcgctgattctgggcgcgctgattggcagcgagcgccagctgcgtcagcgcctgaccgggctgcgcaccaatgcgctggttagcaccggtgcctgtttgtttgtgctgatgacgcaaagcgtaccgggaattgccgcagatgcctcgcgcgtcgccgcctatgtggtttccggcatcggctttcttggcggtggcgtcatcatgcgcgatggcctgaatgtgcgcggccttaacaccgccgccacgctgtggtgtaccgcggcgataggcgtattatgcagcatgggcttgttgctggaggcaggcatcggttgcgtggttattctgtgcgccaacatcctgctgcgcgagctggcacagggcatcaatcggcagagcatcattactgcggaagacgccagccagtattacaaagtacagatcatctgtctggcggccgatgagtgcagtgcgcagcctgatgctgcatag

SEQ ID NO: 56979 - DNA, 3045 bp, Glycine max
  Peptide Sequence Number=SeqID_148664
atgcagcatccgggcgcacgctttattgccggcggtaccaatctgctcgatttgatgaagctggaaatcgaaaccccgtcgcacctgattgatgttaacggactggcgctggatagcattgaacccatcgccgggggcggcttacgtattggtgcgctggtgcgcaataccgatctggcggcagatgcgcgcatccggcgcgactatgccgtgctgacgcgcgcgctggtggcgggcgcttcaggccagctgcgcaatcaggccaccaccgctggcaacctgctgcagcgcacgcgctgtccctatttttacgatgttaatcaaccctgtaacaagcgtcagccgggtacgggctgtgccgcacgcgaaggattcagccgccagcacgcggtggtgggtgtcagcgaagcctgtattgccacccatcccagcgatatggcggtggcgatgcgactgctggatgcggtgattgaaaccgtcagccctgatggcagccagcgcgccattcccatcgctgaattctactgcgcaccgggtgacacgccgcatatcgaaaccgtgctgcagccgggtgagctgatcgtcgcggttaccctgcctgcaccgctgggtggcacgcacatttaccgtaaggtgcgcgatcgcgcttcttacgcctttgcgctggtctcagtagcagcggttatcctgcctgagggtggcggccgggtggccgtcggcggcgtggcccatcagccgtggcgcagcgcggcggcggatgctgaacttcctcacggggcgcaggcggtctgcgatgtgctgtttgctgatgcaccgcacgctcgcctcagcgatcgcggaagcgaggagcaacgcatgaaatttgacacaccagcaaccgccaatcctatcgatcggcagcgcgtcgtcggccagccgctggcacgcatcgacggtccgttgaaaaccactggttcggcgcattacgcctatgaatggcacgctgaagcaccggatgcagcctacggttatgtggtcggcgcgccagttgccaaaggcaacattatctcgattgacacccacgccgcagcacaggcaccgggcgtgctcggcatcgtcaccggagtaaccgccggcaagctcaacaaggcagagcgcaacactgcgacgctgctggcaaataataaaatcgaacactatcaccaggctgtggcgctggtggtggcggagacctttgagcaggcacgtgcggccgcgcagctggttaaggttaactgccaggctgaaacgggggcttacgatcttgaagcggcccagccagaggtgacaacgtcacccgaaggtgagccggataaaacactgggcgacgtcgatgctgccctgcacagcgcagcctttacgctggacgccacctacaccacgcccgatcaaagccatatggcaatggaaccgcacgcttccatggcgctgtggcaggacgatcacctgacggtctggacctcaaatcagatgattaactggtgccacaccgacctggcgcacacgctcgacatgccgatggaaaaggtgcgcgtgctgtctccttacgtcggcggtggcttcggcagcaaactgtttctacgtagcgatgcgctgctggcggctctgggtgcgcgcgccgtgggacgcgcggtgaaagtgatggtgccgcgcccgatgatccccaacaacaccacgcaccggccagcaacgcggcagcgcatccgattagctaccgatgcgcatggccatctcaccgccattgcccatgaaagctggtccggtaacctgccgggcggaacgccggaaactgcggtgcagcagactgaattactctacgccgccgccaatcggcttaccgggctgcgcctcgctgaactcgatctgcccgagggcaacgcgatgcgtgcgccgggtgaagcgcccggtctgatggcgctggagattgccatggatgaaatggccgccatcgccggtatcgacccggtagagtttcgcatcatcaatgatacacaggtcgatccgctgcatccggagcgcttcttttcacgccgccagctggtgcaatgcctgcgcaccggcgccagcaaatttggctgggcggagcgctgtgctaaacccgggcaacggcgcgaggggcgctggctggtgggcatgggcgtggcagccggtttccgtaataacctgctggcgccctccgccgcgcgcgtgcagttggatgcgcaaggcacaatcaccgtcgaaaccgacatgaccgatatcggcaccggcagctataccatcatcgcccagacggcagccgagatgatgggcgtgccgattgagcaggtcagcgtgcggctcggcgattcggcgtttcctgtctcggcgggttcgggtggccagtggggagccaatacttccacggccggggtttatgcggcctgcgtccggctacgcgagaaggttgccgcacagttgggtctggatgcggaaagtgcagagtttgccgatgggcacattcacgccaacgggcagcgcctgccgctcactgcggcgggtccgctgatggcggaagagaccatggaattcggcgatcttgacaaaaccttccagcaatccacctttgccggccattttgtcgaagtggcggtcgatagcgccaccggtgaagtgcgcgtgcggcgcatgctggcggtgtgtgctgcggggcgcatcctcaaccccaaaaccgcgcgcagtcaggtgatcggcgcgatgaccatgggcctcggcgccgcgctgatggaggagctggcggtggacacccggctcggctacttcgtcaatcacgacatggcaggctatgaagtgccggtacacgccgatgtgcctgagcaggaggtgattttcctcgatgacaccgatccggtctcttcgccgatgaaagccaaaggcgtcggtgaactggggctgtgtggcgtcggtgctgcgctggttaatgcggtctacaatgcaaccggcgtccgggtgagagactatccggtgacgctggataagttactcgccgcgctgcctgaccagccgtaa

SEQ ID NO: 56980 - DNA, 804 bp, Glycine max
  Peptide Sequence Number=SeqID_148665
atgatcaccatttgtaccgcctgcggcacgtcgtatcagcagcagcaacctgcccttacgcagtgtcgcatttgtcaggatgaacgccagtttgtgccgcccggcgggcagcagtggatcgatcagtctgcgctgcgcgcctcgcatcaaaaccagtggcaacagctggcgcccgggctgctcagcctgcaaaccgtaccagattttgccattaaccagcgcgcctttgtgctgcaaacgccgcacggcaatatcctgtgggattgcatcgcgcatctggatgacgccaccgtcacgctgctgcgtgcgctcggcggcctgcacgccatcgccatctcccatccccactattacagcaccatgcaggactgggccgacgccttcgacgcgccggtgtacctgcacgccagcgacagcgagtggatcatgcgcgcatcgccccgtctgcagccctggcacggcgacagctgtgatctgctgccgggcgtgcggctgttacgtctgggtggccactttgccggcggcacagtgctgcactgggcgcacgacggcggcgtgctgctgagcggcgatattttgcaggtaacgcccggtgccagtgcagtttcgtttatgtggagctatcccaatatgttaccgctggccggcgccacggtggcggccatgctgcaacggttgcagggcgtgaagtttacgcgcctgtacggcgcgtttgccggccgcgaaattctcgcgcgtgctgatgaggcagtgcagcagtcgggccgccgctatctggcctgtctgcaacatccacagccatag

SEQ ID NO: 56981 - DNA, 330 bp, Glycine max
  Peptide Sequence Number=SeqID_148666
atggatgggattctcatttctagtgtggtgttgttggctgattcacgattcactcgaccggatatgggttttcacccaacaaaactcaatttcgtgcctagcgatgcggatgaggcgccactcgatgtttccatttgcctgcatgcctttggtattgtgggggtgtgggttcgtttagtggtgtcaagtcttgcgaacgtgagggtgctgacgattggttcctgtgttgcctacctaccaaacggtattcgtgtggctagtcagacccattccatccaggcctctttgttggggacgctggaggatttcaaagtcccacacgtgaaccac

SEQ ID NO: 56982 - DNA, 228 bp, Glycine max
  Peptide Sequence Number=SeqID_148667
atgcgaagggtttcctctaagctcagatatgattttgaaattctcaacggtgagaatgttcggaattgggttgcgaatatgatactcaaatttcatgacaatccaacggtgaacgggttcgagatcgttgtttttctgagacaggtttggtgggctgcgggaaaaagaaagggttttgagagaaggggaaaaacgaaaatgaagccaaaaaggaggcagctgacttaa

SEQ ID NO: 56983 - DNA, 231 bp, Glycine max
  Peptide Sequence Number=SeqID_148668
atgggcactattagcaaaatagtcatggataatcattcatggtgttatccagcttgcattcaatgtcataggaaaaatgacatccaaacaggaccattcacatgcggatgtggcaaggataatgatcagcctgttatgaggtatagagttgaagtaatggatggtgatcttgatttgaatgcttcccctcaagcacttgacaagctgttgggttatgtgcttgcttttaag

SEQ ID NO: 56984 - DNA, 333 bp, Glycine max
  Peptide Sequence Number=SeqID_148669
atgggttctccacctgcctccactcctcctcctcctcctcctcctccacctcctccttctcctcctcctcctacttcggacgcatcggcttcgacgtctgccatgaagcggacacgcaaagcctcacgtctacgatcgttgtccactagaccacctcgtgttgagagactcgtggtgcatgttgatcctgctaccgggaaggccgacggtccccataggaaaaaattaagaacatatttagggattgtggcacgtgataaggtggacatcacctacgagaactggaaggtggtccctactgctcagaaggacctgatttgggaggatatttag

SEQ ID NO: 56985 - DNA, 804 bp, Glycine max
  Peptide Sequence Number=SeqID_148670
atggcgtcatcggaggttatatcatggatggctaagaattcacacgcgagggagaacttcgaagctccggaggaagatgaagaagtccgagctctaaaattggagctagggaaggcaagactcgccaaggagaagttcaaatcagctgctacacacatctggaaagagtgcaccgagttacaagaggaaaacgcggccactgcaagagtccttgaacaagaaaccaaaaggacccgcaaggaggaatatggccgagagaaattccgaggagtgttgtggggtagcaacaatgagctcaagctccgaagagaggaaagagatcggtcacgggtgcatggcatgatcttaaaagaagagttagttgcttgcgcgaggtccaaaaggagtttggctcaacacttggaagccacggagcaaagcatgctagctatcatagggcaatacaaggaagagttgaaccagtctgtggcccatgaacaaaagctagtggaggattttgcacaagtatacgctgaaaaagaagcaagagggagggtgattgatgcattgcatcaagaagcgactatgtggatggataggaatttcatcataactaagaaagcacaaaggtacccctataacactcgatccagaaaaatggataatgaagagggcgtgcaggaacagatgaaggccgatctatcggccttaaaagaccaaatggcttccatctcggaggtcatgctaaaactccagaaaaccatagaggataaagccaaggcaaacgcctccagtacagctagggaagcggagccggtgctatag

SEQ ID NO: 56986 - DNA, 375 bp, Glycine max
  Peptide Sequence Number=SeqID_148671
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggccagctcagcagaccaaatcagcctcagatgcaagggttgggtgctaagcgcttgagactcgcggcttag

SEQ ID NO: 56987 - DNA, 255 bp, Glycine max
  Peptide Sequence Number=SeqID_148672
atgactaccctgacccagacatggatgacgttgcttctcagcaacatcctgcccagcgatcataattctgacctccctctgtcgaagtgtatgccgcctaccaggcaccctctagacccaaataagtctaacagggccctgggttttccagcattgatcatgggtctctgccagtcgttcggggttcctgtcacacctagtaaggtgattcgaccgccgatcacccaggctttcatagagagcgatgccgcatga

SEQ ID NO: 56988 - DNA, 426 bp, Glycine max
  Peptide Sequence Number=SeqID_148673
atgaagtggaagataggccgcaccaagaaaactgaccgaatgacgtctgaggcagcaaaggaaattgctgagaagattgaaagattcattggaggagcaggcctcacatggttcctttgtcgcccatggacgttaggatgtactgactgttgccattgggcgaccagaacacgctggtcgtgtgcgtgctgctggagccggtgtcaccatcaagcaatactttggaccgactctaaggacctcctgcacgtcttcctccatggctctcgaagacctggagtagctaacgcaacaaatcagggaccagctggaggagtcgatcacataaaaagtgactcaacagctaatattatccttcagccagatgcaatcccagttttagtcacagatgcaatcacatggactcgcactgcctccagagcctaa

SEQ ID NO: 56989 - DNA, 528 bp, Glycine max
  Peptide Sequence Number=SeqID_148674
atgggacacaccgaaggtggtgaagggcgtgagtttcctgctccgtctgaccgtaacagcggacgacggcagctgacagtccgggcggtaaatgcgtgggggcagcagggcgatccggcgtcggtatcgttccggattgccgcaccggcagcaccgtcgaggattgagctgacgccgggctattttcagataaccgccacgccgcatcttgccgtttatgacccgacggtacagtttgagttctggttctcggaaaagcagattgcggatatcagacaggttgaaaccagcacgcgttatcttggtacggcgctgtactggatagccgccagtatcaatatcaaaccgggccatgattattacttttatatccgcagtgtgaacaccgttggcaaatcggcattcgtggaggccgtcggtcgggcgagcgatgatgcggaaggttacctgatcgaattcctgcagcccgggggatccactagttctagagcggccgccaccgcggtggagctccaattcgccctatag

SEQ ID NO: 56990 - DNA, 509 bp, Glycine max
  Peptide Sequence Number=SeqID_148675
gaactctcctgcctcctctagcgatacttctttcttgccacagccatcctttttctccgaaagaccattcactgggatattctcgtttggagtggggatcatttgtcattttgttcttccgctatctttgcctttcctttaacatttgcgggctatgtcggcaggtcaggaggtgcgaccacgcgaccgctgcgtgtcatgccactcagccccatgatattggttaccttggccgacaacgagctgatgtcggtggcttcttccttcctatcgcttggaggcgcatacctccatgggactgcgtggctgttttggtatggaaacggaacaagtttaactaccaatgggtatcaaggcgtttggggagcagcgtctctggtgaaatataccaccaaaggcttaggccttccaaaacttccctcatctgcggactgcatacatatatgttgctcttcactcccctcatcgtcgacttccagccggcctcggtctatcatctgttgcaatag

SEQ ID NO: 56991 - DNA, 246 bp, Glycine max
  Peptide Sequence Number=SeqID_148676
atggatgtccaactaaggcaaggccttataagccaaatgaaaggaaattggactctcgaagtgagcaactactttattggttattctgaaagatccaggggctataaattttatgatcccaaattaaagacaatttttgagacgggaaccgccacattctttgaggatattgagtttggggggaagaataaggaatatgagaaaaataatggtatgatggaagatgacccagtcaacttccattaa

SEQ ID NO: 56992 - DNA, 288 bp, Glycine max
  Peptide Sequence Number=SeqID_148677
atggagatattccatatgaaagttaagctatggctaattaatttcttatgtccaaaagaggaagaagaagaaacaaaaacttcatcctctgaaatttatgatgaaaacctaaacctaatccaacaggatgaccaactatcatcaacagatgatgatgacggacaagtcaatactctaacgagagaacaagatctcttgtttgaagcaatcaattccatacctgacccccaagaaaagaaggttttcctggaaaaacttaaaaagacattagaggtaaaacccaggtaa

SEQ ID NO: 56993 - DNA, 324 bp, Glycine max
  Peptide Sequence Number=SeqID_148678
atgcacacacaaagtttcacaattccacactttcctaaaataggcctaactcacaaaaacaatccccagtggagtcgccaactgccgcaacctacccttttgcgggccagcgaggcgaggctcacgggtgtgtcttccaaaggaggaaaatgcgcagagtcgccaccaacttttatttgtggaaaacgtcagaaaaaccaaaggaaaccggtcatgaagaatattccagattcgggagttgtatttacgtttgaggaaggtcgacaaaagcggggctcttactcctacgtaccctccatcgaagaggaaatcagacctacgtag

SEQ ID NO: 56994 - DNA, 381 bp, Glycine max
  Peptide Sequence Number=SeqID_148679
atggttaataattcatcttctacaataaatgctttggacaggcaaagtagtgttgaagtcatggaacaagaaggtggattatgtgatgggatagaagttgatcagtttcatcaaccgtctggtagtaatgaggttgccattgctaatgaggatggtatttcatatggatcagagctcatagaggttgacaaagtaaaaataaatcaaggtgatttgttgtttgggggggatgcttcagatggtgctctctgggatatttttcggagacaggatgtccctaagttgcaggaatatctgaagaagcatttcagagagtttaggcatgtccattgctgtcctttaaagcaggattgggtgaaggatcaagctgctaataattag

SEQ ID NO: 56995 - DNA, 105 bp, Glycine max
  Peptide Sequence Number=SeqID_148680
cctcgtagtgaggaagagcagttgattcttgcaaaaagaattttccaaggacgagaaatagttgaaggattttttgatggattaagtcaaatgactcctatgtag

SEQ ID NO: 56996 - DNA, 840 bp, Glycine max
  Peptide Sequence Number=SeqID_148681
atggacctggatgccgtgctcgcgcggcacccagcgctggtactagtggatgaactggcccatcgcaacgcgccgggcagccgccatgagcggcgctggcaggatgtgatggagctgctggacgccggcatcgacgtctggaccacggtcaacatccagcatctggaaagcctcaacgatgtggtgatgcgcatcaccggcgtgcgcgtcagcgagaccgtgccggacggtgtgctcgaccgactgcacgacatcgtgctggtggacctgcccccgcgcgaactgatcgcgcgcctgcagcagggcaaggtctatgtgcccgaacaggccgcgcaggcactgcaggcattcttctcgccggccaacctgaccgcgttgcgcgaactggccatgcaggaagctgccgaccgcgtcgacagcagcctgcgcgaagcacgcgccgcacgcggcgagagcaacctgcctgttcctgctcgcggcgtgctggtggccgttgatggcggcggcatcagagtgaatacctggtgccgccaaccgccatgcgcgtggcaggcgcatcgccagcgccgccgccgtggacggagaggtggcgcaggggcgacgccactggacaggccatggacggccggcgtgagatcgagcgccataccgcacctggccgcgccagcctgggataccattggccgccgccgactgggcgctgcgccacggatccagctcccatgcggccgcttcaccgacactctggccggcgcgcaatggtggttcctgccgctgctggatggcgaagaccgcgcgatcggcgtggccggatgtactgcccggcgcgcagcctgctga

SEQ ID NO: 56997 - DNA, 219 bp, Glycine max
  Peptide Sequence Number=SeqID_148682
atggcaattttgatcgccaatacttcaacaacatttcatagggatgaaagactcgggaatacgcatgctatgcatggaaaatttaagaagacgatatggatcttccaacttcccacgacaaaagacgagacccacatacaacgcatgtgtgacggcatgatgcagatgcgcaaaagcgcaacagggggatttacacagcatggcaatatcctcaaataa

SEQ ID NO: 56998 - DNA, 630 bp, Glycine max
  Peptide Sequence Number=SeqID_148683
atggcagagccatcaaagaagagaaagggatcatcctccaccgctaccgctgctgcccatcgccgtcacggcccatccggagcacccacagcacctattcctccttctttgtcatctccaagatcatcaacactgttttcatccgatgatcaacgtctacggtacctttctcagttttcttctagaataatcttagatcctaagtacctagacgtagagttctttaatgatgaaacgtttgattgctatcaagtgtttcaaaactctggtcttgttgatttcatgtcattaaaattgccatattatcctgaacttgttaaggtcttctactgcaatttaaaaattcaggatggtattattatgtctgaggtgcatggtacttctatggtcattgatcagtcacttttcttttctttgactcatttacccagtccaggtgcaccttttgagggcaccattgttgatgactggaaattcgattattcaagtcatgatgctcgtcgcatggtctgcaatgatcaagctgaaatgaccggtagattgctggccggatcgactgggcccatttggttcggtaccgaatgcataaggcattacgggccaatgcacctcttccttatccacatttga

SEQ ID NO: 56999 - DNA, 258 bp, Glycine max
  Peptide Sequence Number=SeqID_148684
atggagtcgccaactgttgcaacctacccttcggcgggagggcgatgcaagactcacgggtgcgtcttccaagaaaggaaaatgtgcggagtcgccaccaacgtttattcgaggaaaacgtcagaaaaaccggaaatgacgtggtctacgaactttaagtgtgaaaggttcgggagttgtatttacgcacggggaaggtgtttcccttgctcctacgtattcctcaactatgataaggaaatcagacctattttttag

SEQ ID NO: 57000 - DNA, 312 bp, Glycine max
  Peptide Sequence Number=SeqID_148685
atggcacgcagagaccaagtttggtcattctgcacccatgatacgcggagataccttacggttatccgcacccctttgccattcagacacagtcgtgtccgatggcatgcagagaccaagtttggtcattctgcacccatgatacgcggagataccttatggttattctgcacccattcttttgctatctgtaagacagaaagcttgatgagcatgcagaggctgacacagtcttctgcaccttttgatactccgggaacaacaaagcataccttacatgcggaaattatctgcaccccttttgctaggtag

SEQ ID NO: 57001 - DNA, 818 bp, Glycine max
  Peptide Sequence Number=SeqID_148686
atgccgtcacttcagcgcccgcatgggtcaagcccccgcagacctctcatgcctaaggcacccatccagagggaggccccccaagctctggctctaaccacgactcgcccggccgacaattccaacgcaatgaggaaactttcccccgaagccaattccagaattcaccccactcctaatgacgtacgaagacctcttgccgtcccttatcgccaaccaaatggccgtaataactcccggaaagatctaccaatcccctttcccaacgtggacgtggcaacccctaggaggtttatctttgaggccctacaaaagggaggtgtgattccccacggtgggcataaagaggattcttgtttgttgcatcccggcgagctacataacatggaaacatgtttggcagtagaggaattgttgcaacaaatgatggatcaaggccgcctggaagtcggtgatgaggggagggaagaacatcatatatatatgcagtccgcggatgcgagaagttttggaaggcctaagcctttgaggtatacacctccgagtgaaagggaagaagaagaagccatcgacataagctcattgtcggccaaggaaaccaatatcacagggctgagcggtgtgacccgcagcagtggcgtgtttgcaccttccgacctgccaacacaacccgcaaacattaagggaaaggccaagatggtggaggaacaaaatgacaagacgaccctcactccgaacgaggatattccggtaaagggtctttcggagaaaagggatggctgcggcaagaaggaagtgtcgctagaggaagcaagcga

SEQ ID NO: 57002 - DNA, 552 bp, Glycine max
  Peptide Sequence Number=SeqID_148687
atgaaggaattctatgcaaatctatatgaccctgaggacaagtctcccaagcaactcttgaggaaagatcttaccactctggctcaaacctggagtgttctatcttattctaacttggccccgacatcctatacttctgaccttaatctggatagggccagatttcactcattgctcagtccaactcctcgaggcttggatttccagcccttatcactgccttgtgcaagacccgaggagtcacctcagattttctcacttatgagtctattagcccaggcaagcctgcgtctaggccagcttctggttatgcagagtttgcaggatgtggttcagcagaggcctgttatgagtatggaagaattttcacagagggtgacctggccaggagtccagccttctcctttgggagggggtgaggcctctgcagcccaggaacctcagccaaaccaggaggatgactcttctgaagccactctcactccaccagagccatttatttttgaggatgatctagtggctgatccagtgaccgcagaaggtactcagtag

SEQ ID NO: 57003 - DNA, 317 bp, Glycine max
  Peptide Sequence Number=SeqID_148688
ttttccctaagcaatttcagcacataaacatcacaagcatcatcataaaaaccctaaaactgaatggaaacctagcaaaactacccatcatatctcccaaaacccaatacccacgaaaatcaagtgagaaagaagtctacccaaacctgaaatttcgaggtcccacacgtagagatgcgcttcacgacttcgaaaatgccttcctttcacgatttggagcagaaatgggcacaaaaggttggagctttaatggagtttcaatggaggatgaagaagaagagaatggcaacgtgagagagagaaaagagcttttctga

SEQ ID NO: 57004 - DNA, 246 bp, Glycine max
  Peptide Sequence Number=SeqID_148689
atgcgggaagcaaagggtctgcaagaagcaagaagtataaggcccaaacggaaggcaataatctcagcccaatatgatatgaatgaaaataacaaagcttcctttctctcttcttcctctgaaggcaccggtaacctcgaaaccagcttatcttctccttcttcttccttgtttttggaggttctgacccttgaagttcagcaacaagcacaacacgtaacatcattcctccgaatagcaaggtag

SEQ ID NO: 57005 - DNA, 691 bp, Glycine max
  Peptide Sequence Number=SeqID_148690
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcgactctagaggatccccctccgccagtattggcagcgcctggttccgccgcggcacgctggacgtcaatcaggtcattggtgataccaccgcggtgcgcctgaatgtaatgggcgaaaaaacgcacgatgccggacgcgacaaagtcaaaaatgagcgttacggcgtcgccccttctgtcgcttttggccttggtacagcgaatcgtttgtatcttaattatctgcatgtcacccagcacaacacgccagacggcggcattccgaccatcggtttgccgggctattctgccccatctgcgggaacggcggccctgaatcattccggtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 57006 - DNA, 366 bp, Glycine max
  Peptide Sequence Number=SeqID_148691
atgtctcttgccactttatttggaaagttacaggaacacgagatggaattattgagattacgccaacatgaagaaaatgacaagaaaaagaaaggaattgctcttaaagcatcatcttcaatccaagaagaaagtgataaggaaaatgatctagatgatgatgatgatttaagcctttttgtcaaaagattcaacaagtttattaaaaaaaagatggagaagtctgaaaagaaaaatcttagtgaaaagaaattgaagaaagcatacatcacatgggatgaaaacgatatggaatcttttgaagattcagaaaatgaagagataaatctctgccttatggctaaaagttatgaaagtgatgaagag

SEQ ID NO: 57007 - DNA, 428 bp, Glycine max
  Peptide Sequence Number=SeqID_148692
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgatccccgatgatacaattgataattggaaacatgtccctgcatctcaaaaggatttgatctgggaggatattcagactgaatttgatattccagaagcatttgattcgaggacaaagaaaaatatacttcagacagtagcagagtggtggaggcc

SEQ ID NO: 57008 - DNA, 469 bp, Glycine max
  Peptide Sequence Number=SeqID_148693
atggcgaggacgtgtagtcctctaaaggtgaagatgtgtagtcctctgaaggtgagggtgtgtagccctacaaaggtgaaggcacatgaccctttgacggtgaggacgtgtagtcctctgaagttgaaggtacatgaccctttgaaggcgaggacgtgtagtcctctgaaggtgaaggcgaggacttatagtcctctggaggtgagggcgtgcagccctctggtggtgaggacgtgtagtcctctcaaggcgaggacggcgtgcagccctctggtggtgaggacgtgtagtcctctcaaggcgaggacgtgtagtcctctgacggtgagggtaactagtacccaagggcgtgtagccctctcaaggcgaggacatgtagtcctctggagggtgagggcgtgcagccctctgatggtgaggacgtgtagtcctctcaaggcgaggacgtgtagtcctctcaacggtgagg

SEQ ID NO: 57009 - DNA, 390 bp, Glycine max
  Peptide Sequence Number=SeqID_148694
tcgcgcgctaagtcgagcttcctgggccaagcgcatttcattgcggcatctgctgagccaagcgagcctcgctcactaagctcccaatacttaatggcttctaggaaacgtaaaagtattggttcaagacccacatcgcagtatgacacaaggagattctcttccttagatgcttggaccagatacatagataatgtgctggggagaaacattttaccagagaggaaagtagagatatatcactctgagctagatgagtttaaggctgaattggagaggcgtaatttccataaacaccccaccaatttagtcgatgggagcatagacgtgactttggtgaaagagttctatgcaaatttatacagttctgaggaccatccaccaaagtag

SEQ ID NO: 57010 - DNA, 960 bp, Glycine max
  Peptide Sequence Number=SeqID_148695
atgttcccgaccatgttctttaccgtggtactggccttcgtggccgtggtgatcctgttcaaggccgtacggatggtgccccagggctacgagtggaccgtcgagcgcttcgggcgctacacgcacaccatgactcccggcctgcatttcctgatcccgatcgtgtacggggtggggcgcaaggtgaacatgatggagcaggtgctggatgtgcccagccaggaagtgatcaccaaggacaacgccgccgtgcgcgtggacggcgtggtgttcttccaggtactggatgctgccaaggccgcctatgaggtggccaacctggaagtggcgatgatcgccctggtgcagaccaacatccgtaccgtgatcggttcgatggacctggacgaatcgctcagccagcgcgaggtgatcaatgcccagctgctgagcgtggtcgaccatgccaccaatccctggggcgtgaaggtcaaccgcatcgagatccgcgacatccagccgccgcgggatctgctggacgcgatggcgcggcagatgaaggccgagcgcgaaaagcgcgcgcagatcctcgaggcagagggttcacgccagtcggagatcctgcgcgccgatggcgagaagcaggccaccgtgctcgaggccgaaggccggcgcgaggctgcgttccgcgacgccgaggcgcgtgagcgcctggccgaggccgaagcgaaggcaacccagatggtgtcggcggcgattgccgaaggcgacgtgcaggcgatcaactacttcgttgcccagaaatacgtggaagcgttcaaggagctggccagctcgccgaaccagaagctggtgctgatgccgatggaggccagcggtgtgatcggttcgatcgccggcgtggccgagctggccaagcaggcactgggcgaccagaacaccaaggccgcgggcaagcggccgccgccgatcggaggctga

SEQ ID NO: 57011 - DNA, 372 bp, Glycine max
  Peptide Sequence Number=SeqID_148696
atgaggggcatcgtgcatgagcctcaagtgaacataggggcagatcaaaaaggactgcacgtcctcaccttcagaggactacatgtcctcaccttcagaggaatccacgccctcgccatcagagggctacatgccctccccttcagaggactacacgtcctcgccttcagagggtcatgtaccttcaccttcagaggactacacgtcctcgccatcagagggctgcacgccctcgcctctagaggactacctgtccttgccttcagaggactacacgtcctcgccttcagagggctacacgccctcgccttcagaggactacacgtcctcaccatcagagggtgttggattgagtggcctcagaataattaa

SEQ ID NO: 57012 - DNA, 437 bp, Glycine max
  Peptide Sequence Number=SeqID_148697
atcgcgatggtagtgcagttgatccatgtcgagttgtgatggagtgcctagagggtgtttggcagaccctcgaaggcaatgagaggtgccgattccgtggcacgattcaactcactgctacttcattagtacatccgaaggaacccgcacgcacacttcagcagcctgtggagtggatactacctacacctactccatatcgactagtggagccagttcaagtgatagaggtgtcatcctctgaagaggatcctgaagaggacctagaggagttacctcctgaacctactgtggatgctcttgacttcccagaggatgatgaggacccactccctgatgttgattctccagaggatatcatgtcagcatctgaggcagactctacagaggagagcggccctggagggacagcaaatagtgaagactcttcatcatag

SEQ ID NO: 57013 - DNA, 138 bp, Glycine max
  Peptide Sequence Number=SeqID_148698
atggatacctcagagccctacactggggcaatgagaggcaccatgcatgagcctcaagcgaacctaggggcagatgaaaagttctcacccattagcaaccctgagtgggaaccaccgctaaaccggcgggaagagtaa

SEQ ID NO: 57014 - DNA, 306 bp, Glycine max
  Peptide Sequence Number=SeqID_148699
atggccacaatgatagaggccatgatgagcattaagaagataatggaagccaatgcggttacagttgccgctaccagcgctgttgctaaggtgaacccgatgcccccatctggcctcaaccaaatgaatcatccaacctcggctatggtaggcaaagatttgggaagtacgggcggcccccattatgcgcaaattcaaaacaagcacgccttcccgccatgtggatcgcctcccaaggaggatgtcaataactccgctcccatactcattgaaagccgacaacctcatcatgcacatgtctcttaa

SEQ ID NO: 57015 - DNA, 291 bp, Glycine max
  Peptide Sequence Number=SeqID_148700
atgggccccgacgggtgcagagaaacgcgagggactggaaccagagaaatggcacgcaaaccgaggcaagattttagcatttcaaaagaaaaaattcagaagctctcctcaccttctcatgttgcttttcttctccccttctcatccaccattgttgcccaacaaagctgcaaactttgctcaccatttctactccaaatcgcaaaaggaagccattttcagagtcgtgaaacgcacctctacgttgtgggacttcaaatttcaggtttgggtagacttcttctcacatga

SEQ ID NO: 57016 - DNA, 165 bp, Glycine max
  Peptide Sequence Number=SeqID_148701
atggaggttgaggaaacctggcaagcgttatggctaccattgcattatcaagtagataagggagcaaggatggcctttatggataattgggtggtgggtaaggagaaaggttgttattggttgagtaatgacattgttaggttggtgggaaacttggccgtatag

SEQ ID NO: 57017 - DNA, 297 bp, Glycine max
  Peptide Sequence Number=SeqID_148702
atgttgtggaagcttggagggattgatggggacccggtgttgagaggaacgaggataagggctacgtgggagtacgtgagctcagttgaaggtgggcaactggggatggtggatttatttgtggatgtggagagtcgacttgcaccatcgcccgatcgccacctagtacaacatatgacgggtaccccaaaatcctacaagcttgaagcaagcacctggcagtcaaccgataaaagaacaaagaccacaaagcaaggaggcttgtgtggtggctggccagctatggatcttgagtga

SEQ ID NO: 57018 - DNA, 186 bp, Glycine max
  Peptide Sequence Number=SeqID_148703
atggcgcctgatgcgtacaatctgcttgatgccgcattcattaatgccagcctggcacgacaggtttcccgaccggaacacccgctgacgcgccctgacggcattgtctgctcactcggcatccccggctttacgactttatgctgtgccggtctccgtggtagctgcgaatgtgtcagaggataa

SEQ ID NO: 57019 - DNA, 384 bp, Glycine max
  Peptide Sequence Number=SeqID_148704
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggttctcccttcaccagtatcccaatttcgtgaatattaatcagtgcacgcttcgtgttcgattaattgcctctgagcctaacttgcgttcatgcttaatggacgaagggctaactggtgtatgtggtgcctaa

SEQ ID NO: 57020 - DNA, 933 bp, Glycine max
  Peptide Sequence Number=SeqID_148705
gtcgactctagaggatccctccccgacgaagctaatgaagagttgctatggaggcacttcaaaaactggggtgacgtacgtgaagtatacatcgctaaaaggctcaacaaggatggcaggagatacaggttcatgcggttcaagggagtctcggatgcaaaaggattggaggtgagactggacaacatcttcatcaacgattgtaaactatttgtcaaccttcctaggttcgacagaccagttcggaatacagagttgcagaaaaagaaccccattgggaggaagtacaccgacgaagcaagtaagccctgcggggtaattactggtgctcttcggagatcatatgtggacgtgatgactaagggggggtgccaaggagacaaaagggcagacgaggcacaaacaccaactattctgatcaacccagatgaaggcggggaatattggtgtaacgaaacctgggtgggcatgctaaagaaggtgatggaggtggaaaccttagaggatcgtatcacttgggagttaggatataacgtccgcactaagttcctcggagacgacatggttcttctccctgggatgtccgatgacaaagctcaactcctcattcaatcagagacggaaagcgatgattctctcttttactcactggagaagtggacgccgaaatgtagacccaataacagggttgtttggctccagctgtggggatttccgatacaggtgtgggaaatgaaaaatctcaggagggctgtagctgctattggggatgtcatcgagtcagacgatgacacagaggaccgccgacgattggaccgggctcgagtattggtgcggacaccgcttccgccgttgataaggtcggagagacagggttcgaaggtgggtcgaaccggaaaggaagctcgccgtccgatgggtggtcggagatga

SEQ ID NO: 57021 - DNA, 459 bp, Glycine max
  Peptide Sequence Number=SeqID_148706
atgaggctcgcctgcaacaacaagaacttggaggatagggtgcttgctttattgaataatgtcatagggttggagatgtgcaccttaaatgtcgtggccctggctaggtctcaagataatgaaattgctaggctgaggtcggtcgtggctgatgctaacaaggagacaaaggatgctaatgttaaaaaggaagggattcaacagaaggcctttgatgatgtttataacgcacatgagactggcttcaaccattgcctctggcaagtgctacacatgtgtgacgtctcagaccctagtgtgttcgacattaacaaggatgtgcatgaaagggagctaatgctgattgatgacatctcggaggatgatgccgctgtgaatgtatgtatacatgattttgatgatgtcaaagaagaatctaacaaggctgcttcaaatgataagcatttgcttcaagaataa

SEQ ID NO: 57022 - DNA, 326 bp, Glycine max
  Peptide Sequence Number=SeqID_148707
aacaccctggtcgtgtgcgtgttgctgaagccggtgtcacaatcaaacaatactttggaccgactccaaggacctcctacacttcttcgtccatgactcacaaatacttggagcaactaatgcaaaagatcaggtaccagctggaggagtcgatcatagaaaaaggactcgcactgcctcctgagcctgaggttgatccttcagttgcttctgtcagcacaaaggagagttgtcttgatctgtcaaggaacaatccagatgcggtcaaggttggtgttgaggaagttagagatgttgatgctcccattccagtacccaatgaagag

SEQ ID NO: 57023 - DNA, 347 bp, Glycine max
  Peptide Sequence Number=SeqID_148708
acctttgcccttctgtgcaacaatctgaagcaattgaacagcctgaagcttatgctgcaaacatctacaataggcctcctcaacctcagcagcaaaatcagtcacaacagaacaattatgacctctccaacaataggtacaatcccgggtggaggaatcatcccaaccttagatggtcgaatccttcacaacagcagcagcagcagcaacaacaacaacagcagccccaaaaacagcaaatagttgaggctcctccacaaccttcccttgaagaacttgtgaggcaaatgacgatgaaaaacatgcagtttttcaaagagagaccagagcctccattcagagcttaa

SEQ ID NO: 57024 - DNA, 489 bp, Glycine max
  Peptide Sequence Number=SeqID_148709
atgtgggcctttcatacagggcgtcaacttgactgggcacacttagtcagatatcgcatgaataaggcattgcgattaaatgctccactaccatatccacagcttgttactctatttcttcgtcattttgaaattcctcttgattctgaatcttatattccaatcaagagatcctttttaattggtgctactgcaattgtttcttttggttaccacaaagagcgtgatggctcttgggtcaaaaagggcactcaacccgctgatgaagaaggcaacctcccagatgaagataattccactcttcttcgcaggcttatggacaagtttgatggacttcagacttttgttggtgacaagtttgatgccatggaattacaagttgacatgaggttcgatgctatggaatcaaggatcaccagagttgaagaagatgtctctttcatccgaacttgttttgatccaccacctccgtctccttcatcctcttag

SEQ ID NO: 57025 - DNA, 536 bp, Glycine max
  Peptide Sequence Number=SeqID_148710
gaacgatcgttgaagccattctcaccccggttttccccggacgattacgaccagcacggcgcgctgcggctgccgctgggattttgggccgtgttgattttgcaggcgcgcacctggctgctgttcgtgatggccggcgcttcgcgcgagcagggcgaaagcttgctggcgctattttatccggatacccaacgtttttggtacggcatgctgctcggcctgccggcggcgctggcgtttttgctgagcggccgccgccaccaatggccgcggctgtggcgcggctggcgctgggggctggctgtctccctgctggcgtcgctcggcggctcgctgttcagcctgtggcgccaggacggcgatgcgccggggctggaactggcgttggcgctgctcgacgcgctggcgctaagctatctgttgctgaatgcgcgcctgaaagcctgctttgcgccggcggagcacgccgactaattgccgagaagtgcggcacttttcgcattttccgcactccaagctggcaaccgttggcgtag

SEQ ID NO: 57026 - DNA, 259 bp, Glycine max
  Peptide Sequence Number=SeqID_148711
atgtctagccattctacaagccttgagccaaaatcccgactcaccataaaccttgacccaggtggagaaaacaccgagactttttcaagtctcacaagtaatccagaactacgtaggtctgagttcctcattggaggatacgtaggagcaagagcctcgcttttgtcgaccacaccgccttttgttgccatgactcaagagctggtagcccgcggagacaccttacggttatccgcacctcgtcattcagtgatcccaa

SEQ ID NO: 57027 - DNA, 504 bp, Glycine max
  Peptide Sequence Number=SeqID_148712
atgtcatttttgggagaaacaagcagccagatcattgctaactctatattagccttcatttttctgaatggatcaatcactcacaaccaaactggtgtttactttcaaagtcccactccaacaccaatgcgagttcctaacgactgttcttttgatacactcaagcgtagaatgcacaacacccttcaactaaccaatgatcaattagtggatgaaatctactaccgacaaccattcatagatgcagaattattatgtaccattattagaacaccggatgttatactcaacctgcttcaatcaactatcactcctactcatgatgcacttatgtattacaacgggaagtggaacataccacgtcaaggtcagtttttgggttactcctttactagaactaatccaataagatttggcattccttcgggatgtagcatggacaaactaaaggatttaatcaagcaagttgcacctatagggaattcacgaatcacaattggttag

SEQ ID NO: 57028 - DNA, 468 bp, Glycine max
  Peptide Sequence Number=SeqID_148713
atggggacaaggggttgcatcaattacaatcccgttcttgcgataaggcaacttggctacccgatgagaggagcaccactagaggaagagctcacgcctgtcatttcacgaggtttcaatgagaccaacgtggagacacttcggaaggtccgcaaagcatgggtattgatgcaaaagaaggacaaagagctcaaaggcagtaacaatgggcccatcggtggctactttaggtggttgaaagcccatgtgcaaggtttggattggctcccgagtttaagaaccgctaaaggggaggaatttgaggcactggaggaagatgaagaggtgcagacccttagggcagaactcgagcaagcccaaatagtcaaagaaaggttcaaatcagcagctcttaggatccgaaaggagaatgccaaactaagagatgtaaatataggccttggaacaagagaccaagagggctcgtaa

SEQ ID NO: 57029 - DNA, 353 bp, Glycine max
  Peptide Sequence Number=SeqID_148714
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttcgtcaaaacagcggaatcagtaactcagcctgctggtgcctcgaaccattaccgtgaactgggcatgggttttctctccggaatactcaatcccaagaatgcgctgttttgggtaccgagctcgaattcgtaa

SEQ ID NO: 57030 - DNA, 627 bp, Glycine max
  Peptide Sequence Number=SeqID_148715
atggctaagagttcacacgcgagagttagattggctctccaagttgaaaagctagggaaggcaagactcgccaaggagaagttcaaatcagccgctacacacatccggaaagagtgcaccgagttacaagaggaaaacgcggccactgcaagagcccttgaacgagaaaccaaaagggcctgcaaggaggaacatggccgagagaaatttcgaggagcattgtggggtagcaacaatgagctcaagctccgaagagaggaaagagaccggtcacggatgcatggcatgatcttaaaagaagagttagctgcttgcgcaaggtccaagaggagtttggctcaacacttggaagccacggagcaaagcatgctagctatcatagggcaatacaaggaagaattgaaccagtctatggcccatgaacaaaagctagtggaggattttgcactagtgtacgccgaaaaagaagcaagagggagggtgatcgatgcattgcatcaagaagcgactatatggatggataggttcgcctggaccttgaatggaagtcaagacctcccgcgtctattagccaaagcaaaagccatggccgaagtgtgtaggcccccgaggagattcatgggctaa

SEQ ID NO: 57031 - DNA, 312 bp, Glycine max
  Peptide Sequence Number=SeqID_148716
tactgcacgcagagaaaaggtccagggtgatgcaccacaggccgcggacgcgccgccacctcatcaggctggcccagccgaattgtttgatacagagcaagccagggctttacttcttttccgtgccctactgtcataccctaatttcgtccggggacctttgcttgatgacatgcgacctttctttggtccttgtgagtcgaagtgcttctgtaacgcttccgtaagcgattctgtggaaattcttcatcgttcttcgtcgttcttcaccgttcttcatccgttcttcgttcgttcttcgttcttcaacgg

SEQ ID NO: 57032 - DNA, 784 bp, Glycine max
  Peptide Sequence Number=SeqID_148717
atggggacgaggggttgcattaattacaatcccgtcctcgccataagacaacttggctaccctatgagaggggaaccattagaggaaggcctcacaccttttattgcgcgaggtttcaatagcaccagcgcgagggtgcttcatagggtccacaaggcatgggaaatggtgcaaaagaaggacgaggaacttaggggcagtagcaacgggcccatcggcggttaccataggtggttgagagcctacgcacaaggtctgcattggctcccgaatttgagaaccactaaagaggtggagggtgaagctctggaagaagacgaagagaacgccgaactgagagacatcaacatagccaccaccaaggccttggagcaagagaccaagagggcccacaaggaagaacatggctggaacaagttccgaggggctctgtggggcagtaacagggaacttaagctccgaagagaagaaagggaccaatcgcgagtagatggcatgattctgaaggacgaattgaagacttgcctaagcaagtacaaagaagaattaaatttggccaccgcccacgagcacaaagtggcagacgaatacgcacgagtgtacgcaaaaaaggaggctagaggacgggtgattaacttaatacatcaagaagcgacaatatggatggaccggtttgctcttactttgaacgggagtcaagaacttccccgattactggcaaaggccaaagcaatggcaaacgcatactccacccccgaggaagtccacgggctcctcagctatt

SEQ ID NO: 57033 - DNA, 502 bp, Glycine max
  Peptide Sequence Number=SeqID_148718
gtatgccactacaaggcaccctctagacctagataagtctaacagggccctggggtttccagcgttgatcacgggtctctgccagtcgttcgaggttcccgtcacacctagcaagtattgcacgcctagacaggcacagggtgatgcaccgcaggccgctggctctccgccaccacctcatcaggctgatccagctgggtcattcggcatggagcggtatttccagcacttggttcaccagcaagcggccaaccacagggggcaggtgcagatccatgagtgtctctaccagctcagcctcagtcagcagagccagggtttcactctttttgtgtgccctactccagatcagtttagggctgaggtcacatggcccggagattggcccgaggaccagacagaggaggcacctgcaggagctcccgacggtgtagaggatgcccgcatggacgaggagatgacagatttactcgatttcttgggaggaagcggagccacgtga

SEQ ID NO: 57034 - DNA, 888 bp, Glycine max
  Peptide Sequence Number=SeqID_148719
atggatgattttactgtttatggatcatcttttgatgctttcattgcctatcaccatagcaaggaaatctcggttgtcgctatcttggccgatctctatgacacgttcgaccgaagatgcgtaaagaacggcacaagaattctttgttgtatgccagctctctatgtgtggctcgtctcacaccttttccgccaagaaagtaggcccacctgtccactgcatcgtcaccgcttatgcaccgagaagggaaaggcaaactgggagcaactcttggctagtgtggtaggggcatccatcaattggttcccccgttggaaggaaggaaaagttggagttttgtcctcattccgcaaggcatgggatgcggcgcaaaggaaggacaaagagcttaggggaagcagtaatgggatcatcggcggctatcataagtggttgagagtccggacacaagggttggattggctcccaaagctaagggctgcgagaaaggaagaggctgaaactccggaagaaagtgaagaggtacaagccctaaaagcggagcttgaacaagcccgagcagtcaaagagaagttcaagtcaacggccatcaaagtccgaaaggagtacgatgaactaaaagacatcaatatggccaccaccgaagccttggaacaagaaaccaagaaggccctaaaagaagaacacgaccgaaacaagttccgaggagctttgtggggcagatacaatgagcttaagctccaaagagatgaaaaggatcagtcgcgggtcgaagtcatgatcttgaaagatgagttaaaagattgtcataggtcgaaaagaagcttgtcccagcaattgagcaagactgaaggaaatatatgggccatcatcaatgattacaaataa

SEQ ID NO: 57035 - DNA, 588 bp, Glycine max
  Peptide Sequence Number=SeqID_148720
atgatacgcggggatcctttgtggttatccgcaccccttgatagacagacacagttgtgtccgatggcaagcagagaccaagtttggtcattctgcacccaagatacgcggagatactttatggcagacacagttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaagatacgcggagataccttacggttatctgcacccctttgctaggcagacacagttgtgtccgatggcaagcagagaccaagtttggtcattctgcacccaatgatacgcggagataccttacggttatctgcacccctttgctaggcagacacagttgtgtccgatggcaagcagagaccaagtttggtcattctgcacacatgatacgcggagataccttacggttatccgcacccctttgccattcagacacagtcgtgtccaatggcacgcagagaccaagtttggtcattctgcgcacatga

SEQ ID NO: 57036 - DNA, 132 bp, Glycine max
  Peptide Sequence Number=SeqID_148721
atggagttggagcagggttgtgcagggtgttactatttgggtgggttagatatggacttgtggatgctgtttggggtggcatatggcattgtggttgtggtggccaaagtgaagaagaagaagaaacgataa

SEQ ID NO: 57037 - DNA, 413 bp, Glycine max
  Peptide Sequence Number=SeqID_148722
atgaccctgaggaagctcgcctcaaagagatctaggaaggataaagcggctgaaggaaccagttccgctcccgaatatgacagccaccgctttaggagtgctgaacaccagcaacacttcgaggccatcaaaggatggtcatttctccgggagcgacgcgtccagctcagggacgacgagtacaccgatttccaggaggagatagttcgccagcggtgggcatcgctggtcacccccatggccaagttcgatccagacatagtcctcgaattttatgccaatgcttggccaacagaggagggcgtgcgtgatatgaggtcctgggtgaggggtcagtggatcccgtttgatgcagatgctatcggccagctcctaggatatcctttagtgctggaagagggccaggagtgcga

SEQ ID NO: 57038 - DNA, 264 bp, Glycine max
  Peptide Sequence Number=SeqID_148723
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggagggtaatttggcaactccagatattgacaaaagaagctgggtctctgaatcttcatcttctgaggttcaattctcacatcagattatcctgtgcctccccacatccttcttaa

SEQ ID NO: 57039 - DNA, 449 bp, Glycine max
  Peptide Sequence Number=SeqID_148724
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcgactctagaggatcccctaccgtggtcgcggaacgctttgtgccgttacggcaacggctggaagcgcattttgtcgaagagagtagtgaccctgggctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactga

SEQ ID NO: 57040 - DNA, 153 bp, Glycine max
  Peptide Sequence Number=SeqID_148725
atgtttgcttacagtcctttcgctaagcgcaagcctcacgctaagcgcatctctgttcatgtgctaagccatgagtctcaagcgcttagcacccaacccttgcatttgaggctgatttggtccgctaagttggccaaggttgagctaagctaa

SEQ ID NO: 57041 - DNA, 267 bp, Glycine max
  Peptide Sequence Number=SeqID_148726
atggcagcagaatggagaaggaagagagagagaagatgccacttcaaggagaagatgagtctagaagaagctcaccaccataagaggccatggataagagcttggaagaagaaggagatgaatgaagggagaggaagagaagagcacaaaattttgtgctctaaaagagatctgaaatctaaactatggttcagcccactaatccaagataaagtccaagattctccactaagtgtgcttaggtgtcatgaggcatgtaaagcatga

SEQ ID NO: 57042 - DNA, 201 bp, Glycine max
  Peptide Sequence Number=SeqID_148727
atggaaaaatctgaaaagaaaaatcatagtgaaaagaaactgaagaaagcatacatcacatgggatgaaaatgatatggaatcttctgaagattcagaaaatgaagagataaatctctgccttatggctaaaatttacgaaagtgatgaagagaagaggacatggcatatcaacttgctacttcaagaaaaattacagtaa

SEQ ID NO: 57043 - DNA, 873 bp, Glycine max
  Peptide Sequence Number=SeqID_148728
ggtgaacccttgggtactagtaccctcacctccagagaactaggtgtcctcgccatcagaggactgcatgtcctcaccttcgtagggctacacgccctcaccttcagaggaccacacgtcctcactttcagagggctacacgccctcgccatcagaggactgcatgtcctcaccttcagagggctacacgccctcaccttcagaggaccacacgtcctcaccttcagagggctacacgccctcgccatcagaggactgcatgtcctcaccttcgtagggctacacgccctcacctttagaggaccacacgccctcaccttcagagggctacacgctctcgccatcagaggactgcaggtcctcaccttcagagggctacacgccctcgccatcagaggactgcacatcctcgccttcagaggactacacgtcctcaccttgagaggactacacgtcctcgccttgagaggactacatgtcctcaccatcagagggctgcacgccttcacctccagaggactacatgtcctcgccttgagagggctacccgccctcgccttggggctacacgccctcacctttagaggaccacacgtcctcaccttcagagggctacacgccctcgccattagaggactgcatgtcctcaccttcgtagggctacacgccctcacctttagaggactgcatgtcctcaccttcgtagggctacacgccctcacctttagaggactacacgtcctcgccaacagagggctgcacgctctcaccttgagaggactgcacgccctcacctttagagggctacgtgtcctcattttctgtgtgctccacatctacaccttaagagaatttaaggtcctctgtccttaa

SEQ ID NO: 57044 - DNA, 60 bp, Glycine max
  Peptide Sequence Number=SeqID_148729
atggccgaccagcaggcgaccaagtccaaagccaaagtagacacacctagttgctcatga

SEQ ID NO: 57045 - DNA, 297 bp, Glycine max
  Peptide Sequence Number=SeqID_148730
atggcagagaacacgcacagtcaagcttcccttcgtgaaatggaagagcgtctcagcagcaaaatggaatcaagatttgtcgagctcgttgcttccatgcaacaaataatacatggaatgtttcaacagaggcaacaagattctccagcagcaagcaatccacttagaggattggagaatttgccttctggaatgaatatcagatcttggtacttgatcattttggagatgtttgtgaagatcccatggcggaatttaatgaagctcaggcagacaggatccatcagagtatcatga

SEQ ID NO: 57046 - DNA, 275 bp, Glycine max
  Peptide Sequence Number=SeqID_148731
atgccaatgttggatcaattgcatcccttgatacacgatttcattgagaacattatggatgtcaaagctgacggtatgagtgaagattcttggtccttggtgcgcaaccgtttgcttaaagaacttagcaaatggtcagatgagtatatcaacctctttggtggcacagagagattcgaggaattaaggaggtccctacttgttgatggattatccatggttactatggataagtggatgaatataatcaagatgggatatgtcattgcatcaag

SEQ ID NO: 57047 - DNA, 537 bp, Glycine max
  Peptide Sequence Number=SeqID_148732
atggcgcctaccaggaaccctttggacccggataagtccaacagggccctgggatttcccgccttgattacaggactccgccagtcgtttggcgtccccgtcacacctagcaaggtgattcggccacccatcacccgagcttttattgagaagtactacacgcagagacaggtccaaggtgttgcaccacaggccgcggacgcgccgccacctcatcaggctggcccagccggattgtttgatacagagcagtatttgcggcatttggttcgccagcaggcggccaaccaccgggcacatgtacagactcatgattgtctttatcatatgagtctcaacctccagagtcagggctttacttcttttccgtgccctactccggaccagttcagggcagaggtcgcgtggcctggggattggcctgaggcccaggcaggagaggcaccagcagaggctcccgatgaggcagatgaggcccgcaaggacgaagagatgaccgatttacttgatttcttaggagggagcggagccgcatga

SEQ ID NO: 57048 - DNA, 613 bp, Glycine max
  Peptide Sequence Number=SeqID_148733
ggtcggaacaggagagcgcacgagggagcttccagggggaaacgcctggtatcttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgccggataacaatttcacacaggaaacagctatgaccatgattacgaattcgagctcggtacccctcgagggtttgtacagtggttacagaaaggctcaagactatggaaaaggttgttggcatgattttgactccatcacaatcacaaacaatgatgtgatagtcgcacgcgtggccaagggaaacagttatggtggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 57049 - DNA, 324 bp, Glycine max
  Peptide Sequence Number=SeqID_148734
atgataaaggtgcaacccaagttcaagaattctcctgttttgaagtgttcaactgactcaagcttaataaatgttgtgatggatatgctagctgatgttgagacatcttcaaaaatgaatatcccaatttctgattccaatcattctgcccaacatgaatctcaatccgtgtctgtgacagtagaccatcatccactgcttggactccccttgacacctacaaagcggcaggcatttcaagattgtgatgatgaagcagggacctctcaaatttcacatgcgcaactttcatccaacaaattaaaaaaacatggcacaatttag

SEQ ID NO: 57050 - DNA, 399 bp, Glycine max
  Peptide Sequence Number=SeqID_148735
atggaacttcaacgtctcaaccaaaatgaagagaccgacaaaaagaaaagaagcatagcactcaaagcctccacctcaatacaagaagaagaagaagaagaagaatctgacgatgaagaggacttctcactctttgtgaagaagtttcataaattcgtcaaaaatagaagaatagagagaagtcacaacttcaacaatgggaagagatcccaagaagcaaactgtccctcaaatgagtcatggcccgaaaagaatgataagaaaaactataaagaaagaagatccaagaaggtgtatattacttgggatgacaatgactcatccgatggttcggagaaggagatcaaccttctatctaaggactatgaaagtgatgaaaacatctctcaagaagtttga

SEQ ID NO: 57051 - DNA, 288 bp, Glycine max
  Peptide Sequence Number=SeqID_148736
atggggaccggtgttgagagaaacgaggatatgggctacgtgggagtacgtgagctcagttggaggtgggcaaccggggatggtgggtttatgcggggccgcattgtggatgtggaaagcttgttgtgcaccatcgcccgaccgccacctagtaccacatgcgagctcctggcagtccagataaaggaaaacaagatcacagcaaggaggcttgtggtggctggcacagctgtgaagttttgtgaatatgtggggtgggtgtactctggtaatcgattaggtgggtaa

SEQ ID NO: 57052 - DNA, 324 bp, Glycine max
  Peptide Sequence Number=SeqID_148737
agaaagttgttgatgatgagatgaggaaaggcaagagtgaggtaaacattgacaagaagaaggatactactccaaatgaaggcaaggaagtaccttatcctttggtaccttcccgagaagagaaagaaagacatctggccagatttcttgatatcttcaagaaactggaaattactttaccctttggagaagcacttcaacaactgtcactatatgccaaatttttaaaagatatgctgacaaagaagaatcggtacatccacaatgacataattgtggtggaacgtgttggatcgagtggcctcagaataattaagaaggggg

SEQ ID NO: 57053 - DNA, 166 bp, Glycine max
  Peptide Sequence Number=SeqID_148738
atgtacgaaactgatgatgatatcacattcgaaggccctaaaaaagctattcaaataaagtgtggtaaatatattgcactgcaaatttgtgacgatgaagatgttgaaacaatgattcaaagttttgaacaacaacaagaaatgtctgtcatagaattatgtgttg

SEQ ID NO: 57054 - DNA, 447 bp, Glycine max
  Peptide Sequence Number=SeqID_148739
ctcagttggaggtgggcaacaggggatggtgggtttatgcacgatttgtggatgtggaaaacttgtggtgcaccatcgcccgaccgccacctagtaccacatgtgatggagtggtacctggagatatgtcgcgggggtcaggagaccttggggacgtcaggcgagctcctggcagtcaacagataaaaggaatagagaccacaaagcaaggaggcttgtgtggtggctggccagctgtgaatcttgctgtggaggcctctggtaatcgattaccagtctgtgtaatcgattacacagaggaatgggtcactggtaatcgattaccaaagaggtgtaatcgattaccaggcttgaaagctatgagggctgtggaggcctctggtaatcgattaccagtctgtgtaatcgattacacagaggaatgggtcactggtaatcgattaccag

SEQ ID NO: 57055 - DNA, 546 bp, Glycine max
  Peptide Sequence Number=SeqID_148740
atgctggaaagttttaaacaacaagaccaaatgtcagttctggaattgtacatagaaaaggatgtggttggtggttcaatgtttcattctgcaaattcgcttacatcatgtggaaattatttatctaatgatgagacacaatcgacaacaaatatgagcaatttacatattgacgaagacgacgatgatgatgattatcttgtgtctaactcatacattgaagagtctttagacgaagatgacagtgttgacggtatatctgatacagacgatgaagtcaccgacattcctcaaccagtaagaattgttcacccagcagaaggtgcacaacgaattgaaaatccattttgggatgatgctttacattataacaatatcaactggagttatcctgatgaggaggacatttgcggtttggagatgtcgtcaacctttaatgttggccaagaattatatgttggcatggaatttgatagtaaagatgcggtaaaaaaatgcagtcaaacaatatgttatgaaggtgcattaaagtttcaaagttgttga

SEQ ID NO: 57056 - DNA, 338 bp, Glycine max
  Peptide Sequence Number=SeqID_148741
ggatcgcgctcacaagacatccagtggatccgaagaagtccaacagggtcctagggtttccagctctgattatgggcctctgtcaattctacagagtgcccgtcgcccccagcaaggtcatcaggccccctattaacaggtctttcatcaagaagtaccgtgcccctaggcaggcgcaaggcgaggcaccacagcagcctagggacgaccagcagtgggcaatagacacaccgccaccacctccaaagtccacctcagctcatctacgaaggctggagtgttgcctacgacatgtggccgaccagcaggcgaccaagtccaaagccaaaggtaagtga

SEQ ID NO: 57057 - DNA, 453 bp, Glycine max
  Peptide Sequence Number=SeqID_148742
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgagctggagttaccctgatttatgctgtctgcccctttggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 57058 - DNA, 366 bp, Glycine max
  Peptide Sequence Number=SeqID_148743
gagtttgatgcgcaagtggcctggccaggagcccagccttctccttttggagggggtggggcctccgcagcccaggagcctactcctgaggagccagcagcagcagcagtagagggtgtacacatgtctcagaaggaggagacttctacagaccagatcccagagccatccctagcacccatacctgatgatgttgtaccatctgcactagcatctgagttagagcagcctatctctcaggattcaccagctgctcagccattagaagagaatgagcatgtgattggaagtatgactgaaaatgttagtcaatttgtcagattgattgtgaaggaatgcattgatcgtatcccggtgagagtgtga

SEQ ID NO: 57059 - DNA, 422 bp, Glycine max
  misc_feature (325)..(325): n is a, c, g, or t
  Peptide Sequence Number=SeqID_148744
atggataatgaagagggcgtgcaggaacagatgaaggccaatctatcggccttaaaagatcaaatggcttccatctcggaggtcatgttaaaactccagaaaactatagaggataaagccacggcaaccgcctccacttacccctatggcttgcctccggacttcactccccgtgccaccccggaagatttaagccaagcccctactttcgaggggcaactcccaccttatgacgactatcctgggcaagacgatgaggaaggagatacccatctcggccccctgctccacctcaaagatccatccccccatgaactaccccaancaaacatagtccgccatatctcggcttcaaccaaacccgtaaaagaatctgtccccttcgtggaagataagggaaagattgaggcgcttgaagagag

SEQ ID NO: 57060 - DNA, 300 bp, Glycine max
  Peptide Sequence Number=SeqID_148745
atgctcagagcttcggtattcaatttcgagcgtctcgatatattacgggactcagtcagatatcctaggaaaaagttattgtcgtttgaatatgctcagagcttcggtattcaatttcgagcgtctcgatatattacgggactcagtcagatatccgaagcttcggtattcaatttcgagcgtctcgatatattacggaactcaatcagacatccgagtaaaaatttattgtcgtttgaatttgctcagagcttcttcattcaatttcgagcgtctcgatatattgcgggactcaattag

SEQ ID NO: 57061 - DNA, 492 bp, Glycine max
  Peptide Sequence Number=SeqID_148746
atggtgggttacacaccttcaagctttgcggatttggacttcgccggcagaaggatcaaagcgggtctgaaaagaggcaaatttaatcatcccacttggacgaatgagaaaactggggcaaatgaagagggtgagaatgagggagaagcccatgctgtgactgccattcctatacagccaagtttcccaccaacccaacaatgtcattactcagccaataaccaaccttctccttacccaccgcccagttatccacaaaggccatccctaaaacaaccacaaagtctgtctaccgcacttccaatgacgaacatcacctttagcacaatccaaaaacaccaaccaagaaatgaattttgcagcgagaaagcctgtagaattcaccccaattccagtgtcctactgtcataccctaatttcgtccggggacctttgcttgatgacatgcgacttttgtttggtccttgtaaggtgcttggcacccatcattag

SEQ ID NO: 57062 - DNA, 312 bp, Glycine max
  Peptide Sequence Number=SeqID_148747
atgggtgatcaagaagagacacaggaacagatgaaagccgacatgtcggctctgaaagaacaaatggcttccatgatggaggccacgttaggaatgaggcaactcatggagaaaaacgtggccaccgctgcctctattagttcggctgctgaagcagacccaactctcctagctaccgcgcaccatcctccgccaaatgcggtaggacaaggaaggagcacactagggcacaacaacaacccccatttgggatacaaacggttggcttacccttatggattgccgcctaattacacgccgccagtcatgtag

SEQ ID NO: 57063 - DNA, 531 bp, Glycine max
  Peptide Sequence Number=SeqID_148748
atgactagaggcaatccatctgacttacaaccctttgatcctgagatagataggacatttcacagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccaccccgtgagaggactctaagggaaatggctgcacctgatttcacctacgaaagcttgtgcatccaataccctgatgaggatgtcccatatgttcttaaaactggattgattcatttgcttccaaagtttcatggccttgcaagtgaagacccgcacaaacatttgaaggaatttcatattgtctgctccaccatgaaacccccacatgtccaagaggatcacatatttctgaaggcttttcctcattcattagagggagtggcaaaggactggctgtataccttgcttcaa

SEQ ID NO: 57064 - DNA, 345 bp, Glycine max
  Peptide Sequence Number=SeqID_148749
atgacgttgctacttagcaacattctgcccagcgaccgcagtgccgatctccccctgcgaaagggtagcgcccacaagacacccagtggacttggaggagcccaacagggccctggggtttccgactctgggatcacgcccgcaagacactcagtggacccggagaagtctaacagggtcttggagttgccagctctgattacgggtctctgttggttctacggggtgtctgtcgcccccagcaaggtcatcaggccccctactaatcgagctttcatcaagaagtactgcgcccccaggcaggcgcagggcgaaacaccacagcagcctggggatggccagtag

SEQ ID NO: 57065 - DNA, 234 bp, Glycine max
  Peptide Sequence Number=SeqID_148750
atgtcaatccttaccctcggaagcaaaaaaagaaaaagaaggaaaatttccaatcaaagagaaagcaaaaagaaaagaatgggagaaagtaaaaaggaaggaaagaaagctcctgatcaaggatcgaaagaaaccagaagaaatgtgcagaaaagtctttggaccagacaatacctgaacaatacagaattgtcaccaaatgaacaaaaggaagaaaaggaaagcatgacctaa

SEQ ID NO: 57066 - DNA, 741 bp, Glycine max
  Peptide Sequence Number=SeqID_148751
atggagggggctagcgtgaacgccgtcggagggaatgagccatcgcgagcaaagagattaggagaggtggctacttctagtcgcttcatctatcaatcactgcaagcggcgtgcatggtctcccgtggtggagacgaaagggatgaatgtttgtttcacctcggggagtcgcatgacatggaaacctaccccgcggtggaagatttgcttcagcggctcatggattgcgggcagcttgaagtgtccattggagggagggaagaaccacaaatttgcatgcagtcggaagagaagaaggttcctctaacccccaaggccctagtgatgtgttttactaggaaagggaccggctccacacccatgtatccccggacagcgcccaagccaacgccatttgcatatcaaagtaataaggccgttccgtggaagtatacccctcccgcgtccagcgaaagagttgcaaccgaagttgactccctgtcagctaaggtaaccaacatcactggcctcaatggcgtaacccgcagtggtcgggtgttcgcttcccctcacccggcggagttgtcctccaagggaaaagcgcccatgatccaagagcccatagacgtagccaccccctcgaaagaagtagatcctccagtagtaagaggggctgaaaagaaagagggtcttcaaggaaaaacagtgactttggaagaggcccatgagttcctccgcctcatccaacaaagcgagtttaag

SEQ ID NO: 57067 - DNA, 441 bp, Glycine max
  Peptide Sequence Number=SeqID_148752
atggggcagacacttaacaccttccttgcttggctaacacatcacgtgaagcatttatcaaaacagacagctgtgtctctagcaaaacctccagataggccggatcataagcctctccaggttatgtgggatgctaccgtgttcgaggtgtttaatgaagacttcccgttgtacataaagcacaaagatctctctgaaattgcacacagtggtcaatgtctcagcttatctgttatacagttgtggattctgcatctgactgagacaagtatgcgagcgggaaattctgatgtgtatggattcctcgagccacagtctattcagagatctgggcaattgcaatttgaattagaaagttacatgaagagtggaatgcagagttcaaaacgcgatgtctaccttggagcttacctgaatgggctaaacaactaccttaaatga

SEQ ID NO: 57068 - DNA, 609 bp, Glycine max
  Peptide Sequence Number=SeqID_148753
atggtttgtgttgaaaatgctgatatgtctggtcgcttacttgctggatcccttacttttgaatgtcatatcatgcattacattctctatcgtgtgttgcttcctcgttctactaaccttgctcaagcctctaaggaagatttaattgtgatgtgggcattgcaaaatggatgccaaattgactgggcatatcttgttcattatcgtatgcataaggcattacgggaaaatgcccctctaccatatccccatctggtcactctgtttctgaagcacttcaaaaccccttttactaatgaaccatttgtcaagattaagcattcatttgaaataggagccactgcagttgcttcttttggttgtaagaaagatcttgatggacaatgggttcacaaagaggattaccaggctaatgctcccaatgaacgcactccatctccaccacctagggatctctcctctactttactgactgatgttctcaatgagattcgggatcttcgcacttttcttggtgaaaggtttgattccatggattctcacatcactcatcttgaggatgacatgggatttatccgttattgcttttatcctccaaccaatccttag

SEQ ID NO: 57069 - DNA, 399 bp, Glycine max
  Peptide Sequence Number=SeqID_148754
atggaacaagaaggtggattatgtgatgggaaagaagttgatcagtttcatcaaccgtctggtagtaatgaggttgccattgctaatgaggatggtatttcatatggatcagagctcatagaggttgacaaagtaaaagtaaatcaagatggtgctctctgggatattttttggagacaggatgtccctaagttgcaggaatatctgaagaagaatttcagagagtttaggcatgtccattgctgtcgtttaaagcagggttatgtcatagatccatgtcatagagattcgacaaagtttaacgttggctgtcgaaagcctaacacaaccctctccttttatccgggcttgggaccggctaagaatagcaaagctaccctaggcaggattcacctttag

SEQ ID NO: 57070 - DNA, 408 bp, Glycine max
  Peptide Sequence Number=SeqID_148755
atggtagatacgttgcccacgttctactatgaaaagctgataggctacatgccagctaactttgcggatctcgtcttcgccggagaaaggattgaatctggactacgaaaaggcaagttcgaatatgcttccaatgtggcccccaacaacaacagaagagccccagtagtgggcgcgaggaaaaaggaaggagacgcccacgcgaatcacttagtggtggccatacccgggaaggtcctccagccaccctaccccaagtggtatgacccgggtgccaagtgtgcgtaccatagtggagttcccggacacaacattgactcctgcatcccgttcaagtataagcgtgaatgccgtcgaagaggatgggccatcgcgggcaaagagattaagagaggtggctacttctag

SEQ ID NO: 57071 - DNA, 240 bp, Glycine max
  Peptide Sequence Number=SeqID_148756
atgggggtgcaaatagcaacgaggcccacttgggccctccagaaggctgttgcttctggaggaagcaacctagcttgcctgggcgagttgggtggcaagcttctcccccaattttctataaatagggggagaagtgaaccgaggcgcttccgtaacgtttccgtgagtgatttcgcgaaggttttcgaccgttcttcgatgttcttcattcgttcttcatcgttcttcagtcttcaacgg

SEQ ID NO: 57072 - DNA, 204 bp, Glycine max
  Peptide Sequence Number=SeqID_148757
atgaagggtagagttaacctagggttagaaggtgagagtatgcttgggaggattgatggggacccggtgttgagagaaacgaggatatgggctacgtgggagtacgtgagctcagttggaggtgggcaacaggggatggtgggtttatgcgcgcattgtggatgtggaaaacttgttgtgcaccatcgcccgaccgccacctag

SEQ ID NO: 57073 - DNA, 472 bp, Glycine max
  Peptide Sequence Number=SeqID_148758
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccatatgtcgtgcttggtgctcgcattccaaaagcgacagttgccatcgccatggtctggtccaccgatccaacagcactggccgtgcacatgctccactgccagactggcaaaaaatataatataaggcgaacactttcgcccaatgctcggattgcttgctgtgcttcggttggcaggcaacggccaagtgagcagctatgggctgtgagcg

SEQ ID NO: 57074 - DNA, 243 bp, Glycine max
  Peptide Sequence Number=SeqID_148759
atggcctggaatttccttgtcaaatgcaagtatgtgcatgacgaaatggctccgagaaagcttcttgcaaagagatccaggaaggacaaagcggctgaagggaccagtgccgctcctgagtatgacagccatcgcttccggagcgctgagcatcagcaacatttcgaggccatcaaaggatggtcattccaccaggagagacgcgtccagctcagggacgatgagtataccgacttccagtaa

SEQ ID NO: 57075 - DNA, 312 bp, Glycine max
  Peptide Sequence Number=SeqID_148760
atgaaagataaatggaatgtgcatgaattgcacagtatgttagttcaagaagaaacgaggcttaagaatcaaggaagtcactcagtccattatgtaagccaccaagggaatcaaggagctggaaagaaatttatgaagaagcatgataaaggcagagggaaatcaggacatttccagaaggattacctaaagtgcaagtcttggttcgaaaagagaagtgagcttaatactcatagattccttacaatccaaaccataagcccaaatgagaagttcgtcttcatggggaataaagtgaaagctcttgtgtaa

SEQ ID NO: 57076 - DNA, 343 bp, Glycine max
  Peptide Sequence Number=SeqID_148761
tggttttttcggatttcgcacccgtttgtacacgcgaaccgaggagactatagagccgagacatccgcctccccctcatcatgaggagttcgtcgagccacccatccccgaggtttcagtcgcgactgatctccctacgcattcagtggttcactgcgaaggatgtcaggggatggctcaggatttaggagcgattgctgaggatttggagcgggtcatcaacctcaggatggtcactgagggcactgacttacatgacatcatgacttgttgtctgaggagagctagaggtgacaccacagatggaagtcttaggctgcgccagagacgccgcatagattag

SEQ ID NO: 57077 - DNA, 485 bp, Glycine max
  Peptide Sequence Number=SeqID_148762
atggcgcccactaggcaccctttggacccagataagtccaacagggccctgggattccccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgcgcccccaccacctcatcaggctggccaggctggggcatttgacatggagcagtatttacggcatttggttcgccagcaggcggccaatcaccgagcacatggcttcgctcctttttcatgccctactccagaccagttcagggcagaggttgcatggcccggagattggcccaaggcccaagcaggagaggcacccccagaagctcccggcgatggagaagaagcccacgaggatgaggagatggctgatttgcttgacttcttgggagggagtggagacac

SEQ ID NO: 57078 - DNA, 297 bp, Glycine max
  Peptide Sequence Number=SeqID_148763
gttagtatggacaaatggatggatataacagatatgggatatgtaattgcgtcaagaagtcgaccaccggccaattctgctgcgcaccgcataatatgcgtcggccatgtgtatggcagtcattttgttcaggtttttctgaaagatcgttgtcccttaccgcctatggcattgttgtggtcaagcaatgcgtatctggaggcaaaacaatggccaactgcatatgtaggtagaatgcagcaatacttaagcctaatgacaattaatacaacacatgtagacctaagcggacactga

SEQ ID NO: 57079 - DNA, 944 bp, Glycine max
  Peptide Sequence Number=SeqID_148764
atggggacaaatcaaactggcaaaaggttttatcaagtcaaggttaaaggcctagatgttaccagcattaaggaattggggcggttgatgagacctctccaaatgcaagccttccgcaagacttacggaaaaatcttagatttgaccatagcagaggtatccatagaagccattgcatcactcacccaatactacgaccagcctttgagatgcttcacgttcggagacttccaattggtatcgaccattgaagaatttgaggagattctaggatgtcctctcggggaaagaaaaccatatcttttctccggttgtctcccctctttgagcagaattgcaactgtggtcgaggattcagcaagaggtttggaccgcgtaaaacaaactcgaaacggcatagcgggcctaccacggaagtacctagaagacaaggcgagggatatggcaaatcaagaagattgggtcccgtttatggatgtgttagcattgctaatctttggggtcgtcctctttccaaacgtagatggtttggtggacctagccgcaatcgacgcgttccttgcataccgccatagcaaggaaagtccggtggtagctgtcttggcagatttatttgacacatttgaccgaaggtgcgaaaagagtagcgcacggatcatctgttgcttgcccgctctctgtgtttggttggtttcacacctgttccagcaagacacgaggcatccatgtccgctccaaagccatcgctcgtgtaccgaaaagagaagaatagattgggaccagcttttggctgggataggaggtagaacaatcaattggttcccccgatggaaggaaggaaaggagggagtccttttctcatgtggagggtacccaaacattccgctgataggaacgaggggttgtattaactacaatcctgcgctcgctataagacaactagg

SEQ ID NO: 57080 - DNA, 177 bp, Glycine max
  Peptide Sequence Number=SeqID_148765
atgtggtaccatggagaccagtcagggtcacagtgttttgcgagaatgctccaaccatatgagatcaacataggcttaaaggagcactcaaaccgggtgacccccaaggcctgcactccgaagagtccgtcagggcctctccctcctaattcaggtccaacccagaaaatattttag

SEQ ID NO: 57081 - DNA, 558 bp, Glycine max
  Peptide Sequence Number=SeqID_148766
atgtttttcctatacggatttggaggcacaggaaaaacattcatatggagaacattagcaagttcattgagagcagagaatcaaattgtgattattgttgcttctagcggaataacctctctattattactaggaggcagaactgcacattccagatttaaaattcctgtaccaatttttgaagactcaacatgcaaagttatagtatttggtggagattttcgccaaatactaccagccatcccaagaggaacccgctcagacattgtaaatgcagcaatcaattcatcctatctatgggatttgtgtgaaatattgaccttgacaaaaaacatgcgcttacacagcaatctagaatcagttgatgaacaagaaactgccacatttgctaaatggattctagacattggagatggaattatagatgatgaaaacgatggttatgctacaattcaaattcctactcatctactcattactcaatatgatgatccaatcaagcttatcgataccgtcgacctcgagggggggcccggtaccagcttttgttccctttag

SEQ ID NO: 57082 - DNA, 449 bp, Glycine max
  Peptide Sequence Number=SeqID_148767
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcgccacgaagttattgcgtagcgctgttcgccaattctccattctccactttattcggagctccatgaatttattgcctagcgctgttcatatgtcctccaccttcgagtctggagccccgcaaaatcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcg

SEQ ID NO: 57083 - DNA, 504 bp, Glycine max
  Peptide Sequence Number=SeqID_148768
atggacacctatgttagtcctttgaccgctcaaatcacggagacagaggtcaccaaacctactttattcgaggttgcactagaacgatcaccaccaatctgtgcttcttcctcgtctatcagtgtagttttcaaaagcaaaggtgaaaggaaagatattgagctggtagaggaggaacagacacggattggtgctgatccttctagtgggagctccaataatctgagaattataaggaggaagcatggaagaaaacacagaactgaagcagtagaacataggaacaaaagagatacaggccatcaaaatgtggcattggacaataagacaggagattcaactatgctgaagatgggagattcagctaaagttgtgataaaacaagacatgaagggaagaaggcataaatatgggtttaacaacaatgtacatgagaaggcacagaagaaaagggtggtggatgatgaaactgccaacaaacatcagctggatgaagtcctatga

SEQ ID NO: 57084 - DNA, 336 bp, Glycine max
  Peptide Sequence Number=SeqID_148769
atgattaagtccattgatcgagtgttcagttgtaatcgacgatcctggacttatatccgcatttgtggagaggtggcacagggagaccagcaccttccaccttccaatagagagttgatgatcacactagatgatgtgtcgtcactcttccatctccctatcagtggcaccttccacagcttcgaggctctttccgtggacgaggcggtatttttgttgatggagttgcttgaggtgtccggtgaggaggctagagccgagacagtacgagggcgcggggcatatgtatgcctctcatgggttcgggagatctatgagatgagatgccaggcatga

SEQ ID NO: 57085 - DNA, 735 bp, Glycine max
  Peptide Sequence Number=SeqID_148770
gagaagccaagaggtggctccattcatttaaggggaaagctgcaatttcatcaattccctgatgaatccctaagtgaagcattggagaggtttagaggattgttaagaaagacccccatccatggactctttgagccagcccagcttaacatattcatagatgggttgaggccacaatctaagcagctattagatgcttctgcaaggggaaaaataaaacggaaaacccctgaagaagtaacaaagttgattgaaaacatatctgccagtgatcacgccattctacgtgatagagttgtaccatatgtggtagtactcatgaatctggccttcgcattccttttgaagagcaaacacaagaggttagctacatggggaatcaacaaaggcagggatacaatcaaggtggattctcaggtttccagcagggtccttacaaccaacaaggacatggagatcacaccctggtcgtctcaacaagggcctaacatttttcagaggacaaccaagctggaggagactctgactcaattcatgcaggtgaccatgtcaaatcacaaaagcactgagccagcattgaagaaccttgagatccaagtgggccaactagccaaacaattagctgaaaagtcatccaatagctttggggcgaacatagaaaagaatcccaaagaggaatgtaatgctgtgatgacaagaaacaagaagcgtttggtagttgaggatgaagatagg

SEQ ID NO: 57086 - DNA, 207 bp, Glycine max
  misc_feature (171)..(171): n is a, c, g, or t
  Peptide Sequence Number=SeqID_148771
atgaggtctattggaaatggtcgatcggcgtcatccggcgatgcttcttttttaaacctcgaccgcttaactttcctggccgacgtcggcttgaattttcttcgatcaggatcggtgaatcatggttttttgccgaggttggcaaatgttttcctttccgagcaaaagganacatgccggtgtcggccgatacacaacttcggttga

SEQ ID NO: 57087 - DNA, 207 bp, Glycine max
  Peptide Sequence Number=SeqID_148772
atgatgacaaaggtgatgaaaaaaaagctcaaaagatcaaagaacaactcaagtgaatcaaagaacatctcaagtaaatcaagaacaagtcaagagttcaagaatcaagaagaattcaagactcaagaagaaagtctacaatcaagaatcaagattcaagatctcaagaatcaagatcaagattcaagactcaagattcaagaatga

SEQ ID NO: 57088 - DNA, 888 bp, Glycine max
  Peptide Sequence Number=SeqID_148773
atgtctcctttccttgtgagggatctcggcgcacaaaattccaagactatacaaagaatccataaggcatgggaaaccccgttaaggaaagatcaagagcttagaggtattcgtaatggcatcattggtgggtaccacgaatggctgaaagctcatatacgaggtttagattggctcgccaagttaaaagtcgtcagcgaagagagttttgaagcaccggaagaggacgaagaagtccaaactctcaaaagcgagttaggaaaagcaaaacttgccaaggagaagttcaagttggccgctacacacgttcggaaggagtgtgccgggttacgggaagagaatgcaattactgcaagagcccttgaacaagagaccaagagggctcgcaaggaagagtatggccggaacaaatttcgcggagctctatggggtagcaatagtgaactcaagttgcgaagggaagaaagggaccagtcgcgagcacatggcatggttttgaaagaggagttagttgcctgttcaaggtccaaaagaagcttgtctcagcgtttatgcgagacggagaccaacatgctagctatcatcgccaagtaccaagaagagttaggtctagccgcggcccacgagcataggattgcggacgaatatgcccaagtatacgcggaaaaagaggctagaggaagggtgatcgactctttacaccaagaggcaaccatgtggatggatcggtttgctcttaccttgaacgggagtcaagaacttccccgatggttagccaaggccaaggcgatggcagacacctactccgcccccgaagagattcatgggcttctcggctattgtcagcatatgatagacttaatggtccacataattagaaatcgttag

SEQ ID NO: 57089 - DNA, 132 bp, Glycine max
  Peptide Sequence Number=SeqID_148774
atgttaaacggacatagaagcaagctgaggactgcgaaaaagagaaacttagcaatggctctaagagtagagatgtctagcaaattcagtaaaaatttcagctcaaaattcgaagtaaccaattctcagtaa

SEQ ID NO: 57090 - DNA, 432 bp, Glycine max
  Peptide Sequence Number=SeqID_148775
atgtgggcttttcttactggtcgtcagatcgattgggcttatttgattcggtaccggatgcataaggcattacgggccaatgcacctctcccttatcctcaccttgtcaccctttttcttcatcatttcaagattcctttagatgatgaaccatttgttcaatgggttcggaagcaagacttacctcagccaattcctgacgaacgtaccccttctcctccaccgcaaagggctagttcctcttcacttctgaacgacgtcctcactgaactccacagtctttgcgctttcctgggtgaccgatttgatgctatggatactcgccttgatgccatggatgctcactttgatgggatggacacgaggatcactcgacttgaggacaatatgagcttcattaggcgttgtttcgatccaccagccgacccttag

SEQ ID NO: 57091 - DNA, 277 bp, Glycine max
  Peptide Sequence Number=SeqID_148776
cgaaaccacagccaagggaacgggcttggcggaatcagcggggaaagaagaccctgttgagcttgactctagtcggcttcggccggtcgatccgggcggaagacattgtcaggtggggagtttggctggggcggcacatctgttaaaagataacgcagtacgaatacgaaccgtgaaagcgtggcctatcgatcctttagtccttcggaatttgaagctagaggtgtcagaaagttaccacagggataactggcttgtggcagccaagcgttcatag

SEQ ID NO: 57092 - DNA, 186 bp, Glycine max
  Peptide Sequence Number=SeqID_148777
atgtcattgagtagcctaatcgggtgtgattttcaaacgttaaaaaccagaatagcatggcatccccttagaagtcaagcattttggcaaatttactacggacctcagtatgcagctatattatccgcaagggaggtggaacatgcagaatgcagcataaatgagtttgtagttactcgttcatag

SEQ ID NO: 57093 - DNA, 324 bp, Glycine max
  Peptide Sequence Number=SeqID_148778
atgttggtgcgcatgatccgcactcgtctctttgcagcggcacaggtgaaatcttgccccggtatgcatagtagctgtgtgatagcctccctctctggttgtgctcgcacagttggccctcctccaatatcagggggtggcccaagaaccgtgtggatatggagcccactgaatgtgaggacgcgtagtcctctaaaggcgagggcgtgtagccctctgaagttcaggacgtgtcgcctttcgaaggcgagggagtgtagtcctctgaagttgaaggtacatgaccctttgaaggcgaggacgtgtagtcctctgaaggtgaag

SEQ ID NO: 57094 - DNA, 864 bp, Glycine max
  Peptide Sequence Number=SeqID_148779
atgacagtcaccgctttaggagcgctgtacaccagcagcgcttcgaggccatcaagggatggtcgtttctccgggagcgacgagtatactgatttccaggaggaaatagggcgccagcggtggacatcactggttactcccatgccaaaggagggcgtgcgtgacatgagatcctgggtaaggggtcagtggatcccgtttgatgccgacgctatcagccagctcctgggatatccgttggtgttggaagagggccaggaatgcgagtatggccagaggaggaaccggtctgatgggttcgatgaggaggccatcgcccagctgctatgtataccggggcaggattttgcccggactgctacagggaggcgagtgcgaatcatgtgcaccaacatgaccaccctgacccagatatggatgacgttgctgctcagcaacatcttgcccagcgaccataattccgacctccccctgccgaagtgtcaactggtgtacgccatcctgacgcggatgagcgtccatgtggctcagttgatcgctgatgccatctatatttttgcaggtatggcgcctaccaggcaccctttggacccagataagtccaacagggcgggatttccctcgttgatcacaggactctgccagtcgtttggagtccccgttgcacctaccaaggtaattcggccgcccatcacccgagcttttattgagaagtactgtacccagagacaggctcagggtgatgctccacaggccgcagacgcgccaccaccacctcatcaggctggccaggctggggcatttgacatggagcagtatttacggcatttggttcgccagcaggcggccaaccaccgagcacat

SEQ ID NO: 57095 - DNA, 564 bp, Glycine max
  Peptide Sequence Number=SeqID_148780
atgcctaataatagcttgagtgaagagtttccaatgataatccatcacttgtctggatgtgctagatattcattggaacgattatatctaagcatgaatcaaatcaatggtacgcttcctgacctttcaatattctcatctttaagaggattatatcttgagggaaacaagctaaatggagagattcctaaagatattaaatttccacctcaactggagagactagatatgcaatcaaattccttgaagggtgtgctcactgactatcatttcgctaatatgtctaagttagaccacttggagttatctgacaactctttagtgaccttggcatttagccaaaattgggtcccaccatttcagttgcgcttcataggattgcgatcttgcaagctaggtccagtatttcccaaatggttggagacacaaaatcaatttcagggtattgacatttcaaatgctggaatagcagatatggttccaaagtggaaggatacccacatccatgggatctcttcttcatcttcaagcattgctattgagaaacaacaacttaacagatga

SEQ ID NO: 57096 - DNA, 81 bp, Glycine max
  Peptide Sequence Number=SeqID_148781
atgcataaggcattacgagccaatgcatctcttccgtatcctcaattgagttacagggcatccgcacctatgtcgctttga

SEQ ID NO: 57097 - DNA, 612 bp, Glycine max
  Peptide Sequence Number=SeqID_148782
atgaaggccgacatggagcccatgaacgagcaaatggccacaatgatggaggccatgatgagcatgaagaagataatggaagccaatgcggttatagttgccgctactagcgctgtcgctaaagtgaacccgatgctcccatctggcctcaagcaaatgaatcatccaacctctaatatggtaggcaaagatttgggaagtacggatgaccccatgatgtgcaaattcaaatcaagcacgccttcccgccatatggcttgcctcccaaactatacaccacccaatgtggcgtacattcccaatgaggatgtcaataactccacacccatacttattaagagccaacaacctcaatctgatcatgcacatgtctctcgacccatggaggagacacatggaatgccccaccacaatttagccgacttcgagccttggctcggatatgccactgaagggcaagcagttggtggtatatcctttgaaaataactttggagggccatcagtttcgcccactaccacgaccattgcattttgcggtgggaagagcccctcctgctatggccgaaaagggaaaggcggatcatctaaaggaaaggctcagggccattga

SEQ ID NO: 57098 - DNA, 1143 bp, Glycine max
  Peptide Sequence Number=SeqID_148783
gacatcgtcaaaggcggcatcaaagagcgctttgcccagctgcgcaagatggggatcaaaacggtgatgatcaccggggataaccggctgactgccgcggcgattgccgccgaagcgggcgtggatgattttctttccgaagccaccccggaagccaaactggcattgattcgtcaatatcaggcggaaggtcgtctggtggcgatgaccggtgacgggaccaacgatgcccctgccctcgcacaggctgacgtggcggtagcgatgaactccggtacccaggccgcaaaagaggcgggcaacatggtcgacctggactccaacccgaccaagctgattgaagtggtgcacatcggcaagcaaatgctgatgacccgcggttcgctgaccacgttcagcatcgccaacgacgtggcgaagtatttcgccatcattccggccgcgtttgctgcgacttatccgcagttaaacgcgctgaatgtgatgcatctgcactccccggcctcggccatcctgagcgcagtgatttttaacgccctgattattgtcttcctgatcccgctggcgctgaaaggcgtgagctataagccgctcaccgccgccgccatgctgcgccgtaacctgtggatttacggcctgggcgggctggtggtgcccttcatcggtatcaaggatcgggccaacggctcgctgattatgcaaaatggcgaaaaccgcggttcgcgcctgatcggtcagaactttacggatgcccgctacttccagggacgcccttccgccactgccgaaagcccgtataatccgatggcatccggcggcagtaacctggcgggcagcaaccctgagctggacaaagccgtcactgagcgcgtggccgctcttcgcgccgctaatccacaggccagtcagcatgttcccgtggagctggtaactgcctcggccagcgggctggactatagcctgacgccggcagcggtggcatggcagatcccgcgcgtcgccgctgcccgtcagctgaccgttgagcaggttagccagctggttgccgagcacacgcaaaagccgctggtcagctttatcggcatgcccgtggtaaatattgttgagctgaatctggcgctggacgcgctaaggaaaaactaa

SEQ ID NO: 57099 - DNA, 222 bp, Glycine max
  Peptide Sequence Number=SeqID_148784
ggatcgagactgcaagacaccccagtgggacccgaagaagtccaacagggtcttggaagttttcaagctctaattacgggtctctgtcagttctacaagagtccctgtaccctccagcaagggcattcaggcccccctactgatcgagctttcatcaagaagtactgcgtccctaggcaggcgcagggcgaaacaccacagcagcattgggatggctggtag

SEQ ID NO: 57100 - DNA, 459 bp, Glycine max
  Peptide Sequence Number=SeqID_148785
atgggggaagcccgtctgatagcgctctgtgcgcgtactccgaaagggaatcggcctgcccaccctggaaacggctcatccggaggtagggccagcggcctggaagagcaccgcacgtccgcgtggtgtccggtctcgcaagggaacagcctctggtcgatccccctgtgggaacaatcttctgtggcaagggaagtcggaaaatggatcgtacctcgggaaaaggatgggaactctgagggcgccggggcccgaagcccggaggaaactctagagtgcgaggcccgcagcgatactgacgtgcaaatcgttcgtctgacttgggtaggacggtgcggctgctctgttgagccgcgccatggaatcgagagctccaagtgggccatttttggtaagcagaactggcgatgcgggatgaaccggaagctgggttacggtgcccaactgcgcgctaactag

SEQ ID NO: 57101 - DNA, 318 bp, Glycine max
  Peptide Sequence Number=SeqID_148786
atgagggttcactgtaatcaagcaagtcggagacctagcatgatcacagattcacctccactccttatgttcccacgaacccggtggagttacaaactgtcgcaacctacccttttgcgggcgagcgaggtgaggctcacgggtgcatcttccaaaggaggaaaatgcgcggagtcgccaccaacgtttatttgtggaaaacgttggaaaaaccgaaggaaaccggtcatgaagaatattccagatttgggagttgtatttacgcttgaggaaggtattagcacctctcacgtttgtcccaaaggacaacaaccttaa

SEQ ID NO: 57102 - DNA, 144 bp, Glycine max
  Peptide Sequence Number=SeqID_148787
atgggggtgcaaatagcaaccgggcccacttgggccttccagaaaattcctccagaaggcggttgcttctggaggaagcaacctaggtcacctgggcgagctgggtgggggagaagtgaagggaaaaaatgttcagccctcctg

SEQ ID NO: 57103 - DNA, 186 bp, Glycine max
  Peptide Sequence Number=SeqID_148788
tgggctaagcgcgcatccaccgctaagcgtagcttcaacgcgcttagcgcaacaaaagaatctggcagagcatcaatatcaaggccgcgcgctaagcgcaagatcagtgcgctaagcgcagcagttgtctttagccaggctaagcgcacgactggcgctaagctcaaatccaattacttgcgctaa

SEQ ID NO: 57104 - DNA, 590 bp, Glycine max
  Peptide Sequence Number=SeqID_148789
aggcggcgggcccgatgatacgcggagataccttacggttatccgcacccttttgttatccagaggcgacgggcccgataacaagcagagaccaagtttggtcattctgtacccttgtatcatccagaggcggcgggcccgatgatacgcggagataccttacggttatccgcacccttttgtcatccagaggcggcgggcccgatgacaagcagagaccaaaggcggcgggcccgatgacaagcagagaccaagtttggtcattctgcacccttgtatcatccagaggcggcgggcccgatgatacgcggagataccttacggttatccgcatccttttgtcatccagaggcggcgggcccgatgacaagcagagaccaaagaccaagtttggtcattctgcacccttgtatcatccagaggcggcgggcccgatgatacgcggagataccttacggtcatccgcacccttttgtcatccagaggcggcgggcccgatgacaagcagagaccaagtttggtcattctgcacccttgtatcatccagaggcggcggcccgatgataagcagagaccagtttggtcatccg

SEQ ID NO: 57105 - DNA, 216 bp, Glycine max
  Peptide Sequence Number=SeqID_148790
atgaggattcactgttatcaagcgagtcggagacccagcatgaccacagatcaacctccactccctatggctcacatagacccgggtatagggcctaatatctcaacgtgtgtgcgaggtgacatgccgaaaaaccaaaaaaatattgatgcacaatccgtaagtttccgtgacacaccggaaatcaaatggaagcatcgttgcataattaagtga

SEQ ID NO: 57106 - DNA, 444 bp, Glycine max
  Peptide Sequence Number=SeqID_148791
atgatgatctggcctctgtgcaggctctgcagcatagcaaataaagtctcagaggtgaatgaggtgggtcctgtagaaactgaagcaggaactggcaatggagtgggagctgaagctggtgctggtaatgatgaagctggagcagatggagatggcgcaaaagaagctggagctataatggaaggagttgttgatgggggaatctcagaagatgggagagtctctgacctcttccccttggccttgcgaggccctttggaagccactattagatcatcgagattccaacagttcttcatatatgccaaattaatggcggggctgagactctccagtgtcctagaatcagaagtgactcctctagctctacataaagcagtggttaaggttggaaacccaagtctagaggagtcatgttgggcgattgttagtcggtcaatatga

SEQ ID NO: 57107 - DNA, 573 bp, Glycine max
  Peptide Sequence Number=SeqID_148792
atgaattttgcagtgaaaaagcctgtagaattaaccccaattccagtgtcctatgctaacttgctctcatatctacttgataattcaatggtagccaccccagccaaggttcatcaacctccatttcttcgagaatacgattcgaacgcaacgtgtgcttgtcacagagaagccccggggcgttccattgagcattgtagggctctgaagcgtaaggtgcaaggtctaattgatgtgggctggctgaaatttgaggagaatcgcgtgattttcaactttcaccggaattgggtgcaagccattggtctatttgctcaagcgacctgtgctcctgagtttggacttccaagaccattcaatcagagattactcgtcttgcacattggtgggggtgccgtaaaacaacgaggacaacccttcccttgtgttcaggaatcctctacaacaagagacccacggtctcttaatcccttttcagaaataagaagaagaaaagaagagatctctcttaaaagagatagattgtacaatgaagatcaatcaaaattccttattgaatatgcaagtggttga

SEQ ID NO: 57108 - DNA, 267 bp, Glycine max
  Peptide Sequence Number=SeqID_148793
atggctaaggaacttagcatctctatcaaacataatagtcttaggcaaaccatgaagcctcacaacttctctaaaaaaaagtcttcagatttgactagcattatctaccttgtggcatggtatgaaatgtgtcatcttgctaaacctatccaccaccacaaagatagattctacacccctttgggtcctaggaattccaaggacaaagtctatacttatatctacccaaggtgtagatggaatggtaagggtgtgtatagcccatga

SEQ ID NO: 57109 - DNA, 351 bp, Glycine max
  Peptide Sequence Number=SeqID_148794
atgttgagtcaacatcccaatattttaaactacactgactctgtgatgaagagagaatctcctctatccctgcattacaaattgtttgaggggacacatgtcccagacattgtctcgacatcagggaaagctgctgcttcaggtgctgtgtccaaggatgcattgattgctgaactcaaggacacatgcaagataagtggcattgatgatggtgaagcagctgaggaagaagaagaagcagctgagcaagaagatgaagcagctgaggaagaggtagaagctgctgaggaagaggaagatgcagcagaggatacagaatcagatgatgatgattctgatgccaccccatga

SEQ ID NO: 57110 - DNA, 142 bp, Glycine max
  Peptide Sequence Number=SeqID_148795
atgaatttttatagaaaattctcgatgcctcctaaggtgtccggctcctccgggagaggaggaagaaccagtagtaacaggaaagatgttttattggctctaccagagccagtaactaagaaaacaaccgcatcatcttctg

SEQ ID NO: 57111 - DNA, 63 bp, Glycine max
  Peptide Sequence Number=SeqID_148796
gtcgactctagaggatccccgaattttttgagtatgacgaaaggactatggagagatatatag

SEQ ID NO: 57112 - DNA, 444 bp, Glycine max
  Peptide Sequence Number=SeqID_148797
atggggcagaacaatttcgaggaaaaactctcgcaagcaagtcctaattttcatgcttttctaattctaaaaccaaattttgggttcctagccatgagtatgttttcttgcattaaagctaaaaagtttgggttcctaagcttgaaattgcattcccaccatcccaattttgcaaaaccatattcatatatcattggggcatttcaccgagcacttggtgggcacacgtttggacataaattgcaagagaatgggggcaatgtggcatgccccattgattcagaacacaacataggcctaaggccttctcattcaaatcctcaactcaagaaatcaagcataaaaacaacccaaaactgccccacaaatataagcacgttctcacaaattagagcaccaaaagatgaagaaaatactccaatggaagcaaaaactcatgattga

SEQ ID NO: 57113 - DNA, 358 bp, Glycine max
  Peptide Sequence Number=SeqID_148798
actcgatggtggaggacacatgaacagcgctaggcaatccaatcatgggtctccggataagattgaaaatggagaattgccgaaatgcgctagggaatgcattcgcggcgctaggcaatcattcctgggtctccgaataagattggagaatggagatttggcgaacagcgctaggcaatcaattcgcggggctccagactcgatgcgcttggcaatcaattcgcgtggctccagactcgatggtggaggacgcatgaatagcgctagacaatcaattcatgggtctccgaataagtttgagaatggagaattggcgaacagcgctaggcaatcaattcgcggggctccagactcgatg

SEQ ID NO: 57114 - DNA, 489 bp, Glycine max
  Peptide Sequence Number=SeqID_148799
atggccaagttcgacccagacatagtcctggaattttatgccaatgcttggcctacacaggagggcgtgcgggatatgcgatcttgggtgagggtgctggaggagggccaagagtgcgagtatggccagaggaggaaccgggccgatgggtttgatgaggaggccatcgcccagttgctgcgtataccgggacaggattttgcccggaccgctgccgggagacgggtgcagatcatgcgcaccaacatgactaccctgactcagacatggatgacgttgctgcttagcaacatccttcccagcgatcataattccgacctccctctgccgaagtgtcagttggtgtatgccatcctgacacgaatgagcgttcatgtggctcagttgatcgctgatgccatttatctatttgcagagaagtactgcatagctagacaggcacagggtggtgacccacaggccctagaagcatcgccgacacctccttag

SEQ ID NO: 57115 - DNA, 426 bp, Glycine max
  Peptide Sequence Number=SeqID_148800
atgactttgctacttagcgatattctgcccagcgaccgcaatgtcaatcaccccctgctaaaggatcagttgggctgtgtcgtcccgacatggggatcgcacccacaagacacccaggggacccggaaaagtccaacaggggcctggggtttccagctctgggtacgggcctctatcagtcctacaggatggccgtacccccccggcaaggatcgcacctgcaagacacccagtgggacccgaagaagtccaacagggtcttggagttgtcaagctctaattacgggtctctgtcagttctacagagtacctgtaacctctagcaagggcatcaggccccctactgatcgagctttcatcaagaagtactgcgtccctaggcaggcgcagggcgaaacaccacagcagcattgggatggccggtag

SEQ ID NO: 57116 - DNA, 204 bp, Glycine max
  Peptide Sequence Number=SeqID_148801
atgaagatgctcttgataccacatgatgtagctccatgtggagcttgtaggccttggatcttcttcatcaatggagtcctttgcttcttgaatatcatgggagtggaatggagaaggaagaaagatgattggagatgccacttcaaggagaagatgagtcaagaagaagctcaccatcataggaagtcgtggataagagcatga

SEQ ID NO: 57117 - DNA, 181 bp, Glycine max
  Peptide Sequence Number=SeqID_148802
atgactattcaaattgctcaagagcttcccttgttcaatttcgagcgtctagatgaattatgtacgcgaatcggacatccgtacatccgtgtgaaacgttatgaccattcgaattctcgagagcttccgttgttcaatttcaagcgtctagatgagttatgtccgcgaatcagacatccgt

SEQ ID NO: 57118 - DNA, 501 bp, Glycine max
  Peptide Sequence Number=SeqID_148803
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccctcaaagccaaggttgataagatgggttctgttgattcaagaatttggcatcgttatcaaggacaagaagggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 57119 - DNA, 333 bp, Glycine max
  Peptide Sequence Number=SeqID_148804
atggaattgcaagtcgacatgcggtttgatgccatggaatcaaggatcaccaaagttgaagaagatgtctccttcatccttctttttgatgttgccaaagggggagagaacttgagagaccttggggattgtcatcatcaaaaagggggagattgtagaagatctttggtattgtattgtcatcatcaaaaagggggagattgtagatgcaaatgcctttggtgttttgatgatgatcatgatgaagaaaagcaaatgatgcaaatgattcaagaatacaagccacaacatcaagatgatcaccagtacattaggaaggaaattcctaattga

SEQ ID NO: 57120 - DNA, 357 bp, Glycine max
  Peptide Sequence Number=SeqID_148805
atggtgaggatgtgtagtcctcttttggcgagggcgtgtagccctctaaaggttagggcgtgcagccctcttttggcgaggacgtgtagtcttctgatggcgagggcgtgtagccctctaaaggcgaggacgtgtagtcctctgaaggcgaggacgttcagtcctctaaaaggcgaggggatgcagatgcatgcaacctttgtcgcgaaatttggtaaatgcggacttcatatgaaacaatgcaatattgactgtccttttgaaagaggtgataattcatgtaaccttatcctatcttttgcaaatctcttcgggaactccctcagagtgtatgttctgtttgatttagtcacttga

SEQ ID NO: 57121 - DNA, 553 bp, Glycine max
  Peptide Sequence Number=SeqID_148806
atgggctggtccgacccccggcatggccggggtcgatttccagaccctgtccagtgctatgtggcgattggatcaggcatgatcggccgggctggtgccggcgcgatttgccgaaataattcggctatgcagcaactcggcacgctaccttggcacattgcccgcataagcatattggcgaatgtccgcggtcaagacctaggcggcattggatgcacgctcgaaaccgcgtgccggcggctggcgcgcctcctcgaaagcgagcttcagcgtcgcgccgtccagcaccgcattgcccttgatccgaagcgcagcctttttcggatcgaccgccagcgtgccgcccgactgcgcatagtcgccgccgatgacaagatccgtctctccgccgagcgaaagcgtgccgccgctgaccagcacgccgccggttccaagcgcatcggcggacgacgccaccagcgttccctccctgagaatggtgccgccgccatagctgttatggccgccgagagtcagcgctccgctgccagatttgacgagacgccctgccccg

SEQ ID NO: 57122 - DNA, 174 bp, Glycine max
  Peptide Sequence Number=SeqID_148807
atgatggcacatcacaaggccttccaaggttattttgatgatgccaaagaatcaatagttaagcaaattctaaagtttcaagaatcaagatttaagaataatcaagatcaagattcaagactcaagactcaagatttaagaatcaagagaagactcaatcaagataagtactaa

SEQ ID NO: 57123 - DNA, 682 bp, Glycine max
  Peptide Sequence Number=SeqID_148808
agggctacaccccctcaccttcaaagggttgcatgtccttgcctttagaggactgcaggtcctggcctttagaggattgcacgtccttcccttaagaggggcacacgtccttacattcagagggctgcacagcctcgccttgagaaggctacactccttcgccattagagtactacacgtcctcgccttcacaggacaacaagaccttccctttagaggactatacgtcctcactttcagagggctgcatgccatggcctttatagggctacacgccctcacctttataggactaaacgttctcacctttagagaactacacgtccccaccttcaaaggactacacgtgcatgcctttagaggactacacgtcctcaccttcagaggagggttgcacgccctcgccttcagagggctacacgcctttgcctttagaggcctgcacgtccttgccttaagaagggagcacgccctcgccttcagaggaccgcacgtcctcaccatcagagggctacacatcctcgtctttagagggctacatgccctctcttttagaggaaaacatgtcttagccttcagaggactagggctacacgttctcgccttcagagggctgcacgtcctcgcctttagagggctgcacgccctcgccttcagagggttgcatgtcctcgccttctga

SEQ ID NO: 57124 - DNA, 491 bp, Glycine max
  Peptide Sequence Number=SeqID_148809
atggataatgaagagggcgtgcaggaacagatgaaggccgatctatcggctttaaaagatcaaatggcttccatctcggaggtcatgttaaaactccagaaaactataaaggataaagccacggcaaccgcctccagtacagttagggaagcggagccggtgctgcaacctgccttaaatccgggccaagacagaaacacggccgtgtttggtcgaaggtatagtccgcaagcttatccttatggcttgcctccggacttcaccccccgtaacaccccggaagatttaagccaagcccctactttcgaggggcaactcccaccttatgactatcctgggcaagacaatgagcaaagagatacccatcttggccccctgctccacctcaaagatccgtccccacatgaactaccccaactgaacatagtctgccatatcccggcctcacccacacccgtaaaagaatttgttcccttcgcggaagataaggg

SEQ ID NO: 57125 - DNA, 411 bp, Glycine max
  Peptide Sequence Number=SeqID_148810
gttgttgtcaaggaccctcctacgaccgaggaggaattggtcgacgaccagccagaagcacctgttgaagaaggtgttactgatgttgagggttttctaggcggaccccatgacacatcagttctgagtgattttgaaaatcacattgctttgaaagtgtggaatggagatgaacattctgagttgaagctatcttcccatggaaggaagatgactaagtttgggaggcctgccccaaagattgaaggctttgtggtggccagtggacttagtcctttgatcacttgttccctagatacgggcgatcgggggctaatgggcgttccacagcttcgagctacttcatgtcgacgacgctgtcgagatgttgatggagttactcgaggtcagcgctgcaaaggcaaaagttga

SEQ ID NO: 57126 - DNA, 201 bp, Glycine max
  Peptide Sequence Number=SeqID_148811
atgtgcacgtatgcaatttttggtagccaatgtgtcttgagtatgcatgaaatggccccacggaaacttgcctcaaagagatccaggaaggataaagcggccgaaggaactagttctgctcccgagtatgacagtcactgctttaggagcgccgaacaccagcagcgcttcgaggccatcaagggatggtcatttctctga

SEQ ID NO: 57127 - DNA, 564 bp, Glycine max
  Peptide Sequence Number=SeqID_148812
atgaacgccaataatcgccgtctgacgggcgcgctgctgctgggcgccgtcgcgctgttgctgctgccgtggtacagcctggaagcaggctttttcgatagcggctggctgtttaacctgtggcgtgatgaagccagcgcgccggcagctgtggcagatcggcagccatccatggctggtgctcgccgtggcgctgctggcgctgtgcgccgcctgcgccttattgcccggcagcgcgcgcagccggttgctgctgctgttcagcgcgctgggcgtgatcttcctgattgtggaagggcacgcgattggctacagcggctggagctggctgtggctggaaaatcgcttcggcgcgctgccgcagggacagccagcgatgggcgctggcgcgcttctgctgctgaccgtgtttttgctgctgttctcgtttgcgctggccgaacgcggcgtgctgaaaggcgatgcctttgtggtggcgtcgctggtgctgctgactgcgctggtcagcatcttcgtactctatccggtgctcagcatgtttgtggtgtcggtgcaggacgttga

SEQ ID NO: 57128 - DNA, 525 bp, Glycine max
  Peptide Sequence Number=SeqID_148813
atggcttccatgatgaaggccatgttaggaatgagacaactcatagagaataacgtggccaccgctaccattgttagttcggctgccgaaactctcccagctaccgcgcaccatcctctcccaaatgcggtaggacgagaaaagagcacactggggcacatcagcaacccccatttgggatacaatcgggtggcttacccttatggattaccacctaattacacgccaccagtcatgcgtgatgatgcgggtcatgtcccttctcccatccttgaaggggagtctcctcgacagcccgacgaggatcatcgagagtatgcccaaggggatgttgatttctaccccccggtccccgtcgagggaccggcgcccaacacattgcctcagcacaacctcatagcacaaccaatattcttgtccacaaaaggaccacccccggcggcaaaagaaagaaggaaactcgatctcatcgaggagagattgagagctgttgaaggctttggtgactatccgttcgtggacatg

SEQ ID NO: 57129 - DNA, 450 bp, Glycine max
  Peptide Sequence Number=SeqID_148814
atgcatgtcgacgaagcggtcttgatgttggtggagttacttgaagtctccggagaggaagctagagctgagacaacacaatgtcatggggcatacgtactcctatcgtggctacgagatatttatcagagtaaatatgaggccagacattggactgttgcagctcgtgcctatttgttgcatttgttaggttgcactctttttgctaacaagagtgcaacacatagtggaagctacgcatggggagctgccgtcctagttcatatgtatgataatttgaatgatgtttgtaagagcgacaaccaacagcttgctggttacatcaccctattacagtgttggatatatgagcatttttcctctgttgctgagtctttgactgatccagactatgatgagatgtcaccacgtgtctgccgatggattgcttcgaaggcttcttcgaagtaa

SEQ ID NO: 57130 - DNA, 513 bp, Glycine max
  Peptide Sequence Number=SeqID_148815
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccctgccacgtgggatattacgcacgaagtaccagcgtggaccaatgagagcaaaggactcagagagaccaggaaacagaggattataa

SEQ ID NO: 57131 - DNA, 177 bp, Glycine max
  Peptide Sequence Number=SeqID_148816
ttgattgcctagcgctgttcatgtgtcctcccccgtcaagtgcggagcctccggtgactgggaaatatgaaaaaagaagaagtagagacaagagtcgtcatagactagtcacagaaagggcaaagacggatgaaatcagtgtttttatctttactttcctcttatctctgataaaag

SEQ ID NO: 57132 - DNA, 172 bp, Glycine max
  Peptide Sequence Number=SeqID_148817
gtcgactctagaggatccccaaccatatgagatcagcataggcttaaaggagcactcaaacccggtgacccccaaggcctacactccgaagagtccgtcagggcctctccctcctgattcagacattgctcatgaattatacaatactcacgaccttacactcgtgttttaa

SEQ ID NO: 57133 - DNA, 513 bp, Glycine max
  Peptide Sequence Number=SeqID_148818
atgtgtcacctaactgcatacgtttgtgtttactacaatggccaaatttgcaatacatatgaggacaccaccttcgttagtaacaacacaaaaaatttcatggtcaacaatgccataacctttacacaattgcttggacttgttcatcaaaaactaaacattgacccacaacaacatatccaacatctccactttcagtgccctatacttgagtcaggacaacgttatatgtacacatcttttattctgcgagatgatgttgatgttcgacaaatgttcaacattttttacaaaaatctgtcattaccatttgtggagttatttgccataatctgttacaataataacccaccaaccaaccaacatggctcaacctccaatcttgaggacttatcagatgaatatgagacttgttggatcaaaaaccatgatagtgatactgactcttcttccgggcccgaaggaagtaacatgtctgcatcccacgaaacaatattcaaacgggattggtaa

SEQ ID NO: 57134 - DNA, 538 bp, Glycine max
  Peptide Sequence Number=SeqID_148819
tgagaaatacgacataagcaaggaaaaatgggctcagttttgccagactcacagagacccttcttgggaggatgtgcagaaaaaggcacaggtgatccagaaacagaacactgccccccatgttttgtctcgtgggggttatgaatatttggagcagaagctcctggctgagaagatcaagaagaagctggaggaagctgcacagtcaggaagagttgatggcgtcattgaccctccatcccccgtcagacgccatgtgaagtggaagatggcccgcaccaagaaaacaggggagatggcgactgaggccacaaaggaaatccttgagaagatcgattcctttgaggagaggcgacaaagggatacttcgtcccttatggacgccaggatgttctcaccgctgctattggacatccaaagcaccctggacgtgtctgtgctgttggagtcggcgtcaccatcaagcaatacttcatatcgactccatggacgtcccgcaactcttccttgctgcctcctgaagaattgcagctgctga

SEQ ID NO: 57135 - DNA, 324 bp, Glycine max
  Peptide Sequence Number=SeqID_148820
atgcaattcaagggtacaatagattcaatgcaacaagcatttaaaagagctgagactcagattggcaaagataaaggtcagttggaactcaatgtagaggatcagaaaaactcatttgacctctttgaagcaatgaagcacccagatatgagtgatgcctgttttgaagaagaagaggtggagcaagagatagcattatcatctttaaccatggtactgcagttccctttggaaaaagaacctaattatgtgacagactgcctagtttgtgataaagagcttgatgatccaaaagaaaactctattgggtcatgtggttcttga

SEQ ID NO: 57136 - DNA, 338 bp, Glycine max
  Peptide Sequence Number=SeqID_148821
tgggctcatacttaacccatgggcccgaaatctaccctaaggctcatgagaaccctagggccttctcttgcatctctagcccaatcttcttggagtcttctatccaattcccttgttgggtaggattgcatcattccctctcccttgaaaaggatttgacctcaaatccagaggttcttgaagctctgggcttcttccctcaacacctaaacgaagatgctctgataccacatgatgtagctctaagtggagcttgtaggccttggatcttcttcatcaatggagttcttttcttcttgaagatcaattgcaacagaatggagatggaagaaagatga

SEQ ID NO: 57137 - DNA, 471 bp, Glycine max
  Peptide Sequence Number=SeqID_148822
atgtcgatctccccctgtggaagtatcagttggtctgcgtcgttccgacatagggatcgcgcccgcaagacactcagtggacccgaagaagtccaacagggccctggggcttccagctctgattatgggcctttgtcagtcctacagggtgcccgtccccctagcaagagaagtcctacaggtccttggagttacacgccagctcaccttagattaacgttccgccttgagtggttactacacggggtgcctgttgcccctagcaaggtcatcaggccccctactaatcgagctttcatcaaggaagtatgcgcccccgaggcaggcgcggagggcgaaacaccccagcagcctggggatggcctgcaacgggtaacaaacgcaccgccaccaccttctagagttcatctcagctcatccacaaaaaggttagagggacgttgcctacggcagcatggccttgaccaatag

SEQ ID NO: 57138 - DNA, 406 bp, Glycine max
  Peptide Sequence Number=SeqID_148823
ggtacatctacttgggtttgactgagaacaagagagggtacatctcttgtgaatcagttctaatggagggtacatccactagggtttcaaagagaacaagggaggatacatcccttgtggatctttgcttgagccatgtcggtgttgtattgatactgcctgatgaaggcaaccatcaaatccttctaagagcagatccgggaagcttccaagttagtatactagtccccttgtacttatcgaaatctggcaccttcaacttcggggggatgacgacatcaggcactaaacataactccaccatgtcggcgaacggtgcagaggttgtaacgggcggtgttgaggagccctcgcggcattgggctgaggcataccactacaggtcgtcgctcagcagcgagcgtag

SEQ ID NO: 57139 - DNA, 537 bp, Glycine max
  Peptide Sequence Number=SeqID_148824
atggccccgaggaagcttgcctcaaagaggtccaggaaggacaaggcggccgaaggaactagttccgccccggagtacgacagtcaccgctttaggagcgttgtacaccagcagcgcttcgaagccatcaagggatggtcgtttctccgggagcgacgcgtccagctcagggacgacgagtatactgattttcaggaggaaatagggcgccggcggtgggcaccactggttactcctatggccaagtttgatccagaaacagtccttgaattttatgccaatgcttggccaacagaggagggcgtgcgtgatatgagatcctgggttaggggtcagtggatcccgttcgatgccgacgctatcagccagctcctgggatatccgatggtattggaagagggccaggaatgcgagtatggccagaggaggaaccggtctgatggggaggcgagtgcgaatcatgcgcaccaatatgaccaccctgacccagatatggatgacgttgctcctcagcaacatcctgcccaccgatcataa

SEQ ID NO: 57140 - DNA, 209 bp, Glycine max
  Peptide Sequence Number=SeqID_148825
aggtgtcatcctctgaagaggatcttgaagaggacctagaggagtttcctcctgaacttgctgtggaagcccctgacttcccagaggatgatgaggacccactccttgatgtcaattctccagaggatattatgtcagcatctgaggcagactctacagaggagagtggccttggagggacaacgaatagtaacgactcttcatcatag

SEQ ID NO: 57141 - DNA, 50 bp, Glycine max
  Peptide Sequence Number=SeqID_148826
atgtcgagaaattcgaatggtcataactcttcatacagatgtccgattcg

SEQ ID NO: 57142 - DNA, 657 bp, Glycine max
  Peptide Sequence Number=SeqID_148827
atgaaagagcttgaagaagaaaagaagcaaagcctacaggcttggaaaaaggagctgaaggatgccatcattactgacctatttaacggagacaaggactcagcactgactaattttgacttaaatgtgttaggtgcatgcgtgagcactaaggagagcaatgctgaaattgctgtgaacccgtctggggaagtgcatgttggtcgtgtaacaccgcctatggggttgtacgtccaaagtcaaaattgtacaaagcaggtggcgttggcaaaaattcatgatggaccatccaccatacattgcgtagcgtatgcagatgatgtcgtaagggttagcgtcgaacaagtaattgatggtgaagctgaagttccattaccgacatcagaaattaagtatgtgagagatgtcgttaacacattcattgcatggccattgcctttgcattcaggcatcactccagacaaagttgccaatgctgccgaattaaacaatgatgttcctaagcaggaccccttgcgtgagttgattaagacccttgttgacatttacgacaagcctgttgagtttgtgtgggatcttactgaatttgggattccaaatcgaaataacatcaggcgacaaatgcttgaacatagccatacttcaattgtggaccat

SEQ ID NO: 57143 - DNA, 720 bp, Glycine max
  Peptide Sequence Number=SeqID_148828
atgaccaccctgactcagatatggatgactttgctgctcagcaacatcctgcccaccgatcataattccgacctccccctgccgaagtgtcagctggtgtacgccatcctgacgcggatgagcatccatgtggctcagttaatcgctgatgccatctatatttttgcaggtatggcgcctaccaggcaccctctggacccagataagtccaacagggccctgggatttcccgccttgatcacgggactctgccagtcgttcggcgtccccgtcacgcctagcaaggtaattcggccgcccatcacccgagcttttatcgagaagtgctgcacgcagagacaggtccagggtgatgtaccacaggccgcggacacgccgccacctcatcaggatggcccagccggattgtttgatacagagcagtatttgcggcatttggttcgccagcaggcggccaaccaccgggcacatgtacagactcatgattgtctatatcagatgagtctcagcctgcagagtcagggctttactcctttcccgtgccctaccccggaccagtttagggcagaggtcgcgtggcctggggattggcctgaggcccaggcagcagaggcaccagcaggggcgccagcagaggctcccgatgaggcggatgaggcccgcgaggacgaagagatgacggatttacttgatttcttaggagggagcggagccgcatga

SEQ ID NO: 57144 - DNA, 291 bp, Glycine max
  Peptide Sequence Number=SeqID_148829
atggttaactatatgtgtaaatcttttctgcatgctatgaatgttttcattagggttcatcctaaacaattcatattcatgtgtaaaggtattgactctagatcttttaacatcagtggtgacttcatgtgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 57145 - DNA, 297 bp, Glycine max
  Peptide Sequence Number=SeqID_148830
atgggcaccatcaagtgcaatggccatagacaaattaaagcgcctaagcatccccgtagcgaatgcttagattctttaaccactcaagtcccccacgaatgggtcatccgaaaaggtcaatgcaccccccatgaacatacacaacatgcacatgccaatgcatttccaacatcaatcaacattccattttcatatcattctccacatagacatcatctcgtctcaatgacgttatcaacaacaaaaacctcgtttcatatttacataataatcaacaataacatcaattcatgttga

SEQ ID NO: 57146 - DNA, 846 bp, Glycine max
  Peptide Sequence Number=SeqID_148831
atggccaagttcgatccagaagtagtccttgagttttattccaatgcttggccaatagaggagggcgtgcgtgacatgaggtcctgggtgaggggtcagtggatcccgtttgatgcatatgctatcggccagctcctgggatatccgttggtgctggaagagggccaggagtgcgagtatggccagaggaggaaccggtctgatgggttcgatgaggaggccatcgcccagttgctatgtataccggggcaggattttgcccggactgctgcagggaggcgagtgcgaattatgcgcaccaacatgaccaccctgactcagatatggatgactttgctgctcagcaacatcctgcccaccgaccataatttcgacctccccctgccgaagtgtcagaatcctgacgcggatgagcatccatgtatggcgcctaccaggcaccctttggatccagataagtccaacagggccctgggatttcccgcactgatcacaggactctgccagtcgttcggagtccccgtggcacctaccatggtgattcggccgcccatcacccgggcttttattgagaagtactgcacccagagacaggctcagggggatgctccacaggccgcgggcgcgccaccaccacctcatcaggctggcccggctgggtcatttgacatggagcagtatttacggcatttggttcgccagcaggcagccaaccaccgggcacatgtgcagacccatgattgtctataccagatgagcctcagcatgcagagccagggcttcgcttctttttcatgccctactccagaccaatttagggcaaaggtcgcatggcccggggattga

SEQ ID NO: 57147 - DNA, 258 bp, Glycine max
  Peptide Sequence Number=SeqID_148832
tggagggcacaccgtgacaatcagttcaacaaagaccagagtgggccttcaaacaggccaatccaacaaggacctaacatattccaaagaactactaagctggaggagaccttgactcagctaatgcagaatcccaaggaggaatgcaaaactgtgatgacaaggagtaaaaggtttgtggaggttaaggatgaggatagtgttgtgcataagaagaaaactactgacaagaaaagtactgatggaaagaaaaaatga

SEQ ID NO: 57148 - DNA, 441 bp, Glycine max
  Peptide Sequence Number=SeqID_148833
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccctccgttcgtgcgccttcctgattgctgatggtgttatcccgtcgaatgaaaaccgtggctatgtgctgcgccgcatcattcgtcgcgcggtgcgtcatggggggatcctctag

SEQ ID NO: 57149 - DNA, 162 bp, Glycine max
  Peptide Sequence Number=SeqID_148834
atgtctcaagttaaagaattgttggagaagggttgggtccaagagagcctaagcccatgtgttgtgccagtgttgttggtgcccaaaaaggatgtgatgccattttgggcaatcactaatcaccgaagtcacctttatgaggcttatgcatcattgtcttga

SEQ ID NO: 57150 - DNA, 933 bp, Glycine max
  Peptide Sequence Number=SeqID_148835
atgcgatcctgggtgaggggtcagtggatcccgttcgatgcggatgctctcagccagttcctgggataccctttagtgctggaggagggccaggaatgcgaatatggccaaaggaggaaccggtccgacgggtttgatgaggaggccatcgcccagttgctatgtataccggggcaggattttgcccggactgctgctggaagacgggtgcggatcatgcgcaccaacatgaccaccctgactcaaatctggatgactttgctgctcagcaacatccaacccagcgatcataattccgacctccccctaccgaagtgtcagctggtgtacgccatcctgacacggatgagcattcacgtggctcagttaatcgttgatgccatctatctatttgcaggtatggcgcctaccaggcaccctctggacccggataagtccaacagggccctgggatttcccgctttgatcacaggactctgccagtcgtttggagtccccgtcgcacctagcaaggtgattcggccgcccatcacccgagctttgattgagaagtattgcacgcagagacaggcccagggggatgctccgcaagccgcagacgtgccgccacctcatcaggctggcccagctggatcatttgatacggagcagtatttgcggaatttggttcgccagcaggtggccaaccactgggcgcatgtacagacccatgattgtctttaccagttgagccttagcctgcagagccagggttttacttcttttccgtgccctactccggatcagttcagggcagaggtcgcatggcccggagattggccagaggcactagcagaggcaccagcagaggctcccgacgaggcagatgaggcccgcgaggacgaggagatgaccgatttacttgatttcttaggagggagcggagccacatga

SEQ ID NO: 57151 - DNA, 702 bp, Glycine max
  Peptide Sequence Number=SeqID_148836
atgtggtcatgggtaaggggccagtggattccttttgatgcaaacgccctcagccagttcttgggtgacccactagtgttagaagagggccaggagtgcgagtttagtcagagaaggaaccgagccgatggatttgacgaggaggccattgcccagctgttatgcatatcgggtcaggattttgcccagaccgctgccgagagacgggtgtggatcatgcgcaccagcatgaccaccttgacccagatgtggatgacgttgctgctcagcaacgtcttgcccagcaatcataactccgatcttcctctgccgaagtgtcagctggtgtatgccatcctgacacggatgagcgtccatgtggctcagttgatcgttgacgccatttatttatttgtaggtatgccacctaccaggcaccctctagacccagataagtctaacagggccctgggtttttcagcattgatcacgggtctctgccagtcattcggggttcccgtcacacctagtaaggtgattcaaccgccgatcacccgggccttcattgagaagtattgcatgcctagacaggcgcagggtgatgcaccacaggctgcagacgcaccaccaccacctcatcaggctgatccagttgggtcatttggcatggagcggtatttacagcacttggttcgccagcaggtgaccaaccacagggggcag

SEQ ID NO: 57152 - DNA, 398 bp, Glycine max
  Peptide Sequence Number=SeqID_148837
cgttgatcacgggcctctgccagtcattcggggttcccgtcacacctagtaaggtgatccggccgccgatcacccgagccttcattgagaagtattgcacgcctaggcaggcgcagggtgatgtgccacaggccgcaaacgcaccgccgccacctcatcaggctgatcccgctgggtcattaggcatggagcgcctcagtcagcaggatcagggattcgctccttttgcatgtcctactccagatcagttttgggctgaggtcgcatggcccgaagattggcccgaggaccagacggaggaggcacctgcaggagctcccgacgatgcagaggatgcccgcatggatgaggagatgacagacttattcggcatcttaggaggaagcggagccacgtga

SEQ ID NO: 57153 - DNA, 204 bp, Glycine max
  Peptide Sequence Number=SeqID_148838
atgactgttctaggcggggcgggccacccaccttcgaatggtgttggtcctacggaccgtgaatggattcgcctctggcctctgggcaccctatctttctccatatggaagtgctgcgggcacatagagatgtgggtagaggaagtctcaaaaagcgaaggccgagctgtagggtcacgtgacctgcaccgagttggtggctga

SEQ ID NO: 57154 - DNA, 690 bp, Glycine max
  Peptide Sequence Number=SeqID_148839
atgcttggcctacaaaggagggtgtgcgagatatgcgatcttggccagttcttgggataccctttagtgctggaggagggccaggagtgcgagtatggccagaggaggaaccaggccgatgggtttgatgaggaggccatcgcccagttactgtgtataccggggcaggattttgcccggactgctgctgggagatgggtgcagatcatgcgcaccaacatgaccaccctgacccagatctggatgaccttgctgctcagcagcatccagcccagcgatcataattccgacctccccctgccgaagtgtcagctggtgtacgccatcctgacacagatgagcattcacgtggctcagttgatcgctgatgccatctatctatttgcaggtatggcgcctaccaggcaccctctggacccggataagttcaacagggccctgggatttcccgctttgatcacaggactctgccagtcgttcggagtccccgtcgcacctagcaaggtgattcggtcgcccatcactcgggcttttattgagaagtattgcacgcagagacaggcccagggtgatgctccgcaggccgtggacgcgccgccacctcatcaggctggcccagctggatcatttgatacggagcagtatttacggcatttggttcgccagcaggcagccaaccactgggtgcat

SEQ ID NO: 57155 - DNA, 291 bp, Glycine max
  Peptide Sequence Number=SeqID_148840
atgtcagtgaaaaacctcgtcggacgcctaggagtacatgacaagacagaccccacactgggagaccaattagggtcactctgttatgtgagaatgctccaaccatatgggatcagcataggcttcaaggaacattcaaatcaagtgtatttacctccaaggcctatactccgaaaagtctgtcagggcctctctctcttgattcaagtccaacccaaaaatcatttcagcacgcagactctatctatgaattttacaaaacttactactcatcaattgttctcaaaataa

SEQ ID NO: 57156 - DNA, 342 bp, Glycine max
  Peptide Sequence Number=SeqID_148841
atggcatcaagaaagagagagttggctcacaacaggccaatcatatctatggagcagtttctggaaaaagtggcatggcctgaagctcagctccctctcgaaagagcccataaggttgttcctcccagacctataccagctaagactgagccgacatcagttgaaccacaacctcctgtagtagatccacctgcttctctggaacttgagacattgtctcctccggcaccacctctgataatcatccccgatgactcagttgatgaagctactgctcctcctgattcaccatcttgcaacatagacaatggttctgacttttctgactggatggactgctga

SEQ ID NO: 57157 - DNA, 926 bp, Glycine max
  Peptide Sequence Number=SeqID_148842
catctgattctaattttttgtctgagaatgaaaattgtcaatccagcgctaatgaacctacaatcaacagtgaaggctattctgacctcggtgatcaagccatgcaatgtagacattgtaatgcaaaaatgtggtataatgaaagaatttcaaaagataaaaatacaacaagcccaaagttcagcttatgttgtggagatgacaaagttgaacttccattattacaaaatccaccaaaacatcttgaacgacttttgtttgatgataatgcaactgatagtaaaaattatcaatataacatacggacatataacatgatgtttgcctttacctctactggtattaagctagacaaatcaattaatgaaaccaaaggacctcctacaattagaattcaaggccaaccatgccatcgaataggcagcctattaccaatgcctggaaaacaacccaaatttgcacaattatatatctttgatacacagaatgaagttgaaaatagaattaataccatgagccaacatgttgcaattcagccacacattgtttcaactttaagtcaaatgttggatgaccacaatgtccatgcaaaaaattttagaatggccagggatagattgacaaatagtcaagtagataatgtgaaattgagattgatagtcagtcgtgaaaaggatggtcgtacatataatctcccaaatgtttctgaagttgctgctctcattgttggtgattttgatgcaaactcaagaagggatattattgttgaaactcaaaatggagaattacaaagaatccatgaattacactctagctatctaggactgcaataccctttactctacccttatggtgaagatggatatagacctgacatacttcaccgttctacatttgacaacaaaaaaggaagagaaatcgtgtaa

SEQ ID NO: 57158 - DNA, 378 bp, Glycine max
  Peptide Sequence Number=SeqID_148843
atggcagaacaagctaaacaagtattttatgttcaagacccttgtgatgaaaggaggaaaatagttacaccacccagctcccctcctcctcctccttttcttgattcaacatcacattcaccttctaccatgaagaggacaagaaaagcgacccaactgagatcattggctactatacccattggggcagagagacccctggtccatgaggatcctgcaattgggaaagccgatggtccccacaaaaagaagttaagaacatatttggggatcttcgctcgtgaaaaggctgaatttgatatccgtgaagcatctgatatgaggacgaaaaaaaatacttcggaccatgggggagcaatggacacagttcaagtttga

SEQ ID NO: 57159 - DNA, 468 bp, Glycine max
  Peptide Sequence Number=SeqID_148844
atgggattgaaccaagcactctcttttaagaaaaggttctatcatgtcataatcaagagcctagaagtagctagtttgcaagagctagggcagcgaatgaatctacttcaacgtcaaacctttcgcaagacatatgaaaagatctgggattttgctatgatagaagtgtttgttaaagccattgcatccctcgctcaatattatgaccggtcgctaaggtgcttcacgtttggggactttcagttagtaccaatcttagaagagtttgaagggatcttgggatgcccactaggaggaaagaagccgtatttgttttctgggttatacccctccatgaaaagagtagcaaaggtggtcaaaatctcggcgcaagaattggaccgagtgaaacaaaatagaaatggggtggttgggataccaaagaagcacttagaagagaaagcgaaagctttggtggatcaaggatag

SEQ ID NO: 57160 - DNA, 321 bp, Glycine max
  Peptide Sequence Number=SeqID_148845
atggaggatggatctttgagcttcaatggtgattttccaccatggagatgcagcagaagatataggagaatagatgagaggatgtgtcatcgacgagggaataagccatggaagaaggagcttcaccaccaagaatgcgccttggataagaagcttaaagagaaagattcaatggaggaaaagaaagatgatataagatccattagagcttgtaggcctaggatcttcttcatcaatggattcctctgcttcttggaagatgaatggcagtggaatggagaaggaagagagagaggagatgccactttaaggagaagatga

SEQ ID NO: 57161 - DNA, 426 bp, Glycine max
  Peptide Sequence Number=SeqID_148846
atggaggtcttgtctcttgctgaaattgcatattctggatggtcatttgcctcactaaatcttctaaggaaggttgaggaggggcctcagttgcttgttgtctttgttgttgctgcattggaggaggaacacatggcttgcatggaccagcaacattctggaagggaggggcaggctgttgttgttgtggagtacttgtccatctcagatttgaatgattcctccaacctggattatgaagatgaatccgtggccacctcatggactcctctaaggacaatagcatcatttcttgcactgaattattgggagttggaagccatcttctcaatcaaattcctagcctcagcaggagtcatatcaccaagggctccaccactggcagcatcaatcatactcctgtccatgttgctaagtccctcataa

SEQ ID NO: 57162 - DNA, 270 bp, Glycine max
  Peptide Sequence Number=SeqID_148847
atgacgaacgatagttcgaagatgacaagcaagtttgcgaagttggacaagtttgaagggcaggatttcagaagatggcagaagaagatgcactttctcttgacaacattgaatgtggtgtatgtgctgagtacaccgatgccggtgtatatggaagacgaaactctggatcaaacaaggaagcgttcgaaatgggagaacgacgattacatttgtcgtggacacattctgaacggtatgtctgacttcaaaattgatagtgatcaaaat

SEQ ID NO: 57163 - DNA, 198 bp, Glycine max
  Peptide Sequence Number=SeqID_148848
atgagagagggaggttccgagaaagagagggagagattgattgatggaagagggacggtgactggggctggagttacttgcctatggctttcgcagaaggtcgttcaagggcaaaatcgtccgtttcgggcttccgcgggagtggacagtgtggtgcaggctaatttccgtgggaccggatcagaatttaggatgtag

SEQ ID NO: 57164 - DNA, 390 bp, Glycine max
  Peptide Sequence Number=SeqID_148849
atggattgcacaaagaaattagaaaagaagggttgggagaaggaaataaaatggttcattggggttgttgaggagaaggaggaaggagaaggaggaagaggaggggcggtagattttttcgcgcatctccctcttctcccgcatttgtgcccttcacagaacattgtcttcctccctcactcccatccaaatcctctccctccaccgccaccaccactgccaccgcctctgcttcctctcagctcaccatcctcccttcctttcaacactctcactccctctccatcctctatcgtagtgatgctaggagataggccatcaaagtttttgattagcaagaatcaaatcatgggagtgaaggattttgagtatgacgaggcgagggagtga

SEQ ID NO: 57165 - DNA, 1260 bp, Glycine max
  Peptide Sequence Number=SeqID_148850
atgaccgtcgaagaggctaaggaacaagatcatggggttctctgtcaacacccttccccctccccccagttccctccaccatccccatgtcgtcaccattgccgtctcaccgtcgtgtgttcctccttctgccgccgtagtcgaagccgcagacatcacaacaaattatctcttcccaccaccacctccacctcctcatttgaaccgaagctcgaagctgttatcgacctcactcccttaaccgctttccaatctgaacttcgacgacggttcctatcttccggcaaagacgcttaccaagatttgcaaaccttggtcactctcgaccacaaccggaggttttcgtcttggcatcgtaacacgtctagccataagcttgttgtggtgcggagggaccgaagtctcggcggaaaagaggtggttgttgcatgggtcagagaagtgacacgaatccgttatcagtgctggaaattgcccaaatgttggtcaactgtaatcaattccaacgcttctgtttttgacgccaatgagcaggaggaatacaagagagaggcttatagagtggttcgagcctccaaccaagttcagttcaaagacacacttcggtcttctcttacaaccaccaccaccactagtcctcaattaaccaactacttttcctccaactccgacaacaacctacgaatcctcatcggcatcctcacactacccgaccagcacctacgccgcaacctcctccgcctcgtctacggcacgcagccagccccacccggcgccaaaatcaatgtaaagtttgtgttctgcaacctcacaaaggaggaccagaaagttctagtggcccttgagatcatgcggtatggcgacatcataatcctagactgcaaagaaaacatgaacaacggcaaaaccctaacctacttctcaagtctcccggagatgttaaacgacacggcttcatcgtaccctccttatcactacatgatgaaaaccgatgatgacacgtatttaaggctgaacattttggtgcagtcgctgaaaccgttgtcgagggaagacttgtactatgacattgtggagtggataaggaattcggatatttcgaggaagttcgagggtcctgaggataaggtttttggagagtggatgcgtgagggtggaaaagggaagcatagtacgggtgtcgtgtcggtgtcagacactgacacggacgcgtttcagacaccggacacgacaaggagctggagtgtctgtgcttcatag

SEQ ID NO: 57166 - DNA, 564 bp, Glycine max
  Peptide Sequence Number=SeqID_148851
atgcattatctttacataatacttggttcctcagatcttccacacaagaatctcaagtccagcaatgttctccttggaccagaaaatgaaccaatgcttgtagattacgggttcagccacatggttaacccttcaaccattgcacaaacactgttcgcttacaaggcatcagaggcagcacaacaaggccagatactgacaggatggttcccttctcagtatctcaacaatggaaagggtggggctgatgtggtgcaatgggtggaaactgcaatctctgagggaagggaatcaaaagtgcttgatcctgagattgcaggctctaggaattggcttggtgggataaagcaactcctccacattggtgcttcttgcactaaaagcaaccctctgtggcggttagacatggcagaagctgttagaaggataatggagattaaatttgagggtggacatgaatcaagaagccttgcagattctcatcatggtgaacaatcacagaggagacatggaacaaacaacttcggaagcagggatatatcgaatatggcagctcctaggtaa

SEQ ID NO: 57167 - DNA, 126 bp, Glycine max
  Peptide Sequence Number=SeqID_148852
atggctgtggagttagggcaacagacggtggagctctccaccctcgctttgacttcagcaagtgatcatgaaattgatggcgatgatgataacttagacgagtttcttgaggggatgtttccgtga

SEQ ID NO: 57168 - DNA, 405 bp, Glycine max
  Peptide Sequence Number=SeqID_148853
atgcacctcttcccatatcctcaattggtcaccctttttctctgtcattttcaaattcctcttgatgatgaaccttttgttcaagtcaagagatcttttgctataggtgctggtgtagtaacttcatttggttactgtaaggatcgtgatggacaatggctgaagaaggacgcactacctccacaagacgagcgtactccttctcctccttctcaaagagattattccttagtccttatgaatgaagttctttcagaattacggggtctctgcacatatgttggcgaacgctttgattccttggatggtcgctttgaaggaatggatacccgtatcatgcagcttgaagaggatgtgacttatcttcgtcggtgcttcgaccttccaccaccttcccttttttag

SEQ ID NO: 57169 - DNA, 516 bp, Glycine max
  Peptide Sequence Number=SeqID_148854
atggattatcaagagtatcagaggtcattacacttgtctcgtgcatactcagacaagatgatcgctacaacacaagatggagttaaccatatcttcccgattgcctatgccattgtagaaggggagacaacttcagcttgggttacgcatacatggagaagatgcactgacaacatcttggggatacccatgcgaataagccaagtgcagctaaatgacttgatcagttacaaaacaaaattggagaaccaatccccacttctagcacctagatcaccacctggaaggtttagagtaatgtttcaatctcaaaagtatgattatggtgaatatcaagctaaacacttaccgtgttctcacgtcatgctgcctaaaagagatcagtggggtcctgatccaaggagaaagaggaccgcaaagggttgtccggtttcaactcgtatttctactgagatggatgaagatgaaaatgaacggaaaaatagaaaaaaaatgtggaatttgccaacaacatga

SEQ ID NO: 57170 - DNA, 174 bp, Glycine max
  Peptide Sequence Number=SeqID_148855
atgggcctaaaatctaccctaaggctcatgagaaccctagggccttctcctgcatccctagcccaatcttcctggactctcctagccatgactctagtgatgggatctttctgggcttctccacatttccttggcactaagtcacctactaggaagtttcttggtttaacctga

SEQ ID NO: 57171 - DNA, 522 bp, Glycine max
  Peptide Sequence Number=SeqID_148856
atggctaccccacacaactctgctcctccttctcctcttactggtgcagcatcacatttgccgtctaacatgaagcggacaagaaaagccacacacctaagatcattggcgactagaccaattagggaagaaacacccctggtccatgtggatcctatgactaagaaagccgatagtccccacagaaagaagttaagaacatatttggggatcatcgctcgtgataaggtgtttaagtctgatttgacatcaaaattggcacttgcagttgacaaggataatgtggatgacactatatgcaaagagtgtcgcattagcaaggagaactgggcccaattttgtcagagccacagagacccttcctcggagaaacaaaacaatgcccttcgcgagttgtctcgtgggggttatgaatttctggaaaacaagttgatggagaagaagaaaaggaaacaacttgaggaagttgctaaatttggaagcactgacactgtcattgatcctccatctcctatcagatga

SEQ ID NO: 57172 - DNA, 132 bp, Glycine max
  Peptide Sequence Number=SeqID_148857
atggcggcaattttctcttctttgctcttcgtttcctcgcctattcccgaatccataaagctccacaacttttcagggctcgctcctcgctcctcgctccttcaggataaagaggaaaaagtgatcgtgtag

SEQ ID NO: 57173 - DNA, 294 bp, Glycine max
  Peptide Sequence Number=SeqID_148858
atgatggataccttagagccttacactggggcaatgaaaggcaccatgcttgagcctcaggcgaacctaggggaagttcagggatgtttaggagagaaatcggccaaaaacacaaaaattggagtgtatttagcaaaccgggggtgtgtaaatagattgttacaccctaatttcttcctgggatcgctgttgatcacttcggaaggcttaacacccattaccgttgaatccgtaaagttccgtgaggtttcacaaggaaaacaaccaaaaacacaaaaacaggagagggggtga

SEQ ID NO: 57174 - DNA, 765 bp, Glycine max
  Peptide Sequence Number=SeqID_148859
atgcatagcataggagtcaggagcactttggaacaactccccttggcctatttatggaaaaaagggggtgggttacgggaattttatggaagcattacggaagccctgaaagccatttttcaacaaaactggggaggaggttgccgcccagctcgcccaggcaagctaggttacttcctccttaagcaacccaacttccaaaatgttctggaagggcccagatttaaaaatttctatttacacctccagattgataagttcaccccccctcatttttgtgtttttggttgtttttcttgcgaaacctcatggaactttatggattccagggcgatgggtcttaagccttctgaagcgatcaacagcggtccccaaatgaaattagggtgtaacaatctatttacacacccccactttgctaaatacactctcgttttcgtgtttttggccggtttctctccgaaatatcccataactttatggattccatggagatgggtgttaaacattttgaagtggtcaaatgaaagtcgcatgctgacaaacaatggtcctcggacgaaattagggtatgacactcatgaagataaccaattggtaaatgcactagccactttatcatctatgttcgcattgagcaatgatgaggtcatgccacttataaggatccaacatcatgaatcttctgcacatggtcacttggtagacgaggaatttgatggaaaaccacgatactttgacatcaaagagtatatcaagaattga

SEQ ID NO: 57175 - DNA, 594 bp, Glycine max
  Peptide Sequence Number=SeqID_148860
atggagaatcaggttggagcattgcagaaggtcaagaaagtagaattacccacttttgaaggtcatgatccattggggtggctggccagagctgaaaaattctttgaggtgcaacaagttaaaccctcagataggttaaggctagcattccttagtatggagggaaatgcaatacactggtttcaatactggcgtctaaaatccaagaatccatcttggaaagaattctcatactctttgataagaaggtttggaggaaatacgagaagaatggtatatgaaagactggtttctctaagtgtgaaggaccaaatcttggggtatttcttggctggtcttgtggaagcaatgtcttccaaagttattttgatgatgccaaagaatcaagagttaagcaaagattcaagattcaagaataatcaagatcaagattcaagactcaagattcaagaatcaagagaagactcaatcaagatacttattaaaaagtttttcaaaacattgagtagcacaagaagttttcaaaaaatcattaccaaagagttttactctttggtaatcgattaccagaaggtagtaatcgattaccagtag

SEQ ID NO: 57176 - DNA, 273 bp, Glycine max
  Peptide Sequence Number=SeqID_148861
atggccacttgcatggcatgttctaggtatctaaataatgatatagcaagtaacaagaaaaaactcaagaatcagcagggcaataaccccaaaaagctcaggttgcatacttcctatgtacttattgtcctttcactttccatagtcaacctgatgcaatcctaccccgcaagggcattggatagaagactccaagtagattgggccagagatccaatggaaggccctagggttctcatgagccttagggtagattttgagcccatcggctaa

SEQ ID NO: 57177 - DNA, 318 bp, Glycine max
  Peptide Sequence Number=SeqID_148862
atgatggtcaatgtctcaacgtctttgtgtggaagcaatgctttccaagattattttgatgatgccaaagaatcaagtctagaatcaaaagtcaagcaagttccaagaatcaaagaatcgttcaatcaaagcaagtttcgaagaatcaaagaatcgttcaatcaaagcaagtttcaaagaatcaaagagtcgttcaatcaagattcaagattcaagattcaatgtacatcctttgtggtacaagtagagggtacatctacttgggttgctatactgagaacaagagatggtacatctcttgtggatcagttcaagtga

SEQ ID NO: 57178 - DNA, 153 bp, Glycine max
  Peptide Sequence Number=SeqID_148863
atgactggcaaagaaatgaggggtggaggttgcatagtagctcgcctaggcgagctagttgctttctccagaagtaaccttgctcgcccaagcgagctagttacttcatccctaagcttttttgtggcccaggcaagccagaggctagcctag

SEQ ID NO: 57179 - DNA, 344 bp, Glycine max
  Peptide Sequence Number=SeqID_148864
gctcgcttgcctctagctgaaaaaaaggtgtggataaccataaggtatctccgcatgtcatcggacttgtcgtctctggatgacaaaggtgcagatgatgattctcggccggaagacgctgacatctccgggaaaggtgcagatgatgatatagcaaatgagactttttcccagtctcagccggaagatgctgacatctccgggaaaggtgcagatgacgatggcgaggacggaaattctcatcctgggtcaaggttcatggtgagttgggattttggctcagagcttgtagaacgactggacatgatatatgtcagggtgttggtttggtcagcagtccaggg

SEQ ID NO: 57180 - DNA, 1080 bp, Glycine max
  Peptide Sequence Number=SeqID_148865
atgggtcaacttcaacgtcaagcttttcgcaagatatatgggaagatatgggatttggctatgatagaagtgtctgttgaagccattccatccctcattcaatattacgaccagccgctgaggtggttcatgtttgggaactttcagaggaaggaagccgtacttgttttctgggttctacccctccatgacgagaatagccaaagtggtcaaagtcttggcgcaagaattggaccgagaagcactaggaagagaaaagtgaaggcttttgcggaacaaggtgaatgggcttcattcattgatgtcttagtgctattggtgttcggagtcgtcctctttccaaatgtggatgggctagtggatttagcggcaatcgatgccttccttgcttataaccacatcaaggaaagttcaatcgttgctattttggccgatgcctatgaaacatttgactggagatgcgagatgagcagcacaaggattgtttgttgcacccccgctatttatgtatggttggtctctcacatcttttgtcatgaaagtagacctgtctctcctctacaaggtcaccgcatgtgtgccgagaaagggaaagcaaattgggagcaactcctgactggtatgacaacttggctaccccatgagaagagcaccatcggaagagagtatcgcaagcctttcattgcacgaatcttcagtgaaccaaaatcaagagtgcttcaaagagttcgaaaagcatggaatgcggtgcacaaaaaggataaggagcttaagggaagcaacaatgggatcgtcggcggctatcacaagtggctgagggctagaatgcaagagataacttggctcccaaagctaaagatttcaagtgaggaagaggctgaaaccccagaggagagcgaagaggtgcaagccttgaaggcaaaacttgaaagagcacaagcggtcaaggaaaagttcaagacgacgaccatcaaggtccgaaaagagtgtgataagctgagggacgtcaacatggccacaatcgaagcattagaacaggaaacgaagagggcccgaaacaagttccgaggggttttgtag

SEQ ID NO: 57181 - DNA, 381 bp, Glycine max
  Peptide Sequence Number=SeqID_148866
atgtccccaatagaagtgtcaactgtcgcaacctacccttcgacgagagggcaagtgagactcaagggtgcatcttccaagaaaggaaaagacgagggagtcgccaccaacgtttattccaggaaaacgttagaaaaaccaagaaaggggtctacgaattttaagaataagggttcaggagttgtttacatcgacaagggtgttgcccttgctcctacatatcctcaggaaatgaggggtggaggttgcatagcagctcgcccaggcgagctggttgctttctccagaagtaaccttgctcgcccaagcgagttggttacttcatccctaagctttctggtggcacaggcgagccagggacctgaaaacgtcaccaaatga

SEQ ID NO: 57182 - DNA, 78 bp, Glycine max
  Peptide Sequence Number=SeqID_148867
atggatacaggtctcaagtgtttggaagtggtcaaaggaggtagtcgtaggaagttttctggcaggaaaccaacatga

SEQ ID NO: 57183 - DNA, 267 bp, Glycine max
  Peptide Sequence Number=SeqID_148868
atgaccgacatatgtttggtgtctgtcgcaacctacccttcggcgggagggcgacgcgagactcgcgggatgcgtgttccacgaaaggaatacgcacggagtcgccaccaacgtttatttgaggaaaatgtcagaaaaaccggaaacgacgcgatctacgaacttttaagtgaaaggttcgggagttgtatttacgcacggggaagggtgtttccctttgctcctacgtattcctcaatttgcgatgaggaaatcagacctacgtag

SEQ ID NO: 57184 - DNA, 462 bp, Glycine max
  Peptide Sequence Number=SeqID_148869
atgcggccgctgtgggtcacgcctcttagcttgatgatattgtcactttggcggaacacacgttgctctttctcgtccttgttgccgatctcgagtcgaccttggtctatcatccgttgcaacaactcctccaccactgagaatgtttccatatcatgtggtgcacccgagtgcatcaatcaaggatcccccttgtgcctaccgagaggaaccacgcctgcctcttgcagggcttcaaaaataaacctcctagaggttgtgacgtcctttaaatgcttaggcctttgcaaactgcacacctcaattgcattcacagtcgatcccccgtggttggcgagcgaattcatctttatatttggctcatcttcttggaacgtcaaccatcccacctcgatcaagctctacaccttgtgcttgaggaccatgcattgctcgaccaaatgccctggtgttcccccatga

SEQ ID NO: 57185 - DNA, 924 bp, Glycine max
  Peptide Sequence Number=SeqID_148870
atgggatcaaatcaaatacctctgttcaagaaaaggtactatcaagtcaaaatcaagagcttagagatcaccaatttacgagagttggtgcaattgatgggtcaaattcaacggcaagccttccgcaaagcctatggtaagatttgggacctagctacgatagaagtctccgtggaagcgattgcatcccttacccagtattatgaccaacccctgaggtgcttcacatttgaggatttccagctagtgcctagggtggaagagtttgaagaaatcctgggatgcccgctgggagggaggaagccatatcttttctcagggttctatccctccatggctagagttgccaaggtagtgaaaatctcagcacaagaattggactgggtaaagcaaaaccgaaatggggtagtcgaagtaccatggaggtgtttggaggagaaggcaaaggccttggcaaatcaaggcgaatggacttcctttattgacatgttggcgcttttgatcttcggagatgtgaaaagagcggcgcaagaattgtttgttgtacatcgactctctatgagtggctggtttcacactttttttgccaagaaggtaggcccgtttgtttgctacaaggtcaccgctcgtgtgccgagaaaggaaaggcgaattaggaccaactcttggctagcatggaaaaggcatccattaattggttcccttgttggaaggaaggaagaaccgagattttgtcctcgtgtgaaggatttccaaatggtttcagtgaccccaacacaagggtacttcaaggagttcgtaaggcataggatgcagtgtgaaggaaggacaaagagcttaggggaagcagtaatgggatcatcggtggctatcgtgaatggccgagagtccggacacaaggattggattggctcccaaagctaa

SEQ ID NO: 57186 - DNA, 171 bp, Glycine max
  Peptide Sequence Number=SeqID_148871
atgtcggattgcgaatcctatactacagaaaacatggccaggcatgtgtctgttttgtggaaggatattgtgaatttcgacattgataatatgggtgtcaaaactcttccttctgagtatttaatgcagttgcatacttgttcagggctcaaagctgagacccttggttaa

SEQ ID NO: 57187 - DNA, 439 bp, Glycine max
  Peptide Sequence Number=SeqID_148872
ttacagtgtagttttcaaaagcaaaggtgaaaggaaagatattgagctggtagaggaggaacatgcacggattggtgctgatccttctagtgggacctccaataaatctgagaattataaggaggaagcatggaagaaaacacagaagcataaaccaaagagggtggagagtgtcaacgctgatgcagaagcctttgctgaagtagtagaacatacgaacaaaagagatacaggccatcaaaatgtggcattggacaataagacaggagattcaactatgctgaagatgggagattcagctaaagttgtgatcaaacaagacatgaagggaagaaggcataaatatgggtttaacaacaatgaacgtgagaaggcacagaagaaaagggtggtggatgatgaaactggcgacaaacatcagctggatgaagtcctatga

SEQ ID NO: 57188 - DNA, 219 bp, Glycine max
  Peptide Sequence Number=SeqID_148873
atgttgtctatattatcaacaggctgccatcctccttttagaatcaactccattggagcttgtaggacttggatcttcttcatcaatggagttctttgcttcttaaagtttgatagcaacggaatggagaaggagaaggatgattggagacgccacttcaaggagagtatgagtctagaagaagctcaccaccatagaaagccatggataagagcttga

SEQ ID NO: 57189 - DNA, 324 bp, Glycine max
  Peptide Sequence Number=SeqID_148874
atgagggggatctcaaattataattgtaaagagagtaagagaaaaacctttttgattcatgtcactgtgaagagactatatgatgtaagctccattggagcttataggcctaggatcttcttcatcaatggattcctttgcttcttggcagatgaatggcagcggaatggagaaaggaagagagagaggaaatgccacttcaaggaaaagatgagtctagaagaagctcaccaccataggaggccatggataagagcttggaggaaaaaagagatgaatgaggggaaagggagagaagagcacaaaattttgtgttccaaatga

SEQ ID NO: 57190 - DNA, 627 bp, Glycine max
  Peptide Sequence Number=SeqID_148875
gcagcggatatatttcataatcctcttccacaacatcccacaaatccaaagactccatgtaggattgcattttcacttcccaaagatcataattctctccatcaaaagattggaagagttaggtgggaaaaacttgcttcaccttccatggttgaacttacacttcctggagattctacagctgaagttgctaaggttagggcagggagccaatctgccccactttttgctgataataaaccagatacaagtgaaaaacggagacaaatgcacccatctttatcacggaagttcagttcatatgtgctacccacaccagttcatgaatttcctaggcctctaaccagcttcccctccaattcaaggcttttaggtctagtgggtcattctagtccattggtgtctagaggtcaaaaggtttccactgcaaataatttggttgcatcaagtgcagcatctccactgccaatgccacctcagcccatggctcttagtttctccataccttctagtggcacaagagtggcagcattgcatatgccaagaacactagaatcctctcttgatttcactttgaattgtcttagtttggataaggataaaatggagatgaggattaggacctaa

SEQ ID NO: 57191 - DNA, 255 bp, Glycine max
  Peptide Sequence Number=SeqID_148876
cctgctacagaaggatatgataaagcccatgctgttgagattgaagctaccaaggttctcaatgatctcattatctctggcgttgtgcaagaagagatacctaaagtgtccccaacagtgtccaatgttgccaaggatgatgaggttattccaactggtccatctgagcttgcatccaactccttgactattgataatgtccaagctctacttgatatgactttggttaagcaaaaggaggagactcaaacactg

SEQ ID NO: 57192 - DNA, 222 bp, Glycine max
  Peptide Sequence Number=SeqID_148877
atgacacctcgccactgtacccaggtggatgatggggacttgcttgaacatgctgatgcaagacaagatgggaagacaaaggatttggctattgaagttgtcaatgggtataatataataaaggcgacctcgaggcaaaatgatgtgaacctgactaggagcggatcgcttgatacagtctacggagatttggatgatgccacttccggtgaaggaagataa

SEQ ID NO: 57193 - DNA, 384 bp, Glycine max
  Peptide Sequence Number=SeqID_148878
atggactgcaacccttcccagatcgcaaagccgctgccagacaaggtcctccctgagctactcgactgcgttgtgaagtccctcaacgtctgcaatgctgtcatgctcggcctcgacgccatcaagaatctccagcacctcgctgagattgctgtcacagcgctggctcagcccccaccccgcccccgcccccgccccccaaggcgacggtcaaatctgccacgccaagaagcaatgccactgccaagggaaccaaacactcctgtggcgcggagtcctcaggcttggcgcacctttgttggtgttcgtgatgtggactctggttacaacaattccttgaaaacagaggaatggggtcgggactcagttttaattcacgcatag

SEQ ID NO: 57194 - DNA, 759 bp, Glycine max
  Peptide Sequence Number=SeqID_148879
atgggggagtttgcggatgtcccgcatattcctgctgacaacctccacaacttgggctttccttggccttttgccatgtgggagatggatatactgaggccattgccaaaagctccaggacagaaaagtttacatggaagcatgtcatatgtaggtatggactcccctatgccattgtcactaacactcaaattcaaggcccaaacctatgaagaattcctgtcaaggttaggtgtcaagtacctagtaacctctgtcgagcatcctcagacaaatggccaagctgaggcatcgaacaagtctaattactcctatgcatataatacattgacgaatgtcacaatgtctaaaggctcttcaaacccaaggttttgccttggtccgcccaaggcgagtctcataaaaccaaggagaaacatgttccttgtcaaatctccagaggcttgtcaaacccaaggtccacccttggtgagtcttgccaaacctaagataaacatgttcttggttaaatctccaaaggctcatcaaacccaaggttcacccatggtgagtcttgcgaaacccaaaatagacgtgttcctagtcgaatctccaaaggctcgtcaaacacaagatccgtccttgttccttaaagaaaaaacggaagcaccaacaggtgagaagctagaaccagtgtgcacccatatccgtaacatgattattgtgtctgagatgagtggtagcatcactgaactctacaacgaaaagaccttcaaatag

SEQ ID NO: 57195 - DNA, 288 bp, Glycine max
  Peptide Sequence Number=SeqID_148880
atgtgggaaaaggagaggattttgggagaagaagaagaaagaacaaatttagaaggaagaaagagcgtagaaacatatcttaattataaagtgaaggatgacgaatgtagtgatgatgcaagcacaaacatcggttgtctagcaaagggagaactgccaggaaaccacattacaagcaaaacctcaaagagagttgggcttcgtcctcaaaaggaaacaacaccagaaaatctagccttccatggattcaaacagaaaacacaattgaaacatgaagcagaaacgtaa

SEQ ID NO: 57196 - DNA, 525 bp, Glycine max
  Peptide Sequence Number=SeqID_148881
atgccttccataattgaagaacatgaagtgcatgatatacatgcaaattgtaatgatcatgatgaaggtttatgggagaacattcctatagtcattacaacaaccccaaagtcccctacccattcatcagatcctttggagtatacgtataggaggagtagacaatccacacgactaagaagcttaacggtaagaaacttggatcagcttaggccaacagttaatgtcaatccttccagtgggagaggatcaggcccgcataaagaaaagttccacaactatataggcgtgggaaaattttatatcccagaagcatccaatgccaagaagaaggtgatgtcattggtggccactagatggaggcaatttaagtcatccctgaccactaaatgcgtatatgcagacaatgtcaaagaaaacctcatggaggagaaaaggaagaaaagacaagaggaagcaataccgaccaaggattcaacaatgattgtggacccttcatctcctattgaaagacatgtgaagtga

SEQ ID NO: 57197 - DNA, 213 bp, Glycine max
  Peptide Sequence Number=SeqID_148882
atgaagaagatcctaggcctacaagctccaatggagcttacaccagtcaccaccaatgtttattcgaggaaaacgttagaaaaaccaaaaagaggtctgcaaattttgaaaagaaaggttcgggagttgtttacgcatagggaagggtcgacaaggatgtttcccttgcttctacgtatcctcaggtgcgatgaggaattcagacctatgtag

SEQ ID NO: 57198 - DNA, 684 bp, Glycine max
  Peptide Sequence Number=SeqID_148883
atgtgtttcttcaaggaaatgaaatggctccgaaaaagctttccacgaagaggtcttgaaaggacgccacgggaaaaggctctagtgccaccttggagtttgatagtcaccggtttcagagtgccgatcaccagtagcttcgaggccatcaagggatggtcattccacagggagaggcgtgtccagctcagggaagacgagtaccctaacttccagggagaggtagctcgcaggcattgggcacgactagtgacccctatggctaaattcgaaccaaagatcgtcatagaattctatgccgatgcctggcccactgaggaaggggttcaggacatgcgctcatgggtgaggggtcactggatcccctttgatgcagatgccatcagccagttcttgggcgacccgttgattttggaggaggaccagcagtgtgaattcagtcggaggagaagtcgggcagacgattttgatgaggaagccatcgcccagctgctgtgcatactggggcaggatttcgcccagaccgctgtggggaggtgggtgcggatcatgcacaccagaatggcgcctactgggcaccctttggacccagagaactccaagagggccctggggttcccggctttgatcacatgcctttgccagtactacagagttcatgtcactcctagcaaggtaatctga

SEQ ID NO: 57199 - DNA, 401 bp, Glycine max
  Peptide Sequence Number=SeqID_148884
atggcgtgcccgttagcgtacgtaccgaaagagccttcatggacctcccccagcatgctcccaacttctttagcgttcatgcatcagagcaaaaccatgttatggtttctcttgtatagtatgcttccgctcaagaagaaaccggccaccaatctccttaacgtcctcttgtcgttgtcgaaagcctctgctggaacatggatgctaaagtggcaagcgcatcagccatttgattttcctcttgaggaacgtgatggaaggagatctcatcaaaaactcagccaattccttgatataggcctgcttgacgttgaagtcaattgctgcctggacgcccagagtgcatgctttgtattcagccatgttattggtgcagtcgaaccccagcctggccgtgaaag

SEQ ID NO: 57200 - DNA, 168 bp, Glycine max
  Peptide Sequence Number=SeqID_148885
atggggtgctcgcccaggcgagctaaccctgtgcatttttttgcgaagaaagtacatgttctctatgggtcggtgttcgcttactcgaaacctcgtggcacgacctccattccgtataccaaggagaatgatgttgccccggttgaagtgcgcaccgaggttcggtaa

SEQ ID NO: 57201 - DNA, 276 bp, Glycine max
  Peptide Sequence Number=SeqID_148886
atgaagacatgggtcacgttcctccccttatccacgaaggggaacctcctcgacatcctaatggggtccatgagaatcctcgagagcatgctcaaggagatgtcaactcctattccccgtttcccgctgtggggtcggcgcccaatgcactacctcaacccaacatcacgggagagccttgaagccacccaacacaaccaatctttctgtccgtgggaaggccacccatggcagcagaaggaaaggggaaactcgatctcatcgaagagaggttaa

SEQ ID NO: 57202 - DNA, 465 bp, Glycine max
  Peptide Sequence Number=SeqID_148887
atgggattgagtcaaatgccttggcttaaaaggagattctatcaggaactggacctagaaaagctagttgaaaatggggtggtgggagtaccaaggaaatgtttggaagcaaaggcgagagtcctggcaagtcaagacgaatgggccccgttcatggacatcctggcagtcttgatcttcagggtggtcctcttttcaaatgtggatgggttggtggatcgggcagcaattaatgcttttctcgccttttacgaccgcaaggaaaatccggttgtcgttatcttagccgatctatataacacattcgaccaaagatgtaagaagaacaatgcaaggatcgtttgctgtacaccggctctctacgtatggttggtttcacacttcttctgccaagagatgagacacgtttgcccactagaaggccaccgctcatgcaccgagaaaaaagaggcaaactgggactga

SEQ ID NO: 57203 - DNA, 327 bp, Glycine max
  Peptide Sequence Number=SeqID_148888
atgtgcgatttcggagaggtctttgtgctttatgtagagcgggaagtttggattaaagaccccgaacaaggtggcatcccatgtaacctgtggatccctcataaagtcttcctagggcaaccaggcgggcaggatttgcttcaatgtacaagccacacctatctaagtcactcgtctcatgatcgtttcatgagggatcaacataactctccttcgtgcttactcgaggacctgaggaaccaaccagaggccccaaaggtagtgcaagtccctgagattgcatctgggactgaaactgggactgcatctggcttaatgatgccatga

SEQ ID NO: 57204 - DNA, 770 bp, Glycine max
  Peptide Sequence Number=SeqID_148889
acgtccttaccttaagaggactagaagtcctcgccattagagtgctgcacgccctcgccttcagaggactacacggcctcgtctttagaggactgcacgtccttgtcttcagagggctgcatgccctcaccttcagaggactacacgtcctcgccatcagagggctgcatgccatcaccttcagaggactacacgtcctcgactttagagtactgcacgtcctctacttcagagggctgcacgccctcaccttcagagggctacacgccctcgcctttagaggactacatgtcctcgcctatagaggactgcacgtcctcatcttcaaagggctgcacgccctcaccttcagaggagtacacgtcctctccattagaggactacacgtcctcaccttcagagagctacacatcctcaccttcagagggttgcacgcccgctcgtttagaggactagacgtccttgcctgtagaggactagacgtcctcaccttcagaggactagaagtcctcgccatcagagggctgcacaccctcacctttagagggctacatgccctcaccatcagaaggccgcatgccatcttctttagaggactacacgtccttcactttagaggactgcacatcctctccttcagagggctgcacgcccataccttcagagggctacatgccctcgcctttagaggactacatgtcctcgcctttagaggattgcacgtcctcgtcctcaaaaggctgcacgccctcaccttcagaggattatac

SEQ ID NO: 57205 - DNA, 201 bp, Glycine max
  Peptide Sequence Number=SeqID_148890
atggagcttgttttgtttgtgggaagccaggacatttttctcctcagtgcaggagatgacattattgttgcggtcatttatcaagtgaatgttgtcaccgatgtgaacaaatgggtggtagactctagggctaccaagcacatctgtgctaataagaatatgtttatctcctacattgttgtgcgggatggagaagaataa

SEQ ID NO: 57206 - DNA, 168 bp, Glycine max
  Peptide Sequence Number=SeqID_148891
atgatcacaattgagaatgaaaatgcttggaatgaatattgcacttcgcataaatcggctaaaccgtttcgattcaaggtgcttcaaaattgggatgatatagtggatttgtgcctgctaaagcgatctagaggccccggtcatttgggagctgtgaaaaaaagatga

SEQ ID NO: 57207 - DNA, 886 bp, Glycine max
  Peptide Sequence Number=SeqID_148892
ctgtctcctcctgcattccgttaccagctgaccgagctggcgcgtaaagcaggcaaacgcgttgtgctgccagaaggcgacgaaccgcgtactgttaaagcggcagctatctgtgcagagcgcggcatcgcgacctgtgtgctgctgggtaacccggatgagatcaaccgcgtggcggcgtctcagggcgttgagctgggtgctggcatcgaaatcgttgacccggaagtggttcgcgaaagctacgttgcccgtctggttgagctgcgtaagagcaagggcatgactgaagccgttgcgcgcgaacagctggaagacaacgtggtgctgggtacgctgatgctggagcaggacgaagttgacggtctggtttccggtgcggttcataccaccgcaaacaccattcgtccaccgctgcagctgatcaaaacggcaccgggcagctccctggtctcttccgtattcttcatgctgctgccggaacaggtttacgtttacggcgactgcgcgatcaacccggatccaacggcagagcagctggcagaaatcgcaatccagtccgcggactccgcgattgccttcggtatcgaacctcgcgtggcgatgctttcctactccaccggtacctctggtgcaggtagcgacgtagagaaagtgcgtgaagcgacccgtctggcgcaggaaaaacgtcctgacctgatgatcgatggcccgctgcagtacgatgccgccgttatggctgacgttgcgaaatccaaagcgccgaactctccggttgcaggtcgcgctaccgtgttcatcttcccggatctgaacaccggtaacaccacctacaaagcggtacagcgttctgcagacctgatctccatcgggccgatgctgcagg

SEQ ID NO: 57208 - DNA, 297 bp, Glycine max
  Peptide Sequence Number=SeqID_148893
gggacacatgtcccagacattgtctcgacatcaggaaaagctgctgcctcaggtgctgtgtccaaggatgctctgattgctgaactcaaggacacatgcaaggtgctggaagcaaccatcaaagccaccacagagaagaagatggagctggaacggctgatcaataggctctcagaaagtggcattaatgatggagaagcagctgaggaagaagtagaagcagccgaggaagaagaagaagctgctgaggaagaggaagatgcagcatcagatgatgattctgaagccaccccatga

SEQ ID NO: 57209 - DNA, 201 bp, Glycine max
  Peptide Sequence Number=SeqID_148894
atgaggaaatcagacctacgtagttcttgcaaaagcggttatagcgtgaacgatcggttagaattctttttggcaaagggagaagagaatgaaaagatgaatagcacaagttttcaaggtttggaaaaccagaaaacttcagaaagcttttggtacaaagaagaagttcaaagagattcagggcttgtaaaggattgttga

SEQ ID NO: 57210 - DNA, 782 bp, Glycine max
  Peptide Sequence Number=SeqID_148895
gggccctatgcctgggtccatgggaacataaggagtggaagcacacggtgagtttgtccttacgtatggttggtttcacacctgctccgccaagaggccaccactcatacaccgagaaaaaggaggcaaactgggaccgactcttagcaagcaaagaaggagcatctgtcaattggttcccccgatggaaagaaggaagaatcgggattcttatttcatgtggaggatttccaaatgctcccttgatgggaacggggggcctcacaccttttattgcacgaggtttcaatagcaccaatgcgggggtgcttcagagggtccgcaaggcatgggaaatggtgcaaaagaaggacaaggaacataggggaagtagcaacgggcccatcggcagttaccataggtggttgaaagcctacgcacaaggtctggattggctcctgaatttgagaaccactaaagaggtggagggtgaagctccggaagaagacgaagaggtacaagcccttaaaacagagcttgagaaagcccaaacagccaaagaaaagttcaagttagcagctgttaggatccgaaaagagaacgccgagctgagagacgtcaacatagccaccaccaaggccttggagcaagagaccaagagggcccgcaaggaagaacatgaccgaaacaagtttcgaggggctctgtggggcagacgaattgaagacttgcctaaggtcaaagaggagtttgtctcagcggttatgcgagaccgaaacaaacatgttggccatcatcagcaa

SEQ ID NO: 57211 - DNA, 687 bp, Glycine max
  Peptide Sequence Number=SeqID_148896
gatttccaaatgttcccttacaatctcgttcttgctataagacagcttggctaccctatgagaggggcaccactagaggaagagctcacacctattattgcacgaggtttcaataacaccaaagtggaggcacttcagaaggtccacaaggcatgggagatggtgcaaaagaaggacaaggaactcagaggaagtaacaacgggcccatcagcggctaccgtagatggttgaaagcccacatgcaaggtctggattggctcccgagtttgaaaaccactaaaggggtggaagctgaagcaccggaggaagacaaagaggagaatgccaaactgagagacgtaaatatagctaccaccaaggccttggaacaagagaccaaaagggctcgtagggaagaacatggccggaacaaattccgaggggctctgtggggcagtaatagcgagctgaagcttcagagagaggaaagggaccaatcacgagtagacaatttgatcttgaaagatgagttgaaggtttgcctaaggtccaagagaagcttgtctcaacgtatatgcgagacagaggccaacatgttagccattgttagcaagtaccaagaagaattaaatcaagccacggcccacgggcacaaagtgacggacgagtatgcccgagtgtacgcggaaaaggaggctagaggaaag

SEQ ID NO: 57212 - DNA, 273 bp, Glycine max
  Peptide Sequence Number=SeqID_148897
atgcatagatctcccacaggcaatttagttcctctggacttggagattgaagctacgttgagaaggaacagagccgagaggagaagaaaattactgcaagacaggacagtagcatccattcttgaggaagaaactcattttttttattcttcatcatccgactcaccatcatcaagggaatctgtgacttatttaccagaagtcgtttctatggctgatgagcaccatcaaagagttacccttgaggactattcaagcaattcagtgtcgtaa

SEQ ID NO: 57213 - DNA, 372 bp, Glycine max
  Peptide Sequence Number=SeqID_148898
atgtcaacccttaattcatcaccatgtattgaaccacatacaactacaagttgtcgacccactcagattggcatgacttctcaacatataaattcaggtagatacacaatattcaattccaaactaatagagcacatctcgcatgacactgatgatgaactcgatataacacagggagacattgttacagattattcatttgacgacatagcaactaaggattttgctcataccgattatgatggcaatcttgaagcaccatatgacaatgaaaataccggtttttacgttcactgttcaaattatgttgtattgtccttcattacctttgataatgtaataccatgtctaaatttctgcatttacatgtag

SEQ ID NO: 57214 - DNA, 178 bp, Glycine max
  Peptide Sequence Number=SeqID_148899
atggctcttctttcttgggagatcccactgttccttcttatgagggcaaggatggaaattctcttcctgggtcaaggtttatggtggtttgaggttttggctcaaaaggcttgtagaacggctgaacatgatatatgtcaaggtgttggtttggccagcggttcagggataaaggaat

SEQ ID NO: 57215 - DNA, 669 bp, Glycine max
  Peptide Sequence Number=SeqID_148900
atgggtcagctccagcggcaagcttttcgcaaagcttacgataaaatttgggacctagccatggtagaagtctctacagaggccatcgcctccctcacccagtattatgatcagccgttgaggtgcttcacctttggggacttccagctatcacccatggtggaagaatttgaagagatcctaggataccctctaggggggaggaaaccatacctcttcacagggttctatccctcattagctataatttccaagatagtccaaatctcggcgcaggaattagaccacaagaagcaagtcgaaaatggggtggtcggaataccgagaaaatatttggaggtaaaagcaagaatcttggcagataaaggcgagtgggtcccgttcatagatattctcgcactgttgattttcgggggagtcctctttccgaacgtagatgggttggtggacctggcagcgatcgacgcttttctcgcctatcataaccacaaggaaagcccggttgtcgctatgctagccgatctatatgacaccttcgaccgaagatgtgaaaagagcaatacaaggattgtttgctgtactccagctctttatgtatggttagtttcgcaccttttttgccaagaagtgaggcatgcttgcccgttagaaagccgtgggatcctctag

SEQ ID NO: 57216 - DNA, 246 bp, Glycine max
  Peptide Sequence Number=SeqID_148901
atgcttgttttgacttccagaatgttgcgagactttatggattacacaacggtgggtgtcgcaacctacccttcggcgggagggcgatgcgtgacttgcgggatgcgtgttccacgaaaggaatacgcgcggagtcgccaccaacgcttatttgaggaaaacgtcggaaaaaccggaaaagacgtgatctacgaacttttaagtgaaaggttcgggagttgtatttacgcacggggaaggtattag

SEQ ID NO: 57217 - DNA, 609 bp, Glycine max
  Peptide Sequence Number=SeqID_148902
atgagtcttgattcttcatctagtattaatggtgaaggttctactcctaaggaccccttgtataagatattagatgagttgagatcccttaagttgtggaaagaaaaacaagagagaaaagaaaaaggaaaaaaaagagcaaaagaaataagtcaagatgaaaaagagaaaataagggaagaagaaagaaggaaaatactaaaagagttaagaaaagaaaaacatgccacctatagtagtcataactcttgcaagagcctaagtgaagaacttcgtgactattatgaaggaaggcataggtcacatcttagacctcactcccatatgagagaaaatgaaagaaagcctcaagaggctaacattaacctcccatacttctatgggaaggacaatgtagaggcatacttagattgggaaataaggatagagcaaaaacttaaaagaaagtctactttaaaatcttatggatctcattcttatccaaagaaagaccaaggtctaagcatcttaggggcagcaccttctaagcccaatgatgataaggggaagacaatagaaaagcaactccttaaggctagtatgcaagaaaagactagctccataaagtga

SEQ ID NO: 57218 - DNA, 375 bp, Glycine max
  Peptide Sequence Number=SeqID_148903
atgccccatgattcaaaagagcacgccttcccgtcatatggcttgcctctcaactatacgccacccaatgtggcgtacactcccaataagaatgtcaataactccactcctatacccattgaaagccagcaaccccaaactgatcatgcacatatctctcaaaccatgagggagacacatgaaattccccaccacaatctagctgacttcgagccttggctcggatatgccactgaagggcaagcagttggtggtataccctttgaaaacactttggagggccctcagtatcacccacgactgcacctcttgcattccacagcggttaaaaaccctcatgacctatggcaggaatgggaaagttggatcatctaa

SEQ ID NO: 57219 - DNA, 1229 bp, Glycine max
  Peptide Sequence Number=SeqID_148904
tcctctttccaaatgtggatgggttggtggacctagcagcaatcgacgcttttctcgcctatcataaccacaaggaaagcccgattgtcgctatgttagccgacctatatgacaccttcgaccgaagatgtgaaaagagcaatacaaggattgtctgttgtactccagttctttatgtatggttagtttcacacctttttcaccaagaggtgaggcatgcttgcccgctagaaagccactgttcatgcacagagaaaggaggggcaaattgggaccaactcttagcaagcaaagaaggagcatctgtcaactggttccctcgatggaaggaaggaagaaccggagttcttatttcatgcggaggatttccaaatgttcccttgatggggacgaggggttgcatcacctacaatcccgttcttcctataagacaacttggccaccctgtgagaggggcaccactagaggaagagatcgcgcccgtcatttcacgaggtttcaataagaccaacgtggagacgcttcagaaggtccgcaaggcatgggagcttccaagtttgagaactgctaaaagagaggaagctgaggcaccggaggaagacgaagaggtgcaagcccttagggcggaactcgagcaagcccaaacagttaaagaaaggttcaaatcagcagctctgaaaatccaaaaagagaacaccgaactgagagatgtaaatgtggctaccaccaaagccttggaacgagaaaccaagagggcttgggctctgtggggtatcaacaacgagcttaaactccaaagagaggaaagggaccaatcacgagtagacagtttgatcttgaaagatgaattgaaggcttgctcgaggtccaaaagaagtttgtctcagcggttatgcgagacagagaccaacatgttagctattatcaccaagtaccaagaaaaactaaatctagccgtggcccacgagcatagagtggcggacgagtatgcccaagtgtacgcagaaaaggaggctagaggaagggtgatcggctcgctacatcaagaggcaacgatgtggatgaaccgattttcccttaccttgaacgagagtcaagagcttccccgactactagccaaggccaaggcaatggcggacacctactccgcccccgaggagatccacggacttctcggctattgtcagcatatgatagatctaatggcccatataattagaaaccactag

SEQ ID NO: 57220 - DNA, 365 bp, Glycine max
  Peptide Sequence Number=SeqID_148905
cttctggtgactgggaagcacgttattctgttgttttccagatcggttccttcgccaaaagaaatgaagaaggagtggagacgagagtcgtcatcacagaaaaggcaaggcggacgaaatcagtgtcctatctttgctttcctcttatctccgatgagagtcccgagacgtctcagaaatcaaaaggaagcaggcttgcgcgatccgtgaaattccgtaatgtggcggaagtcgaaaagagctgggttgcttcctccggaagcaacccagctcgcctgggcgagctgggcggcaacctcctccccctttttcctaaaaataggctgaagggggctgttctaaggatcccgaatgcccctggtgag

SEQ ID NO: 57221 - DNA, 135 bp, Glycine max
  Peptide Sequence Number=SeqID_148906
gtcgactctagaggatcccacgtctctgcctctaggccttcatccttctccacttaggccttcatccttctccactcgggggctttgtccttctccacttaggctttcgtccttctccacttgggcctttagcct

SEQ ID NO: 57222 - DNA, 120 bp, Glycine max
  Peptide Sequence Number=SeqID_148907
atgggtctgcaaaatttgagaataagggttcgggagttgtttacgtgcggggaagttaaaacttactttacaaaagaaaagcgattaccgatgataggagaaggagatgaagatgcataa

SEQ ID NO: 57223 - DNA, 261 bp, Glycine max
  Peptide Sequence Number=SeqID_148908
atgatcgtcattgtcaatgcggaagcttgtggttacatgagcatgaactactatcaatatatagatgttgtttatacaaacgagcacatcttaaaagcttactccgcacaatggtggcctcttggaaatgaaacgactattcctccttctgatgacgcatggacacttatccctaacccaactacaattcgtgcgaaaggtcggccaaaatcaacaagggtaagaaatgagatggattgggtcgaaccatctgagcactga

SEQ ID NO: 57224 - DNA, 375 bp, Glycine max
  Peptide Sequence Number=SeqID_148909
atggttagaacacgaggtttaggtcgtgcgttaggagctggtagaggtagaggcattagtgaggatgcgcatgaggctgatgttcctcggcgccgcaggcctactgcttcagcacgtaggcaacgggttcttctgcgtgaggacgtcacagagagacctgaggatgtgcctcagttgcatgaggatgtttctcatgtgtctgatgccaccccagagatgacaggcgccgccgatgctgttcagacagagagagtggctactgatgggagcttggggtcacctgctgcagatgagggattccccagtggactacgcgacccatcgattttgatcgattttgctgagcatgttgcacacaacatctggagtggacag

SEQ ID NO: 57225 - DNA, 76 bp, Glycine max
  Peptide Sequence Number=SeqID_148910
aacttgtaaaaggaatttacaagttagtggaactctcaagcgggttgcttggggactggacgtaggcactttaagg

SEQ ID NO: 57226 - DNA, 807 bp, Glycine max
  Peptide Sequence Number=SeqID_148911
cagagttttctgcctttgctctgttttgcttgactgtgatagcttgtgctgtttgaatgttgttctgcttggatgttgtggaagcttgagaggattgatggggacccggggatggtgggtttatgcgcgcattgtggatgtggaaaacttgttgtgcaccatcgcccgaccgccacctagtaccacatgtgatggggtgaaacttcctgcttttattgttgaccacagagtggtacctggagatatgtcgcgggggtcaggagaccttggagacgttaggcgagctcctggcagtcaacagataaaaggaacaaagaccacaaagcaaggaggcttgtggtggctggccagctgtggattttgtgtgatatgtggagtatggcctctggtaatcgattaccaagggctagaaaacgaagtcaggaagcttagggagcctctgggtaatcgattaccagcctgtgtaatcgattacacagagggatgggtcactggtaatcgattaccaggatgtgtaatcgattaccagagatggaaagccttaaaataccccttttacttgcatgtagtgatcgggatggcggcgcagctaatccgtgatcgagtagagatggagtgcctagagggagcttgggagaccctcgaaggcaacacgaggtgccgatttcggggcaccattcgattcatggctacttctttggtgcatccagatgaacctgcacggacgcttcagcgcacggaatttgatgattgtacacttgtggctgaagccaccactatggacacctttgctctggatgacactat

SEQ ID NO: 57227 - DNA, 663 bp, Glycine max
  Peptide Sequence Number=SeqID_148912
atgaattcattgcctagcgctgttcatgtgtcctccaccatcgagtctgaagccccgcaaattcattgcctagcgctgttcgccaattctccattctccaatcttattcggagacccatgaattcattgcctagtgctgttcatgtgtcctccatcgtcgagtctggagccccgcgaattcattgcctagcgctgttcgccaattctccattctccaatcttattcgaagacccatgaatttattgcctagcgctgttcatgtgtcctccaccatcgagtctggagccccgcgaattcattgcctagcgttgttctccaattctccattctccaatcttattcggagacctatgaattcattgcctagcgctgtttatgtgtcctccaccatcgagtctggagccccgcgaattcattgcctagcgctgttcgccaattctccattctccaatcttattcggagacccatgaattcattgcctagcgttgttcatgtgtcttccaccatcgagtctggagccccgcgaattcattgcctagcgctgttcgccaattctccattctccaatattgttcggagacccatgaatttattgcctagcgctgttcgccaattctccattttccaatcttattcggagacccatgaattcattgcctag

SEQ ID NO: 57228 - DNA, 303 bp, Glycine max
  Peptide Sequence Number=SeqID_148913
atggctgtgttgggtaatggggttattactagtgcatctttttctggctcttctagttcttctactgagagtgaaagtcaatgtgatgtacaacccttgaaaggttttcttttgatgtttaggaggttaatggggagtgtgtctagccaaagactgatagaaaagcttgctttgaaaactttcactcaccctaggccttacaaactacaatggttgagtgagaatagggagctagttgtagatatacaagttttgatatgcttttccattggaaaatatgttgatgagatactgtttgattag

SEQ ID NO: 57229 - DNA, 1227 bp, Glycine max
  Peptide Sequence Number=SeqID_148914
atggccaccggggtgggtgtcgatatcctcaaacaggggggtaacgcggtagatgcagcgattgcggtgggctttgcgctggcggtcactcacccgcaggcgggcaacctgggcggtggcggctttatgctgctgcgcaccgctgccggccgcaccaccgccattgatttccgcgagatggcgccggcgcgtgcctcgcgcgatatgttcctggataagcagggcaacgcggatagtaagttatcactcacttctcatctggcgtccggcacgccgggaaccgtagccggttttgccctggcggcgcaaaagtatggcacgctgccgctcagcacgctgctggcgccggcgatcaaactggcgcgcgacggcatcatcgttaacgatgcactggctgacgatctcgctacctacggtaaagagaacctgatcaaccacgacaacagtcgcgctattttctataaagccgacggtcagccttaccagaagggcgatcgcctggtgcagaaaaacctcgcgcacagcctgcagctgattgctcagcaggggccggatgctttctacaaaggcaaaattgccgatgagatcgctgccgaaatggcgcagcacggcggactgattggcaaggcggatctggcggcctaccgcgcagtggaacgcaagccggtaagcggcagctaccgtggctacgaggtgttctccatgccgccaccgtcgtccggcggcattcatattgtgcagatcctcaatatcctggaaaacttcgacctggcgaaatggggcttcggcagcgcggacgcgatgcaggttatggccgaagcggaaaaatatgcctacgccgaccgctccgagtatctcggcgatcccgacttcgttaaggtgccgcagcaggcgctgaccagcaaagcctacgccaaaacgctggcccagcagattgacgtcaacaaggcgcgcccttcagccgacatcaagcccggtaagctggcaccgtacgagagcaatcaaaccacccacttctcggtggtggataaagacggcaacgcggtggcggtgacctatacgctgaatacctactttggcagcggcgtggtggccggtaacagcggcattctgatgaacaatgaaatggatgatttctctgccaagccgggcacgccaaacgtctatggcctggtgggcgcccgggcggtagtcggattatcaccaccgtgctgcaaatggtggtga

SEQ ID NO: 57230 - DNA, 273 bp, Glycine max
  Peptide Sequence Number=SeqID_148915
atgtcgtctcgagtttcgaagcgtattacagagcaagagtctggtcaggacttgctcgaatcgaaaagagaggagagtcttaagaaggtattcccaggttcaaagaagtatttgcgaagtacaaagctaagacaagaaagaggacttcgaatcattgggcgattcgaactggtgtatactcgagtcgaaatcgaggcagctagatttctggacttagcacaatttccgacaaaacttcacaaaatcaacttcgacttcgagcaagatggataa

SEQ ID NO: 57231 - DNA, 81 bp, Glycine max
  Peptide Sequence Number=SeqID_148916
atgatggtggcccgggtgatgttggggtacggctacgagcccggaatgggtttaggcaacaatggcggcagacccagcctg

SEQ ID NO: 57232 - DNA, 477 bp, Glycine max
  Peptide Sequence Number=SeqID_148917
atggttgctggttgcatgacttggacttctcgtcgaatcgacggcaacaaaccggaaataaagcagcttaaagccatgggagcagtcccgttggatcctcatacgaagttgaagcaaatcgtgaatgaagggcgtgaaggaacgcaggccaggacgataactgtccatttctgtgcatccattggaaccaagccaaggcttatccaccccgtagcatcggagccgtcaaacctcggcacatccagcttcaatcggtgcggtgctgcactcggtcccgccgccgggaatgaaggcatctcaggctgtgtttgtgagggactgaatctactggtttcaagatgtgctaacctctccgctaatgattccatttttgcttctaccgttgccgcaaacttcgcgaacagctcctccattttttccgatgacatagcttttgatcgcgtattctccgccatacgtccaccttgtgctcaatga

SEQ ID NO: 57233 - DNA, 102 bp, Glycine max
  Peptide Sequence Number=SeqID_148918
tcgaagtgcttctgtaacgcttccgtaagcgattctgtggaaattcttcatcgttctttgtcgttcttcaccgttcttcatccgttcttcgttcttcaacgg

SEQ ID NO: 57234 - DNA, 276 bp, Glycine max
  Peptide Sequence Number=SeqID_148919
atgaatgaccagggcatactcatgatatgcatggcaaataaatgggtgtataatcctgtcgcaacctacccttttgcgggcgagcgaggcgaggctcatgggtgcgtcttccaaaggagtaaaatgcgcggagttgccaccaacatttatttgtggaaacattggaaaaaccgaaggaaaacgatcatgaagaatattccatattcgggagttgtatttacgtttgaggaaggtattagcacctctcacgtttgtcccaaaggacaacaaccttaa

SEQ ID NO: 57235 - DNA, 159 bp, Glycine max
  Peptide Sequence Number=SeqID_148920
atggcgagggtcacgggtgcgctttcacggagtcgccaccaacgtttattcgtggaaaacgtcgggaaaaccgaaggaaaccggtcgacaaaagcggggcttttgctcctacgtaccctcctttggagaggaaatcagacctacgtagttcttccttaa

SEQ ID NO: 57236 - DNA, 886 bp, Glycine max
  Peptide Sequence Number=SeqID_148921
gtcgactctagaggatcccaccaaggagactggggcccgtttatggatgtgttagctttgctaatttttggggtcgtcctctttccaaacgtggatggtttgatagacctagcagcaatcgacgctttccttgcctaccaccatagcaaagaaagtccggtggtagctgtcttggcagatctatttgacacatttgaccgaagaatggattgggaccagctcttggccgggataggaggtagaacaatcagttggttcccccgatggaaggaaggaaaagaaggagtccttttctcatgtggaaggtacccaaacattccgctggtaggaacgagggggatctcgggcgcacaaaattccaagactatacaaagaatccataaggcatgggaaaccccgttaaggaaagatcaagagcttagaggcattcgtaatggcatcattggtgggtaccaacgaatggctgaagtcgtcagcgaagagaattttgaagcaccggaagaggacgaagaagtccaagctctcaaaagcgagttaggaaaggcaaaactcgccaaggagaagttcaagttggctgctacatacgttcggaaggagtgcgccgggttacgggaagagaatgcaattaccgcaagagcccttgaacaagagaccaagagggctcgcaaggaagagtatggccggaacaaatttcgcggagctctatggggtagcaataatgaactcaagttgcgaagggaagaaagggaccagtcgcgagcacatagcatggttctcaaagaggagttgattgcttgttcaaagtccaaaagaagcttgtctcagcgtctatgcgagacagagaccaatatgctagctatcatcgccaagtaccaagaagagttag

SEQ ID NO: 57237 - DNA, 243 bp, Glycine max
  Peptide Sequence Number=SeqID_148922
tctgttggagattgtttagatgcaatcttcagcagatctatgaagtaccctttcttcgctcagttcgagagaaggtgtacccaggacagcgctttactaggtagcttgcttccaagccggcccggccgcgaggaagagatctttgccggtgctgacttggatctcggtaagcttggctacagcgaagcgcttaccaagcgcgaaggattcgttcctctcccagcaagaggatgcgcgccttaa

SEQ ID NO: 57238 - DNA, 441 bp, Glycine max
  Peptide Sequence Number=SeqID_148923
atgcacctgacctcaactctcaaatgcaacgtgataccgttcatcaggaaatggcctaaacgtgtacatgcaacactctcacttaagaaaactaggcaacaagtgttgaggtcaccttgtcgtgcacaggcaactctcctccccccccccaatgttgatcagcctaagtctcaagggagttccaaaccaagtgacatgcccccaagtacaagtattcccccttatgagaaactacaaggatatccatcatggtcattgcacccctcatgtacatacaaatcacacatcatcacaatgacattttcaacatcaacaacatttcatctcaatgtcattatcaacatcatttcatctcaatgtcattctcaacatcaacatcatctcatctcaatgactatcaacaacaacaacatcttctcatatcaacataatcatcaataa

SEQ ID NO: 57239 - DNA, 223 bp, Glycine max
  Peptide Sequence Number=SeqID_148924
tgagttcaacataaataggaaggttgaaagtaagcccaaggcaatcaatataccatgcttaaaaaaaatcgttggtgctggcagcttggacatacaaactgatgcaatcctccctaggaagggaccaatcactagaaccatgagcaagaggctccaagaagattgggctagagctgctgaagaaggccctagggttctcatgaaccttagggtagatttctga

SEQ ID NO: 57240 - DNA, 354 bp, Glycine max
  Peptide Sequence Number=SeqID_148925
atgacggtctttcatttcttcaactgcgccattctcaccttcggcccccatgttgtcttctattttaccacgcccttatctgagtatgatacactcagaacctctatcaaagccgctgttgtttatcttgcaacgacattagtgaagcttatttgtctagctacttttctcaaggtttcggagaatgataggtttgatccgtatcagacaaatgaagatgaagttgttaaaccaaataacttgtattgtttatggtctcctttaaaagtgctggcatgtttatggtctcctttatcagtgagacacagaatacagggaggcaatcaagtgctatcgaaatgcactgagaattga

SEQ ID NO: 57241 - DNA, 210 bp, Glycine max
  Peptide Sequence Number=SeqID_148926
atgcctagaaggctgaaggtcaagaatgtgacctgggatgtcttcaagagagtgtttttggagaaaatacttttcccgaggatgttaggaacaagaaggagatggagttcttggagcttaaagcaaggaagtatgactgtggctgaatatgcagccaagttgaggagctgggtgaggtactttccccattattcaagggaaagatggtga

SEQ ID NO: 57242 - DNA, 429 bp, Glycine max
  Peptide Sequence Number=SeqID_148927
atggtgggtttcaatagatctcttttccacctaggtcaaaggggtatgccgctatatatgctacaccgaagtatgctcctaggtaagcgactgcctttggatccgcctctcgagcacgagggtcgtattcataaaaggctatcgatcgtgaaaggtttgcctatggctctgtatctacctctgtctgctggtgcttattttgataagctgcaggatcaatggcttaaactactgcttcttcaacgcttctcctgcgacttgttctcctttcgtccttgctcctgcacgcacctaaaggaaggactgctagtcatcaccgagggtatgaccaaggaactgctgctgagagcgatagactttccaactgagatggagagaatgcgctcctactctctttcaatcgccgatgctaaaacaaagagggcgtag

SEQ ID NO: 57243 - DNA, 410 bp, Glycine max
  Peptide Sequence Number=SeqID_148928
cacttttgatctttggagttgtcctctttccgaatatggaagggttagtggacctagcagtgattgacgctttcctcgcctttcatcatggcgaggaaagcccggtcgtcgccattttggccatgtatgacacgttcgaccggggatgtgaaaagagcggcgcaagaattgtttgttgtgcactggctctctatgtgtggctggtttcacacccttttctccaagaaggtaggcccgtctatccgctacaaggtcaccgctcgtgcgtcgaaaaaggaaaggcgaattgggaccaactcttggctagcatggaggggcgtctgttaattggttccctcgctagaaggaagggaagaatcatgattctatcttcatgcgaaagatgtcatgcaccaccctcccatatctaa

SEQ ID NO: 57244 - DNA, 245 bp, Glycine max
  Peptide Sequence Number=SeqID_148929
atgatattgcacgagattagaaggcctaactctctaaaaacagtcctcagtggagtcaccaactgtcacaacctacccttcggcgggagggcgatgcggggctcacgggtgcgtcttctaagggaggagaacgcgtggagtcgccaccaacgtttatttgaggaaagcatcgaaaaaaccggaaaggtgtggtctacgaactataagtgtgaaaggttcgagagttgtatttacgcatggggaag

SEQ ID NO: 57245 - DNA, 192 bp, Glycine max
  Peptide Sequence Number=SeqID_148930
atggcctcctatggtgaagcaaaggaatccattgatgaagaagatcctaggcctacaagctccaatggagcttgcatcaatgttgcactgcatttaggcattagagttgatggtcgtgttgtggttggacctagcttcttacattgggatgagttattcgacgagttactagggcagtgctttaattcttga

SEQ ID NO: 57246 - DNA, 882 bp, Glycine max
  Peptide Sequence Number=SeqID_148931
atggacctcatcaaggctgctggactgctgaaaactgtcaccaagttgggagattgctatgaaagcttagtcagggaattcattgtcaacattccctctgacataacaaacagaaagaatgatgattatcagaaagtgtttgtcagaggaaaatgtgttagattctcccctgctgtaatcaacaagtacctgggcagaccaactgatggagtggtggatattgctgtttctgagcatcaaattgccaaggaaatcactgccaaacgagtccagcattggccaaagaaagggaagctttctgcagggaagctaagtgtgaagtatgcaatcctgcataggattggcgctgcaaactgggtacccaccaatcacacttccactgttgccacaggtttgggtaaatttctcattcagaatcctttgctgtcaaattacccattgccttcccaactgtattgtggcattatgtcgagtcaacatcccaatattttaaactacactgactctgtgatgaagagagaatctcctctatccctgcattacaaactgtttgaggggacacatgtcccagacattgtctcgacatcagggaaagctgctgcttcaggtgctgtgtccaaggatgccttgattgctgaactcaaggacacatgcaaggtgctggaagcaaccatcaaagccaccacagagaagaaaatggagctggaacgcctgatcaaaaggctctcagacagtggcattgatgatggagaagcagctgaggaagaagaagcagctgaggaagaagaaaaagctgaggaagaagaagaagcagctgaggaagaggaagatgcagcagaagatacagaatcagatgatgatgattctgaagccaccccatga

SEQ ID NO: 57247 - DNA, 186 bp, Glycine max
  Peptide Sequence Number=SeqID_148932
atggcgattgacctctacattcgggaagtggatggcctaagatttgagctatccatgaaccagtgcagtgataagttgtcagaactggcacatgaaattctaaaagtcatctttgttttatatcatgtgacctctggatactgtttgtcaagaagtaacactagttcatgtgcacaggcacattga

SEQ ID NO: 57248 - DNA, 204 bp, Glycine max
  Peptide Sequence Number=SeqID_148933
atggagaattggcaaacagtgctacacaataacttctcggggtctccagactcgatggtgggggacacaagaacagcgctaggcaataaattcatggggctccgaaaaaagtggagaatggagaattggcgaacagcgctacgcaataacttcgcgggctccagactcgaaggtggaggacacatgaatagcgctaggcaataa

SEQ ID NO: 57249 - DNA, 285 bp, Glycine max
  misc_feature (24)..(24): n is a, c, g, or t
  Peptide Sequence Number=SeqID_148934
atgggaggtgaaacatgtcacgcncaaaatgagtttgttggttactcgttcacaggaaaaaatccccaaaagtttgacattccttccagatgtaccatggatgaattgaaggatttgatcaagcaagttacacctcatgggattcccccttatggtattcacgaaacacaaacagtgttaattgagtctaactactggaaaaagattgggccaatagaaattttagctattttcagtaaacctgtaatggaaatggaagacgagttgtccttgtcgcaaaattag

SEQ ID NO: 57250 - DNA, 243 bp, Glycine max
  Peptide Sequence Number=SeqID_148935
atgatggcacatcaaaaccccccatacttagccttttgcactcctgggcaaaatgaaacaaagaacaaaatccaaggatatcaaagagaggcaaacgaaaacattcacatatttctcaatgaacatcaaggaatgaaaggaatggttaatcagctcaagaatgaaaaagtgataaagcctcacaagatatacactctatctctcaagtgtctaggctattatttaccctcaaagcacccatga

SEQ ID NO: 57251 - DNA, 475 bp, Glycine max
  Peptide Sequence Number=SeqID_148936
atggttccgagaaagctttccgcaaaaagatctaggatggacgccgcggctgaagggaccagtgccgctcccgagtttgatagccactgtttcaggagcactgagcatcagcaacgtttcgaggccatcaaaggatggccgttccaccgagagagacgcgtccagctcagggacgatgagtacaccgactttcaggaagagatagctcgccgacattggacgtcgctggtcactcccatggctaagtttgacccagatatagtcctagaattttatgccaatgcttggcccacagaagagggagtgcgggacatgcgatcatgggtgaggggtcagtggattccctttgatgcagatgccctcagccagttcctgggagacctgctggtgttagaggaaggccaagagtgcgagtttagtcagagaaggaacaggcccgatgggtttgacgaggaggccattgcccagctgttat

SEQ ID NO: 57252 - DNA, 870 bp, Glycine max
  Peptide Sequence Number=SeqID_148937
atgccggaactggtgctggcggcgattaaaccgctggggctgtccgcgaccgctgcagcgctgttcctgaccggggtgatcctctctgcccgtaagctgcagatcaacaccatggtcatcacgtcaactatcgccaagctgctgattcagcctgcgattgcctggggtatcgttttactctttggtctgcacggttccgtggcgatcaccgctatcctgatgattgcgctttccgcgggcttcttcggtggggtgttcggtaaccgctttggcgtgcagtcaccggatgcagaagcggtactgctgttaagctcacctgtgtatcctgtcgctgccgctgtttatctcattgacgtcaggaatgtaatcatgaccacaacattacgcccccacgacctcatctggcttaccgcgcgcgacgcgctggaagggatcactgaaacctgggtggatgccgcctggcataccggcctgccggtggtggtgcggcgtgatgttgataacgatggccgaatccccgttggcgtgcgcggactgcgccgcgaccagcgggcggccggatgggtgaagacggaaaacgtacgccgcgtggtgtcacctgaagagctgtgcgtcaccgccgatctgctgcgttcgccgtttgtcactcagccacctgttcaggtggcgttacagcttgcgcagcagtcgtggtcgtggacgtggggcattaccggcagcaccggctttgcgctggcgaccggcattccggtgatccatgccgacagcgatcttgatctgctgatccgcgccccgcagccgatatcacccgacgcgtttaccgcctggcagtcgcagttaagtggtgcgctgtgccgggctgatacccag

SEQ ID NO: 57253 - DNA, 261 bp, Glycine max
  Peptide Sequence Number=SeqID_148938
atggcaggaatgggaaagttggatcatctagaggaaaggctcagggccattgaaggaggtgaagattatgcctttgctaacctagaagagttgttcctaatacccaaacatggtcattcccaagttcaaggtgccgaactttggcaagtacaaggggactactcgctccaagaaccatctaaagatggaacctttcttgagtccatttctggaagggacctaatggttgcctttgttaggcagtatcagtacaatttttga

SEQ ID NO: 57254 - DNA, 451 bp, Glycine max
  Peptide Sequence Number=SeqID_148939
atgttggaccttgtacttaagggccaagcatttttcgatggaatgccccggggtattcccatggactgcaagaggtcttcgtacgtcattgggagtggggtgaattctggaattggcttcgggggaaagttcctcattgcgttggaattgtcggctgggcgagtcgtggttggagccggaacttggggggcctccctctggatgggtgccttaggctacacgggtctgcgggggcttgacccatgcgggcaccgaagtgacgacatgggtatctctctccttcctttttgccccagttgctccgactattttagcatgggtacttgtggaggaaacgtaatcgaacttccctcttttcaaccctacatcaattctttccttggtgaataccaagttcgcgaagctggaaggcatgtagcctaccaacttctcatagtaaaacactggcaag

SEQ ID NO: 57255 - DNA, 531 bp, Glycine max
  Peptide Sequence Number=SeqID_148940
gccaggggtaagagatcagaggcccttactacttcagcaccagagacaccagctccttcttcttccacaactccattacctcccactcagactccagttattcctcctacacctacacagataccacttccagctcctctatctggtttgggcttgccatccatcatgagcatggagtattttgatgtgcaggtggcttggccaggagcccagccttctccttctagagggggtggggccttcgcaacccaggagcctgttcttggggagacagcagcagtagagggggaggatgagctcacccctcctgagccttcttattttgatgcaggtatacacatggctcaggaggaggatgcttctacagaccaaattcatgagccatcttctgcacttgtacctaatgatgccacaccatctacaccagcgcctgagttagagcagcctatctctcaggattcaccagttcctcaggtgttggaccttaatgagcatgcacaggagaaaccacatgatgagcaggacatttaa

SEQ ID NO: 57256 - DNA, 219 bp, Glycine max
  Peptide Sequence Number=SeqID_148941
atgaagaaacaacaatggaggaaaaggagaagaggtgagaggaggcgccatccactagggaataagccatggaagaaagagcttcaccaccaagagagtgccttggataagaagcttggagaggaaacttcaatggaggaaaagaaagagagagagaaagcgagaaggggggagcatgaaattgaagaaggaaaagaggcagagaagttgaactttgaa

SEQ ID NO: 57257 - DNA, 207 bp, Glycine max
  Peptide Sequence Number=SeqID_148942
atggctccaaacccgtgggtggaggatgaacgaaaacgcaattcatggggcatccgaaacaggggtaaagaatggagaattgcactaagcattaactacgcatggcttatactagtgggtggaggatgcaagaacaaaaacgtaattcatcgggctccaaaaaagggtagagaatggagaattgcactaagcaatcactacgcatga

SEQ ID NO: 57258 - DNA, 363 bp, Glycine max
  Peptide Sequence Number=SeqID_148943
atggagaattacaaagaatccatgaactgcaccctagctatctaccactacagtaccctctactctttccttatggagaagacggatatagagctgacatacttcaccgttctacttcatccagcaaaaaaagaaagttataccatggttgaatctgaaagacttagctacatcagaaacaaccaaaagaagcttagagttgacaagtattctagcttacaaagttcattggatactggaacagctaaaggcttaaccaaaggaaaaagagtcatcttaccttcaacgtttgttgggagcccacgttatatggatcaactttactttgatggtatgacaatatgcagtcatgttggtttctga

SEQ ID NO: 57259 - DNA, 399 bp, Glycine max
  Peptide Sequence Number=SeqID_148944
atgatgcgaacctcatggtcttcatccacatccatgaccacaaagtcagctggaaagaccatttgcttaactcttatcaggatgtcttcaattacctcatacggccttgtgatggattggtcagcaagctataaggtcattttggtgggcaagatttccaactctcccaaccatctacacatggagagtggcattaagttgatgctggctctcaagtcaatgggagccttccccactgtgacttcacctattgaacaaggaatagtcatacttctagggtccttgtgtttttggtggaaggatcttctgtatcacagcactaaagtttccctccacaacgatattctcttggtgaatgtatttgttcttccttgtcaacatatctttcaaaaactttga

SEQ ID NO: 57260 - DNA, 1051 bp, Glycine max
  Peptide Sequence Number=SeqID_148945
atgattcctggtccaggccctgttcctgagaaactggtccctaaaagacaacagagagtgaagatttctgaaaaccctagccttgcaccaagccctagggaagaagacactgagatggataagaagatccgcagtcttgtgaataacattttgaaaaatgcttctgtccctgatgctgataaagatgttccaacatcttccaccccaaatgctgaagtccgctcttcatccagtgaagaggaatcaacagaggaagaggatcaagccacagaggagacccctgcaccaagggcaccagaacttgctccaggtgacctcattgacctagaagaagtagaatctgatgaggaacccattgccaaaaagttggcacctggcattgcagaaagattacaaagcagaaagggaaaaacccccattactaggtctggacgaatcaaaactactgcacagaagaagagcacaccaatcactcctaccacatccagatggagcaaagttgcaatcccttccaagaagaggaaagaaatttcctcatctgattctgatgatgatgtcggaactagatgttcccgacatcaagagagccaagaaatcagggaaaaagactttgctttagaaagagaattgggaagagatgccttggatttcaaggagatcatggacctcatcaaggctgctggactgctgaaaactgtcaccaagttgggagattgttatgaaagtctagtcagggaattcattgtcaacattccctctgacataacaaacagaaacagtgatgagtatcagaaagtgtttgtcagaggaaaatgtattagattctcccctgctgtaatcaacaagtacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattggcactgccaactgggtacccaccaatcatacttccactgttgccacag

SEQ ID NO: 57261 - DNA, 226 bp, Glycine max
  Peptide Sequence Number=SeqID_148946
atgcttgttctttcctcctccctaagtccagctcttaaaaagagtagttccatttgttgtctatattcttcaacactcatactccctttcatagtaggagggaatgtgcctcttcctaagagcactcttaagatcattccaatactctactggaggagccccatgaatctttcattccttaacaagggaagtccaccaatagagggcatacccttgaaagctaagg

SEQ ID NO: 57262 - DNA, 171 bp, Glycine max
  Peptide Sequence Number=SeqID_148947
atgcagaaatcaaagagggatgtgtacctaggagcctacttgaatgggtttgtattcaatagtgctttgaaaggacttgacgaaactccacaaagtaaatccaaggttgttgctgctaggtggattgttgttaaatgtaataaacaaaaaggaagcactgagtgtgggtaa

SEQ ID NO: 57263 - DNA, 445 bp, Glycine max
  Peptide Sequence Number=SeqID_148948
atggaagagggattttcccatggttcagttccaattattttaggcaggccatttatgaaaatagcccgaaccaagatagatgtttatgttggcacattgtctatggaatttggtgatattgttgttcattttaacattcttgatgccatgaaacatccatctgaggatcattctgtttttcgtcttgagataattgatcagattgttgatgattatatgtttgattttgattctgttcttcatggtaggaaacattcatttttatctgatctgcatacttgtcactccttatgcattgaatctgaatctaaatttgaatttgatcctgtatctgatttttatgctgagagtgaatttgaatttgagtctggttttgattttctgggtgttgtacctcttgatgttgattttttagagtcagaatgcactatccatgttgcaggaa

SEQ ID NO: 57264 - DNA, 309 bp, Glycine max
  Peptide Sequence Number=SeqID_148949
atggaagacacacctgtgagcctcgcctcgctcgcccgcaaaaggctaggttgtgacaataggttaatagggtgccacgagcgcgaattaaaggaaataaccaaaagacctacagtaatgctgcatggagcacgcaatccagggcatgaagagaggaaatggctccgaaaaaagctttccatgaagagatctagaaaggaggccacaggagaaggctccagtactgccttggaatttgatagtcaacggtttcggagcgccgagcaccagcagcgcttcgaagccatcaaaggatggtcattccaataa

SEQ ID NO: 57265 - DNA, 397 bp, Glycine max
  Peptide Sequence Number=SeqID_148950
atgccacccaccaggcaccctctagactcggataagtctaagagggccctggggtttccagcattgatcacgggcctctaccagtcattcgggggcgatgcaccagaggtcgcggacgcaccaccaccacctcatcaggctgatcctactgggtcattaggcatggagcggtatctacaacacttggtttgccagcaggcggccaaccaccgagggcagggtttcattccttttgtgtgccctactccatatcagtttagggctgaggtcgcatgtcctagagattggcctgaggcccaggcaggggaggcgcctgcagaggctcccagcgatgacggatttgctcggtttcttgggagggagcggagccacatgaccatgggatccccagattcat

SEQ ID NO: 57266 - DNA, 291 bp, Glycine max
  Peptide Sequence Number=SeqID_148951
atggcgagagatagattgcaagatgttcaagtggataatatcaagttgaaattgattgctaatcgtgaaaaagatggtcgtacatacaatgtacctattgttcctaaagttgcagcactaatagtaggcgattttgatgcaaattcaaaaagagatattattattgaaactcagcatggacaactacaaaggatccatgaattacattctagctatctagctctacaataccctctattatttccttatggggaatatgaatatagacttgatatcctacatagcagttga

SEQ ID NO: 57267 - DNA, 960 bp, Glycine max
  Peptide Sequence Number=SeqID_148952
atgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccctaccgtcgtaaaataagagcacctggctctgcccattcacaaggactcgattctatgtccaaacatcacatgccagcagatgtggtcaccatcatagtggatgagatcggtcgagtggtctccgttggagatgggattgcacgtgtttatggattgaacgagattcaagctggggaaatggttgaatttgccagcggtgtgaaaggaatagcgttgaatcttgagaatgagaatgtcggaattgttgtctttggtagtgataccgctataaaagaaggagatcttgtcaaacgaactggatctattgtggatgttcctgcgggaaaggctatgctagggcgtgtggtcgacgcgttgggagtacctattgatggaagaggggctctaagcgatcacgagcgaagacgtgtcgaagtgaaagcccctgggattattgaacgtaaatctgtgcacgagcctatgcaaacagggttaaaagcagtagatagcctggttcctataggccgtggtcaacgagaacttataatcggggaccgacaaactggaaaaacagctattgctatcgataccatattaaaccaaaagcaaatgaactcaagggccacctcagagagtgagacattgtattgtgtctatgtagcgataggacagaaacgctcaactgtggcacttagatatgggttacaatttcttctctttttcgcggtcttctatttaattagtactaatattaatatggcttcggtggacacattcgagagtctggtcaggagacttgctttctacctcggggggatcctctag

SEQ ID NO: 57268 - DNA, 171 bp, Glycine max
  Peptide Sequence Number=SeqID_148953
atgtcagtgaaaaaccaccctagggcgcttaggaggagaccagtcagggtcacagtgttttgcgagaatgctccaaccatatgcgatcaacataggcttaaaggagcactcaaaccgggtgacccccaaggcctacactctgaagagtccatcagggtctctccctcctga

SEQ ID NO: 57269 - DNA, 168 bp, Glycine max
  Peptide Sequence Number=SeqID_148954
atggaggccacgaaagagaaaatgaccacaatgatggaggccatgatgagtatgagaaaaatgatggaggtcaacatggctacagtcgttgctgcaagtatcgccactgaggtgaacccgactcacccacctggcctcaatcaagtaaatcgtccagtctcggatatg

SEQ ID NO: 57270 - DNA, 394 bp, Glycine max
  Peptide Sequence Number=SeqID_148955
atgattatgaggggtcaagacatttatagtagccaagatgaggctactacttcaccttcctctagtgaaagtgaagaagcaagaggggaagaatctagtgaagaaatatatctccaagaagaaggacaatcattaatggttaaggaggagtgtaaggaggtaagtgtctcctccaagaggttagctaagaaggaaagtcgttttacaataaagacaaacattaaagaaactttccctcttagacaacctccatattttctcctttgtaaaaatacacttgttagcattgccacacctcttgggcttgagtttattcctcaagtaaaggagttgttggatgagggcttagtttgcaagagcttaaatcctagtgctttgttggtgcccaaaatag

SEQ ID NO: 57271 - DNA, 540 bp, Glycine max
  Peptide Sequence Number=SeqID_148956
atgcgggatgaaccggatgagtgggttactagtgcccaactgcgcgctaacctagaccccacaaagggtgttggtcgattaagacaagcaggacggtggtcatggaagtcgaaatccgctaaggacctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggtccctgcggatgttga

SEQ ID NO: 57272 - DNA, 417 bp, Glycine max
  Peptide Sequence Number=SeqID_148957
atggcacctactagacaccctctggacccagagaagtccaacagggccctggggtttctggctctgatcatgggcctctgccagtcctacggagttcatgtcacccctagcaaggccgcgggcgcaccaccaccacctcagcaggctgatccggctgggccactgggcgtggagcattatcgacaacatttggttcaccagcaggcggccaaccaccatggacaggggcagggttccgcccctttggtatgccctaccctggagcagtttagggctgaggtcgcatggcctggagacaggcccgatgcccaggtaggggaggagcctacaggatccctcggtgagacagatgagtcccatatggatgaagatatgacggacctactcggtttcttggaagggagcggagccacatga

SEQ ID NO: 57273 - DNA, 507 bp, Glycine max
  Peptide Sequence Number=SeqID_148958
atgggggagacacatgaaatttcccaccacaatctagccgactttgagccttacctcggatatgccactaaagggcaagtagttggtggtatatccctgcaaaacactttggaagggcctcaatttcgcccccaaccacaacccttctatggaaaaatggtgggttacacaccttcaagctttgcggatttggtcttcgccgatgaaaggatcaaactgggtctggaaagaggtaaatctgattatcctggtttaataaatgcgaaagtcggggctaatgaagaggatgagaatgagggagaaacccttgctatgattgccattcctacatggtcaaatttcccatcaacccaacaatgtcattactcagccaatatcagcccatctcattacccaccacctagtcatccacaaaggccatccctaaatcaaccacaaagcctgcctatcgaacatccagtgccaaaacaccaaccaaaaaggaattttgtagcaaaaagcctgtag

SEQ ID NO: 57274 - DNA, 49 bp, Glycine max
  Peptide Sequence Number=SeqID_148959
atgaagaagatccatggcctacaagctccaatggagcttacatcatgtg

SEQ ID NO: 57275 - DNA, 432 bp, Glycine max
  Peptide Sequence Number=SeqID_148960
atgaaaagagaaaaacatacctcctatagtagtcataactcttgcaagagcctaagtgaagaacttcgtgactattacgaaggaaggcataggtcacatcttagacctcactcccatagaagagaaaaggaaagaaagcctcaagaggctaacattaacctctcatacttccatgggaaggacaatgtagaggctaacttagattgggaaataagggtagagcaacaacttaaaaacaagtatacttcaaaatcttatagctctcactcttatccaaagaaagaccaaggtcaaggcatcttaggggtgacaccttctaagcccaaagatgataaggggaagacaatagaaaagcaagcccctaagaggacacattacttctcaatgccccaccacaaaaaccatgattatgaggggccaagacatttatag

SEQ ID NO: 57276 - DNA, 369 bp, Glycine max
  Peptide Sequence Number=SeqID_148961
atgtggggcatcccttttatccttgaaccaaaccaaaccctgacatgtatcatgtctagccattctacaagccttgagccaaaatcccgactcaccataaaccttgacccaggaaggaaaattccccaatcaaagagtgggagaaagcaaaaagaaaagaaaggaaaattcccaatcaaagaatgggagaaagtaaaaaaggaagaagaagaaggaaagaaagctcctgatcaaggatcgaaagaaaacagaagaaatgtgcagagaggtctttggaccggacaatatctgaacaatacagaattgccaccaaatgaacgaaaaaagaaggaaagggaaccacgacctaaaatagtcttctccctttga

SEQ ID NO: 57277 - DNA, 450 bp, Glycine max
  Peptide Sequence Number=SeqID_148962
gaaggaaaggagagagttctcttctcatgtggggaccacccaaacgttccgttggtagggatgaggggttgtattaactacaatcccactattgctataagacagttagggtaccccatgaggggagcaccgacggaagaaaggctctcgcctttccttgggagagattttggcgcgcaaagtttcaagattgtacaaagagtccacaaggcgtgggaaagcccgttaaggaaagataaagaacttaggggcatccgtaatggcatcatcggtggttatcatgaatgggctaagagttcatacacgaggacatccggaaagagtgtgccagaattacgagaggaaaatgcggctaccgcaagagctcctcaaaacgagaaaccaagagggctcgcaaggaagagcatggccgagataaattccgaggagctttgtgggcagcaacaatga

SEQ ID NO: 57278 - DNA, 348 bp, Glycine max
  Peptide Sequence Number=SeqID_148963
atgcccaagtggttatccgcacaaacaatttctattaaccctgacccgggaagtcaggtggcaggcgggggtaccgggcaagcaaacccgttgacatgcggagacttacgtcatcttctggacctttgtcatcctgacccatacccaagtggttatccgtataaacactctttcgctatccgtcagactcaaagtccggtgacggtggagattcccaagcggttatccgtacaaacgatttctgttaaccctgacccgggaagtcaggtggcaggcgggggtaccgtatggttatccgcacctttcgtcaaccaggggcaaacgagcccgttgacgcgcagagactaa

SEQ ID NO: 57279 - DNA, 222 bp, Glycine max
  Peptide Sequence Number=SeqID_148964
atgatgataacaaaagatgatgacaaaggtgatgacaaaaagctcaaaggtcaatcaaagaatgagttcaaaatgttcaagatggaatcaagaacaattcaagactcaagaggaaaagttgaagaacacttcaagattcaaggatcaagcttcaagaatcaagatcaagattcaagattcaagattcaagattcaagattcaagattcaagagaagacttaa

SEQ ID NO: 57280 - DNA, 213 bp, Glycine max
  Peptide Sequence Number=SeqID_148965
atgagtaaacgaagggaaaaaacacttatcggtaaggacacaacgctactcatggcggtggaggagaggaaactcgcggaggacgacaaggaactaccaaaggagaaactagggaggagcgatggacaacagacacacaccacaaacaataccaacatcagcttcacgaaagagaaggtggagaccaaaggacgtgccaaaaattccaaatga

SEQ ID NO: 57281 - DNA, 546 bp, Glycine max
  Peptide Sequence Number=SeqID_148966
gagccatacacaacaactgtgatggcaacgttgcctcaaatttgtgtggttggaagtgtagcctggttcgcggtggtgccactgatttgtttccatgttgttgagtggcaccaacccgatagagttttacaacaatttggattgcaaaaacctattcccggatgtccttcgcaaccgcagaatctccatggcataacactgaaaggcaaacaagacgaaaattggttccacctattggccccgatcatcagtcaatggaacaatagagctgagtttagggtcgacgtttatcctcgacaggagggcctactgggttttaactcggacaacatgtatatggtgtcaccacaagggaggaacacatggacagttgatgatctcatgccttacgtggaaaagttagcgattatatccgaagagcaagagagaatcattgagccagtgtcacatggtccaacatcagagcgtgaattctcagcacaagagtttcacattcttcagtcaagtgttgaaactcggggcataggcagacgaagggagcttgtt

SEQ ID NO: 57282 - DNA, 348 bp, Glycine max
  Peptide Sequence Number=SeqID_148967
atggcttccaggaaaagaaaggcaccctctacaccaacccaagccagatttgacagatccagattcatttcccaagaggcttgggaaagatacactgatgttattgttcctaggaagcttttgcctgaaaggaacgtggtggtctactatacagagtatgatgagttcaaggaggaacttgagagacgccactgggatgaggagttgactgattttggtgacgacaacatcgatgttgccattgtgaaggaattctacgccaacctctatgaccccgaggataaatcacctaagcaggtgagggtgagaggggagttcagtctaactctagatccttggagagcctga

SEQ ID NO: 57283 - DNA, 333 bp, Glycine max
  Peptide Sequence Number=SeqID_148968
atggaggggtttcatcagcagactctccttccccgtggagaaaacaccgagactttttcaagtctcacaagttatccagaactacgtaggtctgagttcctcattggaggatacgtaggagcaagagcctcgcttttgtcgaccacaccgctttttgctaccatgactcaaaagctggtagcttgcggagacaccttacggttatccgcgcctcgtcattcagtcaccccaagtgtgattgatgagcagaggccaatatggtcatctgcgccctttccggagatgtcagcatcttccggtggagacttttttcgagtctcacaagttatctag

SEQ ID NO: 57284 - DNA, 261 bp, Glycine max
  Peptide Sequence Number=SeqID_148969
atgaggcttccctttctttggccaatgctggactcgtttggcagtgggtttccttggcaatctgatgctcagaaacatcaatatccaccattcctttcactgggtgaagagggaagatgttggaacaataaacttcatcagcatcaggaactagaggcatttttcataatcagttacttaccaatttgcgtgactgtcttcagtagtccagcactctctgtgtctagcttccctatggactcctgttgcaatccaggctag

SEQ ID NO: 57285 - DNA, 315 bp, Glycine max
  Peptide Sequence Number=SeqID_148970
atggatgggttggtggatctagtagcgatcgacgcttttctcgcccatcatgaccacaaggaaagcccggttgtcgctatgttagccgacctatatgacaccttcgaccgaagatgtgagaagagcagagacacttcaaagaaggtccgcaaggcatgggaggtggtgcaaaagaaggacaaagaactcagtggcagtaacaatgggcccatcggtggctaccgaaggtggttgaaagcccacgtgcaaggtttggattggctcccaagtttgagacagccgttgagatgcttcacttttaagggaggaagttga

SEQ ID NO: 57286 - DNA, 144 bp, Glycine max
  Peptide Sequence Number=SeqID_148971
atgagtcatcattcgtctagtgctaatggtgaggaggaaggcataggtcacatcctagacctcactcccataggaaggaaaaggaaagacaacctcaagaggctaacgttaacctcctatacttctatgggaaggacaatgtag

SEQ ID NO: 57287 - DNA, 154 bp, Glycine max
  Peptide Sequence Number=SeqID_148972
gcttattgcttgggatgaaaatgaatcatctgatggttcggagaaggagatcaaccttctatccaaggactatgaaagcgatgagaacatctctcaagaagtttacgctaaaagaaaaagtttgacttccatctttaaagatctaggcacttaa

SEQ ID NO: 57288 - DNA, 1535 bp, Glycine max
  Peptide Sequence Number=SeqID_148973
gcgccgagctgctctactccggcctgcacggccagggctaccgcgacaacaacgacaacaccgacatcgacgatttcatgctgaaaacgcgttatgcgttcagcgatcgcgacgagctgctggccaatttccactactacgacgccaaagccggcatgccgggcgggctgagtgccgcgcaatactcgcaaaacccgttccaatccacgcggccgtgggaccagttcgaaggccgccgcaaggatatgtcgttcaagtacaaacatcaggaagacgacaaacagttcgaagtgttgacctacttcaccgacagctaccgcggcagcaacatcgaatcggaaggcaccggcaaaaacgcgggccagcggcgcatggtctcctatccgcgtcactattcaacctgggctatcgaaccaagctattcgcaggtcttccgcttctgggatatggcgcacgaaatcaccctcggttaccgttacctgaatgaaaccatggacgaaaaggcgtcgcgttcggcctggtataatccggcggatatcggctcgacgccggagaccccggactattaccagcacacctccggcggcaccgcggccaacgcgttctatatcgacgacaccatcaacgtcggcaactggacggtcacgccgggccttcgttatgaaagcatccgcacccacgtggacgatgccttcaacaacatcagccgcgagaaaagctacagcgaaccgctgccgtccttgaacgtgatgtaccacctgtccgacgcctggaagctgttcgccaacgccaacacctcgttcggcagcatgcagtatttccagctgaccaaaggcggcaacggcaaccaacctgcgccggggctgacggcggagaaagcgcatacctatgaattcggcacccgctacgacgacaccgtggtcaaagccgaagccacgctgttctacatcgacttcgataaccagctgcaatacatcagcaacgacgtgggctggaccaatatgggcgccaccaagcacaaaggtatcgagctggcgctcagctacgatctcagcgagctgaaccgggcgctcgacggcgccagcgtctataccagctatacctacaccaaggccagcaccgataagggcgacttcgccggtaaagacctgccgttctactcgcgccaggtctataccgtcggcacgcgctacgccaccggcagctgggtatggaatctggacggctacgcgcagtccaaacagcattcgccgggcaccgggccggagtacgtcacgcaggaaagcgccgatggtcagttcggcgatatcgccggttacatggtgtggaatatgcgcggtgaatataacttcgggccgcagctgtcgaacctgacgctgggcgccggggtgaaaaacctgttcgatcagcgttacttcacccgctccaacgacaataacttcggcaagtacgtcggcgaaccgcgcaccttcttcgtgcaggggtcgatcgctttgaataaccgaggccccgccggggcctcggtatcaccgaca

SEQ ID NO: 57289 - DNA, 117 bp, Glycine max
  Peptide Sequence Number=SeqID_148974
gagaatgaagcacatgtattgatgcaatcctaccccgcaagggcattggctagaagactccaagtagattgggctagagatccaaggaaaggccctagggttctcatgagccttagg

SEQ ID NO: 57290 - DNA, 822 bp, Glycine max
  Peptide Sequence Number=SeqID_148975
atgagtcttgattcttcatctagtattaatggtgagggttctactcctaaggaccccttgtataagatattagatgagttgagatcccttaagttgtggaaagaaaaacaagagagaaaagaaaaaggaaaaaaaagagtgaaagaaataagtcaagatgaaaaagagaaaataagggaagaagaaagaaggaaaatactaaaaaagttaagaaaagaaaaacatgcctcctatagtagtcataactcttgcaagatcctaagtaaagaacttcgttactattatgaaggaaggcataggtcacatcttagacctcactcccatatgaaagaaaatgaaagaaagtctcaagaggctaacattaacctcccatacttccatgggaaagacaatgtagaggcttacttagatcgggaaataaggatagagcaaaaacttaaaagaaagtctactttaaaatcttatggatctcattcttatccaaagaaagaccaaggtctaggcatattaggggcagcaccttctaagcccaaatatgataagggaaagacaatagaaaaacaaccccctaaggctagtatgcaagagaagactagctccataaagtgctttaaatgtcttggaagaggacacattacttctcaatgccccaccacaaaaaccatgattatgaggggccaagacatttatagtagccaagataaggctactacttcaccttcctctagtgaaagtgaaaaagcaaaaggggaagaatctagtgaagaaatctacccccaagaagaaagactaccattagtggttaaagagaagtgtaaggag

SEQ ID NO: 57291 - DNA, 405 bp, Glycine max
  Peptide Sequence Number=SeqID_148976
ggcggacggctggtctccagcgtgaaactggcgcgtgcgcagcagggggcggcggtgctggactatcgccagacggtgctgaccgcgctcggggatgtggagaatgcgctggtgagctaccgtaccgatcagcagcgtgaagcgggcctggcgaaaaccatcgacgcgctgcaaaacgcctttgacctggcgagcgacagctaccggcaggggatcgccagctttatcgacgtgctggacgcccagcgacagctggcgcaggcccagcagcagcgcgcccaggcgcaggtgcaaagcgcccttgacctggtggcgctctacaaggcgctcggcggcggctgggagccgtatcagcaggtgcaattaccggactacaccgtctttggcgatgccccgcgcggataa

SEQ ID NO: 57292 - DNA, 338 bp, Glycine max
  Peptide Sequence Number=SeqID_148977
atggccaagtacataatgtcaatgtggttacttcaacttccacttttgttattcttagccataaagacagcagttgagttatcgcagaaaattctcaaaggccttgaagtagtatcaactatcttcagcccaaaaatgaaactcttaatccatattgtcgcaacctacccttcggcaggagggcgacgcgtgactcgcgggatgcgtgttccacgaaaggaatacgcgcggagtcgccaccaacgtttatttgaggaaaacgtcggaaaaaccggaaaagacgcgatctacaaacttttaagtgaaaggctcgggagttgtatttacgcgcggggaag

SEQ ID NO: 57293 - DNA, 120 bp, Glycine max
  Peptide Sequence Number=SeqID_148978
atggaattcacaaaattgcctaatgatggaaccaaaccctcacaaggaccaaagaaaggtaacatgtcatcaagcaataatcaccggacgaaattagggatatgttcaagtaatgggtaa

SEQ ID NO: 57294 - DNA, 573 bp, Glycine max
  Peptide Sequence Number=SeqID_148979
atgttcatagatgggctgagacaacaaaccaagcaactgctagatgcttctgcagggggaaaaataaagctgaagaccccagaagaagcaactgagctaattgagaatatgttagctagtgatcacgccattctactcgacaaaacccatcaacccacaaagaaaagcttattacaggttgtaccatttgtggtgaggctcatgaaacaggccaatgtattcctgttgaagaaaacacacaagaaattcattatatgggaaatcaacagcgacaagggtaaactcaaggaggattttcaggcttctagtaggttcaacaaagaccagtgtggaccttcgaacaggccaatccaacaagggcctaacatcattcagaggactacaaagctggaggagactttgactcagtttatgcaggtgggacaattggccaagcagatagctgacaaatcatccaacaattttgtggaaaatatagaaaagaatcccaaggaggaatgtaaagctgtgatgacaaggagtaaaaggtttgtggaggctgaggctgaggagagtgttgtgcataagaagtag

SEQ ID NO: 57295 - DNA, 354 bp, Glycine max
  Peptide Sequence Number=SeqID_148980
atggcaagagttggtgacaatggtggtgtatatcatcaactggatggatctcaatgcttattactagacgcgatgactacacaaatgcaacatttgctgaatcgtaacaatgaagagctctacaggagaatagccaaatcttccttgtttattcttaaacctttatcccctagagaagtgtgtgatgaccaaatcagaatgagagaaaagagagaacaagagaaagaaaatagtgaggcaccacataggaataggaaaaggaagagtgatacacccgagggaaagagtgatacacataagagagagagtgatacacatgagagaaaatttaattattttgaagaggcgagtgaa

SEQ ID NO: 57296 - DNA, 390 bp, Glycine max
  Peptide Sequence Number=SeqID_148981
atggtgaaaagttggaacctcttacgtgccgatcaacgtctcattttcgccaaaaagttggcccagggctttcccggtatcaacagggacaccaggatttatttattctgcgaagtgctccagtggcttctgtttctatcagctgtccctcctgttcagctactgacgggggtggtgcgtaacggcaaaagcacccgcccggacatcagcgctggcaagtgtaggggtcccgctgcgcgtaaccaccacaccccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 57297 - DNA, 765 bp, Glycine max
  Peptide Sequence Number=SeqID_148982
ttctacgccaacctctacagtctcgagggaccttcacctaaacaagtcagaattcggggccacttaataaggattgatgcagacagcctcaatgcttttctagaaacacctgtggtgcttgctgagggtcacccggggaagatcctcaaaaaagatctaaccacccttgctcaggtctggagtgttctatcctactccaacctggctccgacctcccacacatcagatctgactgtggatcgagctaggttaatctttggcctagttactcaactggacatgaatgtcaaagccctcatttctgggcagattacttctatggcccagtctaactcctctagactcagatttcctattcttatcacagctttatgtaggaccagaggagttgccttcgatagtcttatctttgcttgtttgagcccggtcattaatttggcctacataaggaagaattgttggaaccctgatgatccaacagttattattaggggggccagaagaccaagggcaaggccagctgagactccttctacatcaacagctcctcatccagcttctacatcagcaactcctcttctagctcgtttgacagcagctccttctaccctacctcctatagattttcaacatttcaaagccatgcttcaaagcatacatcaggggaaaattattttgctccaaagtctccagctggtagcacctccaaactccatccctacagtagagcaatttaatgaatgggtagcctggccagggacttag

SEQ ID NO: 57298 - DNA, 681 bp, Glycine max
  Peptide Sequence Number=SeqID_148983
atgaaaaagaatagtaatttacgcagcctggcagcccaggctattgagcaggtcgtagagaaaggccagtctttaagcaatgttctgccgccgctgcagcaaaaagtgagtgagaaagacaaagcgctgctgcaggagctatgcttcggcgtcttgcgtaccctcagccaactcgagtggctgatcggtaagctgatggcccgcccaatgaccggcaaacaacgtaccgtacatttcctgatcatggtcggcctgtatcagctactttatacgcgaattcccccgcacgccgcgctggcggaaacggtggaaggcgcggtggcaattaaacgtccgcagcttaaagggcttatcaatggcgtattacgccagtttcagcgccagcaggaagagctgctggccgaattcgcccagcacgagaaccgttatctccatcctaaatggctgcttaaacgtctgcagcaggcctggccgcaacaatggcaggatattgtgtcagccaataatctacgtccgccaatgtggctgcgtgtgaatcgcaatcatcattcgcgagatgaatggctcgcactgctggaagacgctggtttacagggtttcactcacccggactatccggatgccgtccgtcttgcgaccccagccccggtccatgcgttaccaggatttgataaaggctgg

SEQ ID NO: 57299 - DNA, 744 bp, Glycine max
  Peptide Sequence Number=SeqID_148984
atggccgtgtccagcgctaactggatggcgatgggggcgattatctggctgttaatgggtgaagacgtgaattacttcttcgtgctgggcgtgctgctggtgagcagtattgccggggtgatcgtgcatattccggctgggatcggcgtgctggaggcggtcttcatcgctctgctggccggagaacatgtctctcagggcaccatcattgcggccctgctcgcctaccgcatgctctattacttcctgccgctggcgctggcaacggatgttggcgaagtgaacgcccctcaccctacccctctccccaaaggggagagggaaccgatcgagcccctctcccctttggggagaggggaacaggttgatgaaatccagatagagcgtcagcgcgcccagaatcgagtatttgcgcaggttagagctgtcgcgcacgtcgatctgttcgccaatatttttcagcttctgggtgtcatacgccgtcagccccacgaagaccaccaccccaatgtaggtcaccgcccacatcagcgcttcgctcttcagccacaggtttaccagcgacgccagcacgatcccgatcagccccatgaacagcatgctgccgaagccgctcagatcgcgtttggtggtgtaaccgtagaggctcatcgcaccaaacatcccgccggttaccacgaaggtgctggcgatggaagagtaggtgtaaacgatgaaaatgctggaaagcgtcagccccgttaa

SEQ ID NO: 57300 - DNA, 214 bp, Glycine max
  Peptide Sequence Number=SeqID_148985
cgattatcctcctcacatttcagctagcccgcatcagttagaccttgcaccttatgcttcaggatcatacaatgctcaatggaatgccccagaactcctccatgataagcacatgtcgcatttgagtcatatccttggaaaaatgggggttgaggaaccttggctgggggtggtgtttggtattggatgtgcagtaggcgggccttgtggctga

SEQ ID NO: 57301 - DNA, 549 bp, Glycine max
  Peptide Sequence Number=SeqID_148986
aatgtgcgtaaaaaggcacaggccatccaaaaacagaacattgccccccacgttttgtctcgtgggggttatgaatatttggagcagaagctcctggctgagaagacgaagaagaagttggaggaagctgcacagtcaggaagtgttgatggcgtcatcgatcctccatcccaggtcagacgccatgtgaagtggaagatggcccgtacgaagaaaacaggggagatgacgactggggccgcaaaggaaatcgttgagaagattgtaagcgacacagggatccttcgtccccatggacgtcgggatgttctcaccactactattggacgtccaaagcaccctggacgtgtctgtgctgctggagtcggtgtcaccatcaagcaatactttggatcggctccacggacgtcccgcagctcttcctccctgcctcctgatgaattgcagcagctgacccagcaaatcagggaccagttagaggagtccatcacagaaaaagtgacgcggcagctcatggcatcgttcagccagatgcagtcccagatttag

SEQ ID NO: 57302 - DNA, 141 bp, Glycine max
  Peptide Sequence Number=SeqID_148987
atggcgttgatgcatgaagaagcagctgaggaagaagaagatgcagcagaggatgtacagaatcagacttgcatgatgattctgatgccaccccatgactaccgctattggggcatctgcttagctgctgatgagttttaa

SEQ ID NO: 57303 - DNA, 798 bp, Glycine max
  Peptide Sequence Number=SeqID_148988
atggcgcattataggcagaatcacaccggcgcagccaccgattttgcctttgaattaccggaatctttgatcgcccactatccgcaggcgcagcgcagcggttgccgcctgctgtcgctggatggcccgagcggggcgctgaaccatggcgtgtttactgatgtgctggataagctcaatccgggcgatctgctggtgttcaataatacccgggtgattccggcgcgcgtctatggccgtaaagccagcggcggcaaaattgagatgctggttgagcgcatgctggatgacaaacgcgtgctggcgcacgtgcgcgcctccaaagcgccgaagccgggtgccgaattactgctgggcgacgacgaaagcgtcaaagccaccatggtggcgcgccacgatgcgctgttcgaaatcgagtttgcggacgatcgcgcggtgctggatatcctgaacagcgtcggccatatgccgctgccgccttacatagatcgtccggatgaggaagctgaccgcgagctctaccagacggtgtacagcgcgcgccccggcgcggtggcagccccgaccgccggtctgcacttcgatgagccgctgctggcggcgctgaaggcaaaaggcgtggagatggcgtttgtaacgctgcacgtcggcgctggcaccttccagccggtgcgcgtagagaacatcaacgatcacatcatgcactctgaatatgccgaagtgccgcaggacgtggtggacgcggtgctggcgtgcaaagcgcgcggtaacaaagtggtggctgtgggcaccacctcg

SEQ ID NO: 57304 - DNA, 819 bp, Glycine max
  Peptide Sequence Number=SeqID_148989
atggccgatgggttcaacgaggaggccattgcccagctgttatgcacaccgaggcaggatttcgcccggaccactacagggaggcgggtgcggatcatgcgcaccagtatgaccaccttgacccagacgtggatgacattgctactcagcaatgtcttgcctagcgatcataactttgatctccctctgccgaagtgtcagttggtatatgccatcctgacacggatgagcgtccacgtggctcaggtgattgctgacaccatctatttgtttgcaggtatgccacccaccaggcaccctctagacctggataagtctaataaggccctggggtttccggcattgatcacgggcccctgccagtcatttggggttctcgtcacccctagtaaggtgatccaaccgccaatcacccgggccttcatcgagaagtattgcacgcctaggcaggcgcagggtgatgcacctcaggccgcagacgcaccgccaccacctcatcaggccgatcccgctggatcacttggcatggagcgttatctacagcacttggttcgccagcaggcggccaaccaccgggggcaggtgcagatatatgagtgtctctaccggttcagccttagtcagcaggggcagggtttcgctccttttgcgtgccctactccagagcagtttggggctgaggtcacatggcccggagactggcccgaggcccaggcaggggaggcgcttgcaggatcccccgacgatgcagaggagcccgtattgatgagagatgacgatttgctcggtttcttgggaggaagcgagccacgtgactga

SEQ ID NO: 57305 - DNA, 1094 bp, Glycine max
  Peptide Sequence Number=SeqID_148990
ggcgccaccctggcggcggccgtggcgcggcagctggtggtctatcatcggcgccccggcgggcagtcgcagtattcgctgctgctggcgttgaacccgtcgtcggatcgcatgcgcgccgcgctgtcgttcgcgcgcgagcacttgcacctgccactgtcggtggcggatctggccgacgccgcctgcctgagcgagcgccagttcggccggctgttccgcgccgaaaccgggcagacgccggccaaggtgatcgagcaactgcgggtggaggcggccagggtgcgcatcgaagagagcgccgagccactggaggcgattgctcgctcggtggggttcagcgatccggagcgcatgagacgggcgtttatccgcgtatttggcctgtcgccgcaggcgatccgccggctcggccgcgcgggataacttttttgccacgcctggcggcggggcacaccagaggagcaacggatgtatcaggatttcgagagcgaattgaactgggcgatgcgccatatgccgcgcactcgggcggcggtggcggcgttgccggacctgcacggggtgcggctggcgtgcaatatgcacctggatctgaaaatggcgccgctgaacgacgtggtggcctggctggaacggcggggcgtgcaggcctatgcctggcgcgacatgaacgccggcgaatggtcggagtccttcgaccgcgcgctggcctggcagccgactcacctgtgcgaaatgggggcggatctgaccacccgtttgcaccaatcgccgagcggcccgcagatcgtcgccgggctggaggccaccggctcgggcatcagccggttaaacggcgtggcgccgcgctacccgatcttcaactgggacgatctgccggtgaaagaggggctgcacaatcggcatatggttgggctgaccgcctggcacaccttcttccagaccacccatttgacgctgcacgaaaagcgcgtgctggtgatcggctacggcctggtcgggcaggggacagcggcggcggccagggcttacggcggccaggtgatggtggcggaaatcgatccggcgcgcgcgctgcaggcgcgttatga

SEQ ID NO: 57306 - DNA, 560 bp, Glycine max
  Peptide Sequence Number=SeqID_148991
ggtggacccttgggtacacgtcctcaccttcagagaactacacgtcctcaccttcagagggctgcacgccctcgccttcagagggctacacgtcctcgcctttagaggactacatgtcctcgccttcagagagtggcgtgccctcacctttagagggtcctctgcacttaaatgcttcaccaagacttgcgctcccggttatggggccagtagtttccttttatcagttcttgggccaccccttgatattgaagagcaaccaactgtgcaagcacaaccagagagggaggctatcacgcagctactatgcataccggggcaagatttcacccgtgccgctgcaaagagacaagtgcggatcatgcgcaccaacatgaccactcttacacagatatggatgacgttgctacttagcaacattccacccggcgaccgcaatgccgatctccccctgggtagcgcccacaagacacccggaggagcccagcagggccctggggtttccagctctggttaccggcctctgtcagtcctacagggtgcccgtcccccccagcaag

SEQ ID NO: 57307 - DNA, 222 bp, Glycine max
  Peptide Sequence Number=SeqID_148992
atggggtaccgatcacgcccacaaagctcatccgaccctccattaacaggtctttcattgagaagtattgtatgcaaagctcacatgcagaggatggagctccagatgcacgcgtacatgcagcatttggctaaccagcaggcggcaaaccataggggtcaggtgcagttgaacgatagcttctatcagagccactgtcgcatggcctggggacaagcctaa

SEQ ID NO: 57308 - DNA, 210 bp, Glycine max
  Peptide Sequence Number=SeqID_148993
atgtcgcgaaactttatggattatgcaaccatcccttctttgacttctggaatgttacagaactttgacggattgccaacaatgcttcctttcggaaaccatcccgaacatgtcggaagcttcacggattgcttcctaatgatgggtgttaagtacctcgaagcggttccaagcgaagtgttgcataatggtcgccagactcgaaattag

SEQ ID NO: 57309 - DNA, 258 bp, Glycine max
  Peptide Sequence Number=SeqID_148994
atgtggactaccacgggggaggagcttgccacccagctcgcccaggcgagcaaggttgcttcctccagaagcaatagccttctggaggaaggatctagaaggcccaagtgggccagattgctatttgtacccccttttttactaaatgcacccccttctatttttttgctttcaaaggagttacggaaactcacggattacgcaaaaacacctcttttcgatttctaccacatcacggaatttcacggattgcgctag

SEQ ID NO: 57310 - DNA, 561 bp, Glycine max
  Peptide Sequence Number=SeqID_148995
taccggagaatgttaaattagaaatgattgctgcttatgagaagaatatagctgaaactgctgcatacatggaggctatgcaagaagaagacgaggaagaggaagatgggatcctagagattgcacgacttaaaagtggaaaaaagcgtccaacaacatcaaatgaagcctccttaactgcttccaataagaggatcacaactaaaaaaggccccattgattttttgttctccaaagcacctgaagaaagtatcaaattaggaaaaaccatgagacaatcaagtgtaaatgaaacttataacaaggctgcaagagacagggcagcgattggaacctatggtcctcatttaaagcctcccagctatcatgaattgagagttccactccttaaaaaagagttggaatacacgaagggcttatatgaggggagtgtggatgcttctgaatacatgaagactggtcagaagatctttgagcttttggatagctttgttgaggagattggagaaaagaatgttattcaagtggtgacggacaatggaagtaattatgtgttggcgg

SEQ ID NO: 57311 - DNA, 561 bp, Glycine max
  Peptide Sequence Number=SeqID_148996
gtcctcgccatcagaggactacacatcctcgccttcagaggactacacatcctcgccatcagagggctgcacgccctcaccttcagaggactacacgtcctcgccttcagagggtcatctaccttcatcttcagagaactacacgtcctcgccttcagagagctgcacgccctcaccttcagaggactacacgtcctcgccttcagagaactacacgtcctcaccatcaaagggctgcacgccctcaccttcagaggactacacgtcctcgccttcagagggtcatgtaccttcaccttcagaggactacacgtcctcgccttcaaagggctgcatgccctcaccttcagaggctggacgccctcaccttcaaaggttcttgggccaccccctgatattggagggcgaccaactatgcgagcacaaccaaaggaaggctatcacgcagctactgtgcataccggggcaaggtttcacccgtgccactgcaaagagacaagtgtggaccatgcgcaccaacatgaccactcctacacagatataaatgacgttgctacttag

SEQ ID NO: 57312 - DNA, 618 bp, Glycine max
  Peptide Sequence Number=SeqID_148997
atggctccgagaaagcttcctgcaaaaagatccaggaaggacaaagcggctgaagggaccagtgtcgctcctgagtatgacagccatcgcttccggagtgctgagcaccagcaacgtttcgaggccatcaaaggatggtcattccaccgagagagatgcgtccagctctgggacgatgaggaggtcatcgcccagttgttgtgtataccgggacaggattttgcccggaccactgccgggagatgggtgcggatcatgcgcaccaacatgaataccctgactcagacatggatgatgttgcagcttagcaacatcctgcccagcgatcatgattccgacctccctctgccgaagtgtcagctggtgtatgccactgtcgcagcatgcccattcgcgggcgagcaagggcgaggctcacgggtgcgctttccaaaggaggaaagatgcgcggagtcgccaccaacgtttatttgtggaaaacgtcgaaaaaaccgaaggaaaccggtcaaagtgaaaattcaaagttcgggagttgtatttacgtttgaggaaggtcgacaaaagcggggcttttgctcctacgtaccctccatcgaagaggaaatcagacctacgtag

SEQ ID NO: 57313 - DNA, 457 bp, Glycine max
  Peptide Sequence Number=SeqID_148998
gtcgactctagaggatcccacgctttcaaaattgccccatgtgtggcatctcttgtcaatgtcaggatttacacgcaattctcctcaaatttcagccagcccgcatcaattagatcttgcaccttacgcttcagagccctacaatgctcaatggaacgccccggggcttctccgtgacaaacacacgttgcgttcgagtcgtattctcggagaaatggaggttgatgaaccttggctagggttatggctaccattgaattatcaagtagatatgggagcaagtcagcataggacactggaattggggtggtattcgtcattggaagtgcgtaatgacattgttgggttggtgggaaacttggccgtacagggatggcagtcacagcatgggtttctccctcatcctcaccctctttatttgccccagttttctcattcgtccaagcaggatgattaa

SEQ ID NO: 57314 - DNA, 237 bp, Glycine max
  Peptide Sequence Number=SeqID_148999
gtcgactctagaggatcccaccccacgttctactataaaaagctgataggctacatgccagctaacttcgcggatctcgtcttcgtcggagaaaggattgaatccagactacgaaaaggcaagtttgaatatgcttccaatgtggcccccaataacaacagaagagccccagtagtgggcgcgaggaaaaaggaaaaggagacacccacgcggtcaccaccgccccgacgtggatga

SEQ ID NO: 57315 - DNA, 264 bp, Glycine max
  Peptide Sequence Number=SeqID_149000
atgctgcaggtcgactctagaggatcccaatccgatttgaggacaaatccttctcaagagggagagaatgatgaggacatgttcaagagcaagggcaaggatccacttgaaggacttggaggacctatgacaagggctagagcaaggaaagccaaggaagctcttcaacaagtgttgtccatactatttgaatacaagcccaagtttcaaggagaaaagtccaaggttgtgagttgtatcatggcccaaatggaggagaactaa

SEQ ID NO: 57316 - DNA, 309 bp, Glycine max
  Peptide Sequence Number=SeqID_149001
atgaaggtatcttccttgggtattccttacatagtaaagcatttagaatatacaacaaaagaacccatgacaattgaggaatctatacatgttacttttgatgaaactaatatttcctccccaagaaaggagtttgttgatgatattgcagatactttggaagatactaaaaataaagaaagagagatgatgaagacaaggatgatcaagatgacacaacacaagaaaatgataatcttcctaaagaatggaaaacttcaagaaatcatcctcttgacaacatcatcggtgatatctcaaaaggggtaa

SEQ ID NO: 57317 - DNA, 507 bp, Glycine max
  Peptide Sequence Number=SeqID_149002
atgttttggctggccagtttgaacctgggctattggttggaggttgtctttggccaagtttcaggaaaaggtagaagggtagtctttaaactaaaggacttgagccagcaattactatcttgcactttgtgggatgattattgcttgcagtttttaaagttcttagatgattatgaaggtgatggtccaattacagttctattgacccatggtagaataaaggaagctcagggatcttatcccccatcggtcagcaattttttcaaggtttcaaagttaattattaaccaaccggtgatggagattcaagaattcaatgaatggcttgcggagttgggcattgaggcccggtcaggttttaaatcccatggtgaagggagtacacaactttcaggttctatccaattatcatcaaaggaaccattctttggaaagactgaggcaaagactattgatgacattaacaccatctctgaagtaatcatcttatatagggggatcctctag

SEQ ID NO: 57318 - DNA, 183 bp, Glycine max
  Peptide Sequence Number=SeqID_149003
atggaagctccattggagcttcggaatggagaaagggagagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 57319 - DNA, 300 bp, Glycine max
  Peptide Sequence Number=SeqID_149004
atggctgctagtgaccacacaattttgagagatagagtccacattccaacaaagagaagttgcagggtgtgcattgtggtggagctcacgattctggctgctgtatccccaatggagaaccagctcatgaagtcaattatatggggaaccagccaagacataatttcaatgcaggtggattctctggattctagcatggccaacagtataatcaacagtagggacagtggagaaatcaccctggaaatcctttcaacaccagggtggaccatccacaaggccacagcaacaagggcctag

SEQ ID NO: 57320 - DNA, 867 bp, Glycine max
  Peptide Sequence Number=SeqID_149005
gcaggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataa

SEQ ID NO: 57321 - DNA, 219 bp, Glycine max
  Peptide Sequence Number=SeqID_149006
atgcctccccgcttcttcttcgtcagcctccgcaaaaaatgcgttacgcaaatcaacaccgaacaagtcaccgttattaggtgttggaattggggccatgatattgctgtgaaggggtcattgtgggccatgaaaaatgagcttgtgtttccgcaacaccaccaaacgattgctggcttgcagaagtatcagtgtgatgaccctggaaaaggatactaa

SEQ ID NO: 57322 - DNA, 273 bp, Glycine max
  Peptide Sequence Number=SeqID_149007
atggttggagcattctcgcaaaacaatgtgaccctgactggtctccctatgatttcacctagtgagagagacctaacttaccaatgtggtctgtcttgtcatggtaaagagtgtcacaatatcaacatacttgtagaaggcacaatccgaattgctaaacactccctttctgaatgttctgttgctcgtcccacccaacaaagctcaacaactcaatcctactcctctcctcctaccaagtggcacaaaccgcaagagggcttcttcaagtga

SEQ ID NO: 57323 - DNA, 318 bp, Glycine max
  Peptide Sequence Number=SeqID_149008
atgaggtcctttaatggtgattttccaccatgtagatgcagcggaagacaaaggagaagaggtgagaggaggcgccatccactagggaataagccatggaagaaggagcttcaccaccaagatgagccttggataagaagcttggaaggatgcttcaatggaggaaaagaaagagggagagaaagagagaggggggagcacaaaattgaaggaataaaagagggaaagaagtggaactttgaagtagcttccttgagaagctttcttgagaaaacttccttgagaagcttctttgagaaaacttccttgagaagctag

SEQ ID NO: 57324 - DNA, 463 bp, Glycine max
  Peptide Sequence Number=SeqID_149009
atgtctaaatcttgtggatttgggatgaccgaccctctcgatgagtcgatctcttgctttcttataagggtggacccttgggtacttgtacttatcgcctttagaggactacacatcctcgccttcagaggactgcacgtcctcaccttgagaggactgcatgtcctcaccttcgtagggctacacgccctcacctttagaggaccaaacgtcctcaccttcagagggctacacgccctcgccatcagaagactgcatgtcctcaccttcgtagggctacacgccctcacctttagaggactacacgtcctcgccaacagagggctgcacgccctcaccttgagaggactacacgtcctcgccaacagagggctgcacgccctcacctccagaggactacacatcctcgccttgagagggctgcacgccctcacctttagagggctacgtgtcctcattttca

SEQ ID NO: 57325 - DNA, 157 bp, Glycine max
  Peptide Sequence Number=SeqID_149010
atgttcatgataataacctatccttggaataagctctgtagcatagggactaaggtttgggagctctggacatctgatcctactgttattgacggaggagctggagtggatgatgaagggctgttatctgctctggctctttttctcgatgccatct

SEQ ID NO: 57326 - DNA, 399 bp, Glycine max
  Peptide Sequence Number=SeqID_149011
atggatgagaagaaagagaaacaactggaggaagctgctaaatatggaagcactaacaccgtgattgatcctccatctcccatcagacgacacatgaagtggaagatggcccgcataaggaaaactgaccaaatgacgtctgagatagcaaaggaaattgctgacaagattgcctcacatggttcctttgtcagccatgaacgtcaggatgtactgactgctgccattgggcaaccagaacaccctggtcgtgtgcatgctacaagaatcggtgtcacgatcaaacaatactttggaccggctccaaggacctcccccacttctttgtccatggctcccggagacctagagcggctgacgcaaaagatcagggaccagttggaggagtcgatcacataa

SEQ ID NO: 57327 - DNA, 312 bp, Glycine max
  Peptide Sequence Number=SeqID_149012
atgacaaggttgaacaaccacgacacttcccggttcgcctcccctactcggttatcgtgccttgccacagcaggtagtctgcgtggaagagatctcgcgtgtctaacgggcttgattccggacgacgaggtagtctacgcggaagatgagcataaatctccgcgtgtcaacgggcttgtagtctgcgtggaagatgacgtaaatctccgcgtgtcaacaagtttgttggcgtcgattgacaaagggtgcagaagagacgtagatggtgcggagaaactgcttgtgtatctccgcacgtcacctgacttgagg

SEQ ID NO: 57328 - DNA, 483 bp, Glycine max
  Peptide Sequence Number=SeqID_149013
atgggtgaagtagaagaggtgcaagagcagatgaaggccgacatggaggccatgaaagagcaaatggccacaatgatggaggccatgatgagaatgaagaagataatagaagccaatgcggttgcagttgttgccaccagcgttgttgctaaggtgaactcgacgcttccatctggcctcttccaaatgaatcatccaacctcagatatggtagacaaagatttaggaagtatgggcggcccccattatgtgcaaattcaaaacaagcatgccttctcgccatatggcttgcctcccaactatatgccacccaatgtggcgtacactcccaatgagaatgtcaatagctccactcatatactcattgagagccaacaacctcaatctgatcgtgaacatgtctctcaacccatgggggagacacatgaaaatgccccaccacaatttagccgacttcgagccttgcctcggatatgccactga

SEQ ID NO: 57329 - DNA, 252 bp, Glycine max
  Peptide Sequence Number=SeqID_149014
atgcacacacaaagtttcacaaatccacaattccttaaaataggcctaactcacaaaaagtccccagtggagtcgccaactgtcgcaacgtgcccttcgcgggcgagcgaaggcgaggctcacggatgcgcttccaaaggaggaaaggtcgacaaaagcggggcttttgctcctacctaccctcctttggagaggaaatcagacctacgtagttcttccttaagcgtgaatcgagtgattctttttacttga

SEQ ID NO: 57330 - DNA, 321 bp, Glycine max
  Peptide Sequence Number=SeqID_149015
atgtttgatactttaaaaactgatggagaattcggccatttcaatttagggaatggtggaaaaatgaaggttgaaggcatagggagcatgacatcacaagggtacaagtatgctggttcaaagtggggatgcaaggtatacaaggggatacacttggcgttgcaaggacaaaaaaataaagataacctttgttatttggatggtcaagccttgaagaggagccatgatagcaaagtgaagaagaaagtgaagttttctaatgttgaggaagtgttgggagatacttcctttggagggggagtttgttcactttcaaattga

SEQ ID NO: 57331 - DNA, 279 bp, Glycine max
  Peptide Sequence Number=SeqID_149016
gggcatgtgcttgctagaaagactcttgtccaaggtgatgcaagctccattggagcttgtaggcctaggatcttcttcatcaatggattcatttgcttcttggaagatgaatggcagcggaatgaagaaaggaagagagagaggaaacgccacttcaaggaaaagatgagtctagaagaagctcaccaccataggaggccatggataagagcttggaggaagaaggagatgaatgaagggagaggaagagaagagcacgaaattttgtgctccaaatga

SEQ ID NO: 57332 - DNA, 366 bp, Glycine max
  Peptide Sequence Number=SeqID_149017
atgaagcttcttcctccttcatcttcagattttcgaattttgtggccaacagtgtgggtgcaatgctggaccaacttcactgatttggagatattccctcctgttcagctaccattgacggggtggtgcgtagacgcaaaagcaccgccggacatcagcgctggtccaagtgtagcggcattcgtcttgcgcgctgcgcaactgttgggaagggcgatcggtgcgggcctcttcgctattacgccagctggcgaaagggggatgtgctgcaaggcgattaagttgggtaacgccagggttttcccagtcacgacgttgaattcgatggacacatcaaagctgaaagtcctctcctctgcttcttga

SEQ ID NO: 57333 - DNA, 234 bp, Glycine max
  Peptide Sequence Number=SeqID_149018
atgtatctattggaaggagacgtttcgtttctaaatgatcatctagaggaaacactgggttcatcaaaaatagaagaaaatcactcaaagtgtatcaatctcccacagggcaaggatgggcattctcaccctgggtcaaggtttatggtgagttgggactttggctcaaggcttgtagaacggatggacatgatatatgtcaaagcgttggtttggccagcggttcaaggataa

SEQ ID NO: 57334 - DNA, 201 bp, Glycine max
  Peptide Sequence Number=SeqID_149019
atggtagctataaccccagccaatgttcctcaacctccattttttcgaggatacaactcgaacgcaacatgtgcttatcatggaggagtctcggggcattccattgaacattgtatgaccttgaaacataaggtcatgacaaaagacatgaatagatacctcagagccctacaatggagcaatgagaggcaccatgcataa

SEQ ID NO: 57335 - DNA, 188 bp, Glycine max
  Peptide Sequence Number=SeqID_149020
atggcttccatgatggatgccatactgggaatgaaacaactaatggagagtaacgcggccaccgccgccgctgttatttctgctgctgaagcagacccgactctcccaactgtcgcgcaccacccttttccgaacctggtgggacgagagagaagcacatcggggcacatcagcaacccccatctggg

SEQ ID NO: 57336 - DNA, 354 bp, Glycine max
  Peptide Sequence Number=SeqID_149021
atgtcacaaaaccttacagattacgcaatcatcccttctttggcttccagaatgttatggaactttacggattgcgccttaacacgtcctttcaactcccgacatgtcgcgcaacttcacggattgcctaacgatgggtgtcaagtacctcgaagtggtcaagcaagggtcgcaccccaacaaacagatgatccccggacgaaattaggaaattttctatggggaggtgattttgaggccaacaagatcccttgggtgaaatgggacacaatttgtcttcctaagaacaaatgggggttagggattaaagacttgatcaaatttaatgaggctttgcttggcacatggggttag

SEQ ID NO: 57337 - DNA, 162 bp, Glycine max
  Peptide Sequence Number=SeqID_149022
atggataaatttgacttctttgtccctcatcctctcgtaattacatctttgcttccactggaatgttgtgaaaacaaaacaacggtggatacctcagagccctacactggggcaatgaaaggcaccatgcataaacctcaagcgaacctaggggcagattag

SEQ ID NO: 57338 - DNA, 246 bp, Glycine max
  Peptide Sequence Number=SeqID_149023
tggcgtctcctctctctcttccttctccattacgctgccatttatcttccaagaagcaaaggaatccattgatgaagaagatcctaggcctacaagctccaatggagcttgcatcatgtggtatcagagcacaagagcttcaagtgttgagggaaggagcccagagtatgaagaacctcgggatttgaggtcaaatcctttccaaggtggagggaatgatgcaatcctatcccgcaagggcattgg

SEQ ID NO: 57339 - DNA, 219 bp, Glycine max
  Peptide Sequence Number=SeqID_149024
atgggagattcagctaaagttgtgatcaaacaagacatgaagggaatagagcataaatatgggtttaacaacaataaacgtgagaagccagagaagaaaaggaaaattacattagccaattgtcgcaacctacccttcggcgggagggcgacgcgtgactcgcgggatgcgtgttccacgaaaggaatacgcgcggagtcgccaccaacgtttatttga

SEQ ID NO: 57340 - DNA, 651 bp, Glycine max
  Peptide Sequence Number=SeqID_149025
atggccccgaggaaacttgcctcaaggagatccaggaaggataaagcggccgaaggaactagttccgctcccgagtatgatagtcaccgctttaggagcgctgaacaccagcagcgcttcgaggccatcaagggatggtcatttctccgggagcgacgcgtccagctcagggacgacgagtataccgatttccagaaggagatagtttgccggcggtgggcatcactggtcaccctcatggccaagttcgacccagacatagtcctcgaattttatgccaatgcttggcctacagaggagggcatgcgagatatgaggtcctgggtgaggggtcagtggatcccgtttgatgcagatgctatcagccagttcctgggataccctttagtgctggaagagggtcaggagtgcgagtatggccagaggaggaaccggtccgatgggttcgatgaggaggccatcgcccatttgctatgtataccgggacaggattttgcccggactgctgccgggagacgggtgcggatcatgcgcaccaacatgaccaccctgactcagatctggatgactttgctgctcagcacatccatcccagcgaccataattccgacctccccctaccgaagtgtcagctggtgtacgccatcctga

SEQ ID NO: 57341 - DNA, 627 bp, Glycine max
  Peptide Sequence Number=SeqID_149026
gtgggaagcattgatgtggcggttgtcaaagaattttatgccaatctgtacaaccctaaggatcagtcacccaagcaagcaagagtaagaggacacttaataaagattgatgcagacagcctcaatgattttcttgagacaccagttgtgctaaaggaaggggagaccctacccacctactctagactttgtaggttgaggtctaatcctcaagagatagaggctagactgtgtattccccacaagggttttgttctgaatgccgaaggccaaccatggaagctcctcagaaaggacttgaccatattggcccagacgtggagtgtcttatcttactccaacctagctcccacatcccacacatcagacttaaacatggatagagctaggttggtttatggtttggtaactcacatggatatgaacattggcgcccttatcttgggtcagatttcttctattgctcaaagtaaatgctctaggctcggatttccagccttgattactgctctctgcagagctagaggagttacttctaatagtttgacctacgagagcctgagcctggccattaatttggcctacattaaaaagaactgttggaatttgggtgcctcttacagttaa

SEQ ID NO: 57342 - DNA, 459 bp, Glycine max
  Peptide Sequence Number=SeqID_149027
atggatattgactatgctataaggaaggatgagccaccagctattactgaaactagcgaacctaatgttgttgacctttatgaaaagtgggagagatctaatcgtctctccgttatgttcataaaaaccaacatatccgctagtattcggggttcagttgaccagcatgataaggtcagagatctgttgaaagccattgatgaacaatttacaatctctgagaagtcgcttgctagcacactcattataagaggagagattgataatgggaagagggtgagaaggaagaagtctgtaggcaccgataaaggaaagattccgactcaaccaacaattaaaaaggagtcaaagtgtttcttctgtaaaaagaaaggacacatgaaaaaggactgccccaaatttaaaagttggtttgagaagaaagggtatggaaagcctaaggaagccagtgggaagtga

SEQ ID NO: 57343 - DNA, 762 bp, Glycine max
  Peptide Sequence Number=SeqID_149028
gtatgctctcactcgaacccttcacagaagatcagggtcggtcggcggtgcaacccacagggggatcccaccaatcagcttccttgcgccttacgggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccccttgggacggaatttaccgccccgattggggctgcattcccaaacaacccgactcgccgacagcgcatcgtggtgcgacagggtccgggcacgacggggctctcaccctctctagcgcccccttccagaggacttggccccggtccgccactgaggacgcttctccagactccaattcggacgccgagggcgaccgattttcatggtgggctgttccgggttcgctcgccgttactaagggaatcctacgggtagccccgcctgacctgaggtctcgttgggagcgtgcgtgcacgcaaagggtcgtcgatgggtccagaactgaccggctcgcacgcgattggtctcgagcgtggctcatccaccattttatcacggcgaagtcggccatgaacccagatttcaaccaaccacgaggcgggcgtgccctcggcctaatggcttcgggcgcaacttgcgttcaaagactcgatggttcacgggattctgcaattcacac

SEQ ID NO: 57344 - DNA, 381 bp, Glycine max
  Peptide Sequence Number=SeqID_149029
atggcagcccaagaagaagaagatgatgaagaatcagaagatgaagaagacttctcattctttgtgaagaagtttcacaaatttgtcaagaatagaagaatcgagaggcgtcaaaatttcaaccatggaaaaagattccaagaaggttctccaactcttagatgctacaagtgcaaccaacttggtcacatcaaagcaaattgcccctcaaacgagcaatggcctgagaagaatgataagaaaagccatgaagaaagaaggaccaagaaggcttacatcgcttgggatgacaacgattcatcagaaggatctgaaaaggaggaaatcaatcttttaacaaaagccaatgagagtgaagaggacatcactcaaagggattaa

SEQ ID NO: 57345 - DNA, 950 bp, Glycine max
  Peptide Sequence Number=SeqID_149030
gacttccagctagtgccaactgtgaaagagtttgaagaaatcctgggatgcccactgggaggaaggaagccatatcttttctctgggttctatccctccacgacaagagttgccaagtaccaaggaagtgtttggaggaaagggcaaaggccttggcaaatcaaggcgaatgggctctcttttattgacatcttggcgcttttgatctttggagttgtcctctttccgaatatggaagggttagtggacctagcagtgattgacgctttcctcgcctttcatcatggcaaggaaagcccggtcgtcgccattttggccatgtatgacacgttcgaccggggatgtgaaaagagcagcgcaagaattgtttgttgtgcactggctctctatgtgtggctggtttcgcacctttttctccaagaaggtaggcccgtctatccgctacaaggtcaccgctcgtgcgtcgaaaaaggaaaggcgaattgggaccaactcttggctagcatggagggacgtctgttaattggttccctcactagaaggaaggaagaatcaggattctatcttcatgcgaaaggatgtcccatgagaggagacagagagcttaggggaagcagtaatgggatcatcggcggctatcataagtggctgagagtccggacacaaggattggattggctcccaaatctaaagactgtgagagacaatgaggttaaagcttcgggagaaagtgatgaggtacaagccctaaaggcaaagcttgaaagagcccgggtagtcaaagagaagttcaagtccatagccatcaaaggcagcaatagtgagctcaagctccgaagaggtgaaaggaatcatcacggtgagactgaagggaatatgtgggccatcatcgatgagtgcaaagagaagctaaatctagcggcgactcacgagcaaaggctagaggatga

SEQ ID NO: 57346 - DNA, 156 bp, Glycine max
  Peptide Sequence Number=SeqID_149031
atggactccttgaagcaaagttggcacattgatagcggttgctccaaacacatggcgggagatgcatcaaagtttattcatatttctcccaaaaatagtgaacatgtgatctatggagacaacaacaaagattttttttctcctctctgctcatga

SEQ ID NO: 57347 - DNA, 366 bp, Glycine max
  Peptide Sequence Number=SeqID_149032
atgatgtttgttgaatggtttatctggggagcctggttcgtaccgctgtggctgtggctgagcaaaagcgggtttaccgccggggaaatcggctggtcttacgcctgtaccgctattgccgctatcctctcacctattcttgtcggctcgctgaccgaccgcttctttgccgcgcagaaagtattggcggtgctgatgtttgccggcgcgattctgatgtacttcgccgcacagcaaacccagttcagcgccttcttcccgctgctgctggtttactccctgacctacatgcccaccatcgcgctgaccaacagtattgccttcgccaacgtggacgacgtcgaggccgatttcccgcgcatccgc

SEQ ID NO: 57348 - DNA, 182 bp, Glycine max
  Peptide Sequence Number=SeqID_149033
ttgagccggtccaagtgatagaggtgtcatcctctaaagaggatcttgaagaggaccaagaggagttatcttttgcacctgttatggatgcccctgacttaccagaggatgatgaggacccgctccttgatgttgattctccagaggatattatgtcagcatctaaggcagactctacatag

SEQ ID NO: 57349 - DNA, 188 bp, Glycine max
  Peptide Sequence Number=SeqID_149034
atctcgtcttttccggtttttccgacgttttccccaaataaacgttggtggcgactccgcgcgtattcctttcgtggaacacgcatcccgcgagtctcgcgtcgccctccctccgaagggtaggttgcgacagggtataactaagaagaaggtattgactatgatgaaacttatgctcaagttgcaag

SEQ ID NO: 57350 - DNA, 353 bp, Glycine max
  Peptide Sequence Number=SeqID_149035
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaagccgattaagttgggtaacgccagggttttcccagaattcgatcctcaaataaaaaggggtggcgactcgggcggaattattcctttcaagcaacacgcatctcgcgagtctcgcgtcgccctcccgccgaagg

SEQ ID NO: 57351 - DNA, 270 bp, Glycine max
  Peptide Sequence Number=SeqID_149036
atgtccgcagcggagtcgccaactatcgcaacgtgcccttttgcgggcgagcgaaggcgaggctcacaggtgcgcttttcatttaaggaggaaaggtgcgcggagtcgccaccaatgtttatttgtggaaaatgtcggaaaaaccgaagtaaaccggtcaaaatgaaaattctaagttcgggagttgtatttacgcttgaggaaggtcgacaaaagcggggcttttgctcctacgtaccctcctctggagaggaaatcagacctacatag

SEQ ID NO: 57352 - DNA, 333 bp, Glycine max
  Peptide Sequence Number=SeqID_149037
atggcccgagttatgttggggaacggtgatgaacccgggatgggtttaggcaaagacaatggcggcataactagcctgataaaaacccaaggaaatcgtgggaagtatggtttaggctataagcccactcaggcggacatgaaaagaagcaccgcgggaaggaagaacagtggtcagagctcgcgttggagacaagaaagtcaagggttcgcgatatgtgaagacgatgttccaagtactttggatttggtccgaccatgccctcctgatttccagctgggaaattggcgagtggaggaacgccccggcatttacgcaacaagcataatgtaa

SEQ ID NO: 57353 - DNA, 333 bp, Glycine max
  Peptide Sequence Number=SeqID_149038
atgaagcttgcctctacagccttgttactaaagattgctaattggaaacactgctctaaaacatgtgttcaaatcaagctttttcattcaccaagagatttccagctagtacttataattgaggagtttgaaaagattgatggatgccctctagaaggaactaagcctttcttcacttcaggacactctccatccatacctagattatccgaagtgttgggaattcctgtgactaaactcagagaaaaggagatgaataggaatggagttaggagcttcctgaagaaattaatggaggataaggcgcgagaatgtgccagtaaaggagaatga

SEQ ID NO: 57354 - DNA, 272 bp, Glycine max
  Peptide Sequence Number=SeqID_149039
ccgtgaagctgtcatttgattcttctttttccaggtttctattttcgtccaacttttttttccggatttctcctgtttgcaaaaccaaaaagggttcaaaaattggagctactctctggcaagaactcttcactgaattgcgggacaagttacagtgtggttcttcgtatttgattcagaacctgaggattgttgacaaccaatctgaatacagagtctgcccagctccatatttggtttatttcctaaaaactacatgtgggatcctctag

SEQ ID NO: 57355 - DNA, 172 bp, Glycine max
  Peptide Sequence Number=SeqID_149040
attctctaattacactaagagcgttgtagctgtgcttagcggtagatgcgagctgagcccacaggccttggatcttcttcatcaatggagtcctttgcttcttgaacatcaatggcagcagaatggagaaggaggaaaggtgattggagacgccacttcaaggaggagatga

SEQ ID NO: 57356 - DNA, 423 bp, Glycine max
  Peptide Sequence Number=SeqID_149041
atcgactgggcccatttggttcggtaccgaatgcataaggcattacaggccaatgcacctcttccttatccacatttgattactctgtttttgcgtcattttcaaattccgcttgatgatgaaccctttgttcaagtcaagcgttcctttgcaattggtgctggtgcagtgacctcctttgggtatcgtaaagatcggaatggacaatggctgaagaaggatgcactccctcctcaagatgaacgtactccttcacctccccctcaacgtgaagattccgcactcatgaatgaaaaaacttcatcaaatggcagagccatcagaagagaaagggatcatcctcgcaccgctaccgctgcttgcccatccgtcacggcccatccggcacccacagcacctattcctccttctttgtctctctaa

SEQ ID NO: 57357 - DNA, 321 bp, Glycine max
  Peptide Sequence Number=SeqID_149042
atgggttttcctttgccggcggtcatttaccctgccaaaaatttatctgcattcgttattcgctctcccttgaggagattctgtgtcctcttcttcgggggaaaggatgaggattcttttcataggcccaggaaagctggagttgctgcacatgatgtccaacgttatgtcaaggaatcagatcgggctgcacaatgcacaaggcaagataaaatgtcaaatgaagaattgaagctgcaggatccacgatgtcggatacaatgtccaggacatcctgcccgaaaatactggaggtgctgcacaatgcacaaggcaagataa

SEQ ID NO: 57358 - DNA, 366 bp, Glycine max
  Peptide Sequence Number=SeqID_149043
atgtctcggggtggtcgacaaaagtggggcttttgctcctacgtatcctcaattgcgatgaggaaatcagatctacgtagttcttgcaaaagcggaaaaagggggaggaggttgccgcccagctcgcctgggcgagctgggcggcaacctcctccccctttttcctataaaaaggctgaagggggctgttctaaggatccctcagccccctggctatgtatttcagctgttttgggtgaaaaaaattgtttccgtgaagaaaatccaagtcgaggtgcttccgtaacgcttccgagatgtttccgtaagcaaatccgtgaaggttttcgtccgttcttcatccgttcttcgttcttcaaccggtaa

SEQ ID NO: 57359 - DNA, 531 bp, Glycine max
  Peptide Sequence Number=SeqID_149044
atggcttctatcacggaggccatgctaaagcttcaaaaaactatagaagataatgctacggcggccgcttccaatacagctagggaagcggaaccggtgctacagcccgcaataaacttgggccgagacaaaaacgcgacgggttttaatcggaggtatagtcctcaagcctacccttatggtttgcctccagactttactccccgtaccgctccagacgatttgagccaagcccctagcttcgagagccaagacggtttgcaagaagatgatgaaggagatgcccatttaggccctttacttcccctcaaggaaccagccccccatgagttgccccaaccaaacgtagtccgccacgtcccgtctccatccgcacccgttaaggaactcgtttgctttgcaaaagacaagggaaagattgatctacttgaagagaggctgagagcagtagaaggcctcggcagctatccgttctcggatttagcggatctgtgtctggtacctgacatcatcattcctcccaagttttaa

SEQ ID NO: 57360 - DNA, 291 bp, Glycine max
  Peptide Sequence Number=SeqID_149045
gaggcgaaaagactaatcgaacgtctagtagctggttccctcgaagtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacgggcatggaagtcaaccctggaaggaagggtga

SEQ ID NO: 57361 - DNA, 1107 bp, Glycine max
  Peptide Sequence Number=SeqID_149046
ttgatgggtcaggtccagcggcaagcttttcgcaaagcttacggtaaaatctgggacctagccatggtagaagtctccacaaagaccagtgcctccctcgcccagtattatgatcagccattgaggtgcttcacctttggggacttccagctatcacctatggtagaagaatttgaagagatcctaggatgccctctagggggaaggaaaccatacctcttctcaggtttctatccctcattagctagaatctccaagatagtcaaaatcttagcgcaggaattagaccacaggaagcaagtcgaaaatggggtggttggaataccaagaaaatatttggaggaaaaagcaagaatcttggcaggtaaaggcgagtgggccccgttcatagatattctggcacttttgatcttcggaggagtcctttttccgaatgtggatgggttggtggacctaccagcgatcgacgcttttctcgcctatcataaccacaaggaaagccttgttgtcgctatgttagccgacctatatgacaccttcgaccgaagatacaacttggctacccctatgagaggggcaccactggaggaagagatcgcgcctgtcatttcacgaggtttcaataaggccaacgtggagacacttcagaaggtccgcaaggcatgggaggtggtgcgaaagaaggacaaagaactcaggggcagtaacaatgggcccatcggtggctaccgtaagtggttgagagcccacgtgcaaggtttggattggctcccatgtttgagaaccgctaaaagggaggaagttgaggcaccaaaggaagatgaagaggtgcaggcccttagaacagaactcgagaaagctcaaacagtcaaagaaaggttcaaatcagcagctttgaagatccgaaaggagaatgccaaactgagagatataaatacagctaccaccaaatccttggaacaagagacccagagggctcgtagggaagagcacggccggaacaagttccgaggggctctgtggggcagcaacagtgagcttaagctccggagagaggaaagcgaccaatcacgagtagatagtttgatcttgaaagatgagttgaag

SEQ ID NO: 57362 - DNA, 231 bp, Glycine max
  Peptide Sequence Number=SeqID_149047
atgcatagatctcccacagctacattgcgaaggaacagggccgagaggagaaggaaacttctgcaagacagaacagttgcatccattcttaaggaggagactcatttcttttacttattatcacctgattcacaatcatcaagggaatccgccactcaattacctgaagtcattatcatggcagaagagcatgaccagaggattacccttgaggattactcaagtagttaa

SEQ ID NO: 57363 - DNA, 462 bp, Glycine max
  Peptide Sequence Number=SeqID_149048
atgtacactgagcttcaagagttatcaatgcaaaagaatttattccagtgccttcttgtttttatgcgacttaggactgcatctggagacgtggtccctatcaacttggaaatcgaagccacttgtcggcgtaacaacgctgcaagaagaagaagggaacaggacaccgaaggaagcagtcacacatcacctcctctctctccacatcacactgaaatggacggggaacaggcacgaagagtcaccttagaagacttctccaacacagccactcctcagttcttcacaagtatagcaagaccggaggtgcaagccgcaaatatctcctacccgcattcccttattcagcttattcaagggaatctcttccatggtcttccaagcgaagatccatatgctcaccttgcctcatacattgaaatatgcaacactgtaaagattgctggagttccagaagatgcg

SEQ ID NO: 57364 - DNA, 90 bp, Glycine max
  Peptide Sequence Number=SeqID_149049
atgcccgaagaaacaccattactcctagttagaccatgcattgtgagaaatgggtttatgatcccaacatggttggctcatggtgcctaa

SEQ ID NO: 57365 - DNA, 357 bp, Glycine max
  Peptide Sequence Number=SeqID_149050
atgtcttccaaggttattttgatgatgccaaagaatcaagagttaagcaaattttcaagcaaagattcaagaatcaagttccaagattcaagaataatcaagatcaagatcaagattcaagactcaaagattcaagaatcaagagaagacttaatcaagataagtattaaaaagtttttcaaaacattgagtagcacaagaagttttcacaaaatcattaccaaagagttttactctctgagggtacatctacttggggattgttacactaagaacaagagagggtacatctcttgtggatcagttcaagtggagggtacatccacttgggttttcaaagagaacaagggaggataa

SEQ ID NO: 57366 - DNA, 303 bp, Glycine max
  Peptide Sequence Number=SeqID_149051
atggaagtaaccatcttgcagaaattggggcaaaagaaggatcgggttacatcgctgcttcgtctactgccaaacacatttaggactgttgatgtccttgttacttccaatttcaccttgacgaaggtgtcacggaccataaaaaaacacgctttacggcgcccttaccgaacctgtgctagagcaagagtaatgggtgaagtagaggaaggtgtaagagcagatggaggccgacatggaggccgacatggaggccatggaagaggcaatggccataatgatggaggtcatgatgaagcatga

SEQ ID NO: 57367 - DNA, 282 bp, Glycine max
  Peptide Sequence Number=SeqID_149052
atggtgatttttcaccatggagatgcagcggaaggcaaaggagaggaggagaggggaggagcttcaccaccaagaattgccttggataagaagcttgaagtggatgctttaatggaggaaaagaaagagagaaggggggagcacgaaattgaaggaataaaagagggagagaagtggaactttgaagtgtatctcataagactttcattcatcaaagttacaacaagtgttacacatgcttctatttatagactaggtagcttccttgagaagctttcttaa

SEQ ID NO: 57368 - DNA, 168 bp, Glycine max
  Peptide Sequence Number=SeqID_149053
atgcagaacatggaacatggacacttaaacatagttgcaagggtccaaatcatatttgatgatgctgttacagggctgaagaactttgaccttattctccaaacgaatgcggtgcatcgaactgttgtaaagtggctaaatatgatgccgccaaatttggtgtattga

SEQ ID NO: 57369 - DNA, 2859 bp, Glycine max
  Peptide Sequence Number=SeqID_149054
atggggagtggaagtaactgtattccaatcggtatcgtgtctagtaaaacaccttatgttcccaaggtgcttgaccagaaaagatggtcacgagctgaagctagagctgcagagctgattgcacaaattcagccaaactatgcatcagaagcacatcgaaatgctgtcgtatttaacctacaatgcctgatcatgaattctgtcccttgtcaggtattcacatttgggtccgtaccattgaagacctacttacctgatggggatattgatctagcagtgtttgctgaaaaccaacattcggaagaccgtctgatccaagatgtacggaatattttggaaaatcaaggaacgaatgaggattcggagtttcatgtgaaagaggttcagtatatccagggagaggtgaagattataaagtgtttaatcgaaaactttgtagttgacatatctttcaatcagattgatggtttaggtacactttgttttcttgaggaggttgacaatttaataagaaaagaacatttattcaaagaaagtattatactgatcaaagcttggtcatattatgagagtcgcatcttgggatctcagcacggactcctttcaacctatgggttggaaatcttaatcatatatttattcaatatctatagtcacacgcttgcaggaccccttgaggtactttttcaatttctgaacttcttcagtaaatttgactggaacaagtattgcattagcttgagagggccggtgcctattaggtcactgcctaaaatgaaagctgagcctccacgatatgcacgaaagaattgcccagaattactactgagtgaaaaattccttgattcatgcgagtccaactatggcgttaagcttagctaccgagaaatcagagacaaaccttttgtctgtaaacacctgaatattgtagatccgctgcgtgctaacaataacctgggacgtagcattagtcgaggtaacttctgtaggataaaaggtgcattttctttgggtgctaagcggatagagaggttgctgtcttgcacagaagataacatcatagctgaatttgatttgttcttcacgaattcgtgggacagaaacggcaatggttactgggtcgataccgaaacctataatctgcttataaggaataaaagtgttgaaactagccatgaatatgcggttgagcagcctcatggtgtttcccaaaatcctgataatcattcagaagaatcaaagcaaatgtctggaacttctgatgtaattgttgctaataccatgaacaataaggtacttgctaatagaggccaaagtcctacatattcatcaaatgaagctcatgacatgcatcactttcctgagttttatttcagttcagaattttctcatttgtatggtgaagctccatcccatcatcaccacaacaccggattttcgtccgaaattcagcaatcatatgggcagatttcagatgattggagaagtgaacatgcatttgacccagaaaatacttcaagtggttattattatgattatgaatatgactttggtgtcaattatgaaaatgtctttcctactgatgaggcaatgctgatgcatcagcatcaggaggagtttggatttcctaatttgaatgaatatcagcaagcagcagtgaatgtgaattcaagtgatgtaccttttccaccaccaccaccccatgttttagcttcaggatacatgcatgaaaactcattcggggtgctttatggaaactggattgatcaatcaactataggcactgacttgcgtgagaacacaagtactgaatcaaccacttcaagagttcaagctcttcaattaggttcaagtcagagagatgtaattgataacaaaaattttccaccagttgaaggtggttcctctggaccatcatttcaagttcctaccatgttcccattctacaatcttcctactgaaactacttttgcagccaccaattatgatatattggatggtgactttgaaacacattatatgaatcttcaatatggaaggctttgtaagaatccaaaatcactgccaatgcatttaagggaacaatttccatggtatgggaaacctaaaggtgtcttcaacattgaggagcatgctcatcccccagttcgagtgatgctgcctcaacgtgcttctcgcttgcgtgggaatactaatcaaagtgttggtttttggcttccaagatttagtgacgggactgggactttctttccaaagccttcaagttcttatcacgagctgtggttttggaggagaaatcgtcttcaacaagatcgttacatcgaatatcagagatatgaaaggaaggataacaatggtgaaagggaacacaatttgttttctaattcagaggcaaggttggctgaccttggtcagtacaaattagagaatccaggttcaaatgaatcatcacagaaagatgaaaggaaggataaagacggtgaaagggaacaaaatttgtttttgaattcagagagaatgtttcctagtcttggccggtacaaatttgagaatccaggttcaaacgaatcatcaaatcaaggtgaaagctcacacagtggtactagtaaggtgccaaatattggaactggaagagattctaaaaggttcaaaaagagggacattcggtcattaaacggagatgctgattacttgcttggccagaaatattttcctttccttgtctgtgcctcccttactagggtgaagcttgaaaaagtgaaccatttatacaaagagagtgtgataatagtgagattactcatatgtcctccctacatgtgtgtcattcaaagatggcatgaagagggattcatgtag

SEQ ID NO: 57370 - DNA, 1620 bp, Glycine max
  Peptide Sequence Number=SeqID_149055
atggccgaggttgttacttcagctcccgggaaagtgcttatgaccggtggttacctcattttggagcgacctaatccaggacttgtcctcagcaccaacgctcgcttttacgccattatcaaaccaattcatcacgaaatcaaacccgattcctgggcatgggcatggacagatatcagattaacctctcctcagctctgcagacaagccctctacaaactcgctctcaaaaatctcgccatccaaaccgtttccccaaggcaccttcaccttctccttttcaaattatttttttcactattagcaagcattatagaattattactgtgctctttctggttttggtatttcagtgatacgagaaatccttttgtggaatatgcgattcagtattccgtggctgctgcttatgcaacgtttgaccagaataaaaaagagctgttgcacaaactacttttacatggtcttgacattacaattttgggtggcaatgatttttattcatataggaatgagattgagagacgtggactccctttgacaccggaatcgttggccacccttctgcctttttcctccattaccttcaatactgatgatgccgatggagggagttgcaaacctgaagtggcaaaaactggtttgggctcgtctgcagcgatgacaacggctgtagttgctgctttacttcattacctggatgttgtaaagctttcctcttcgaaagatcattgggaaaggaaggatgttgcagatcttgatatggtgcataaaatagcacaaactgcacactgtattgcacaggggaaagttggcagtgggtttgatgtcagttcagctgtgtatggcagtcagcgctatgtgcggttttcaccagaagtgatttcttccactaaggtaggagatatagcagtgcctttgccagatagtatcactgaaattataaaaggaaattgggaccatgacacagctgagttctctttaccacctttgatgactcttttactaggagaacctggaactggtggatcatccacaccatcgatggttggtgctgttaaaaaatggcaaaagtctgaccctcagaaatccctggacacatggagaagattgtcagaggcaaattcagcattggaaatgcaactaaacttgttaagcaaattagcaaaggaacaatggaatgcatataaatctgtgattgacagctgcagcatgctaagatctgacaagtggatagaacaagcttcagaaccaaacaaggaagcaattattaaagcactgctaggagcaaaagaagccatgctggggattagatatcgtatgagccaaatgggggaggctgcaggtgttccaattgaaccagaatcacaaacacaacttttagatgctacagtgaacttggaaggagtattgttggctggagtgccaggggcaggaggatttgatgcagtctttgctgttaccttgggagattcgagcagcaatgtgacaaaaatatggagttcactcaatgtccttgccttgttggttaaagaagatccttgtggcgtttgtttagaaaaggctgacccacgaaccaatgaaatcacatcagctgtgtcttcaattcatattcaataa

SEQ ID NO: 57371 - DNA, 1104 bp, Glycine max
  Peptide Sequence Number=SeqID_149056
atgagtcaaccgacacagcagcgcctctatgatttcgccaaaatggctctcatcaacatcttcgttcacccctacgccacggtgtgcgacttgtactgtggagatgccgacgctgataaatgggcccacgcacaaattggccactatattggaattgatgcgccttcgtctgggatagaccaaatgcgagaaacttgggagactcacaggaaatcctacactgccgagttctttgagcttgacccttgcacggagaatatagaaacgcatttggaggagaagaccaacatgactgatgttgtctgctgtttgcagcatttgcagttgtgttttgagactgaagagaaagcacggaaactgctgcataatgtgtcttctctgctgaaacctgggggttattttcttggtattactcctgactcatctaccatatgggccaagtaccagaggaatgttgaagcctatcacaacaaaagcagcagcatgaagccaaacattgttcccaactgcatccggacagagaattacatgattacttttgaagttgaagaagaaaagtttcctttatttggaaagaaataccagctaaaatttgctaatgatgtctctgctgaaacctattgcttggttcattttccaagtttcatcaggttggccagggaagctggtcttgagtacgtggagattcaaaatttgaccgagttttatgatgacaacagagcacaattagcaggcctgttaacacactatgttccaaacctcttggatcctagggggagacttcttcctcgttcatatgatgcactaggtctctacaccacgtttatatttcaaaaacctgacccggaaattgcacccccgattcctactccgttattgccagatgttagttataatcttgatgagaatacgattttagggactgttgaagaggagaaaactgagcatatggacgagtcagtaatagaggtaaccatttggcgagatgatgaagtgataaatgggcatgtagtagaacctgctattgggctgggcaaaataagcgaacaaaaagggatattgggcccaggtcctgcagatttacgttttccggaagcactttga

SEQ ID NO: 57372 - DNA, 1560 bp, Glycine max
  Peptide Sequence Number=SeqID_149057
atgtcgtcgacggtgctggaggtgacgcgggcggcacacgaggaagtggagcggttggagcggctgatagtgaaggagctccagaatgaccctgcctccaacaaagagcgcttgtatcagagtcaccgtgtgcgaaacatgatcgacaccattacttccaccactgaaaagcttattggggtatatgaagataacgacaatgcaaggaaggacgagattgctgcactcggaggccaaaccgccactggaattaacgtttttagcgccttttatgatagacttaaagagatacgagagtatcataggaagcacccagttgctcgtgttgttgacgccaatgacgattatgaaacacttctcaatgaggaacctcaaattgagtttagtggagaggaatcacttggtcgatacctagacttgcatgaattatattatcagtatgtcaattctaagtttggagagccaattgagtattctgcataccttgatgttttctcagacacagataagattccccgcaaaatgaaaatgaccaggcagtaccgagaatatttggcgaatcttttggagtatctgttatactttttccagcggacagaacccctgcaagatcttgatcgaattttgtcaaaggtaacaactgaatttgaagaaagttgggttgttggaaaggtacagcgatgggaaaatgacaatcaggaaaatggacatgtacttgctgagcatgctcccattgatcttgattattatagtacaattgaagaattgatggaagtcggccctgaaaggttaaaggaggcactggctgcattggggcttaagactggtggtactgttcagcaacgcgcagagaggctcttcctcacaaagcacacacctcttgaaaagttggacaggaagcattttgctaagggtgcatgtggtgtagaaaagaatggggttgctgcagttccacaagaagatggaaattctaaagaaattgcattgatggaagccaaaatgacaaaactttgtcatttgttagaggagacaattgctcgaacaaaagacaatgttgtaaagaagcaagccctaacatatgaggaaatggaagcagaacgtgaggaggaagagacacaagaggactctgaaagcgaagatgaggagcagcagatatataatcccctaaaattaccaatgggatgggatgggaagcctataccttactggctgtataagctacatggtctgggtcaggaatttaagtgtgagatatgcgggaactacagttattgggggcgtcgggctttcgaacgacattttaaagaatggcgccatcaacatgggatgcggtgtcttggtataccaaatactaagaatttcaacgaaatcacatcaattgagagagtgctaaccagtgtcttaagagcactggaagcaaaggaactttggaagaagatacagcaaagacaaggagtgaacaagtggcgcccagatcttgaggaagagtatgaagacaaagaaggcaacatctataataagaagacatacactgacttacagcgccagggactgatatga

SEQ ID NO: 57373 - DNA, 1494 bp, Glycine max
  Peptide Sequence Number=SeqID_149058
atgctgcagttggcagaatttcatgctactgctcaggttcctgccaaacctaagaaaccttctctaaaagaaagaaagcagaagttgcttaccttcttgcaagagaagtatgaacctgttcatgctaagtggactacagaacgctgtgctgtttgtagatgggttgaagactgggactacaacaaaattatcatttgcaacagatgtcaaatagcagttcatcaagaatgctatggagcaagaaatgtccgagattttacatcttgggtttgtaaggcttgtgaaacacctgacatcaagcgggagtgttgtctttgtcctgtaaaaggtggtgctctaaagccgactgatgttgacacattgtgggttcatgtcacttgtgcttggtttcgacctgaagtctcttttgctagtgatgagaagatggagcctgctttgggtattctaagtattccatcaaattcttttgtaaagggcataggttcaaatcctagaaatagcctctttgcttgtgagagtatggctgtgttcgtctaccctccccaaactccatttggtgggagcttcttgcattggcaaattcatggttcgtgtacacaatgttgcaagtgttctacttatttccatgccatgtgtgcttcaagggccggttatcgaatggagttgcattgtttggagaaaaatggcaagcagacaacaaaaatggtctcgtattgtgcttatcacagggctcccaacccagatacagttttgattatgcaaacccctcttggggtcatttcaactaaaagccttctccaaactaagaaaaaaagtggttcgaggctaatctcatccaacagaagaaagcaagatgacactcctgttgataacactgagcatgagccattttctgctgctagatgccgtatctttcaaagaacaaaccataccaaaaaggtagtacacgaacctcaggcattttcttctttcagagaacgcctataccacttgcagagaaccgaaaatgatcgggtttgctttggtagatcaggcatacacggatggggcctctttgcacgtagaaatattcaagaaggagacatggaccaatgggattttggactacttgagcatttagaacttggaagttcagcagaagttcttgaatatcgtggtgaacaagtgaggcgcagcattgcagatttgagggaggcacgctatagattagaagggaaagactgctacctgtttaagataagtgaagaagtggtggtagatgccactgataaagggaatatagctcggctgattaatcattcttgtatgccaaattgctatgccaggatcatgagtgttggtgacgacgagagccggattgtactcattgctaagactaacgtggttgccggtgatgagttaacgtatgactacttgtttgatcctgatgagccagaggaaaacaaagtcccgtgcctatgtaaagctccaaactgccggaaatacatgaattag

SEQ ID NO: 57374 - DNA, 1602 bp, Glycine max
  Peptide Sequence Number=SeqID_149059
atggtgaaccagaatgccatgaccaacaagctcacacaagaaactcggaagaagaatttgcggttctccgacattctcgcgcccaattctttaactttctttgaccctcttcgcgtgtctctccacgaaattcggcctcgcgctctcgcttcttcgtttgctctgtttttctcggaatttcaattcgggattagggtttatggggtgtctcgcgcgtttggcctcgtgacgcgaaccatgattatcaaacggaatttgaaatcccaaatgccgagtctgaaacgggtcaaactcggtgactcggtgggcgagaatgatgagtgttcttatgctcgtaagaagagaaagaccaacaacggttactaccctttgaaccttctcggcgacgtggccgccggcgtgattccggtgagttttcacgggctgctcggtgccgccggcgtggtggagaaggggttctctgcggcatggtgcaacggagtggaatcgaacgtgaaaaacgaagttgtcgtggaagtgaagaagaagaacgaggtacagcggccaccgctggttagaacttcgagggggagagttcaggttctcccttcgcggttcaatgattcggttattgataattggaggaaggagagcaagagtagtagtggtggcttgcgtgattgtgattatgatgaagaatttgaatgcaagaaggagaagttcagcttcaaggcacccaaggtttgcaataataatcagaagaaagggaaaagcgaggagaaaacgggttctaaggctcgtaagtactcggcattgtgtaatagttttgagaggagcaagtgtttgagttcgcctggtgatggttcattggccttgaggcacagcggggcagccgcggttgaagaggatgatgagaagggaaggtttttggaggtggaaaaggttggtttgatgggtttgaaggagaagagaaatgggttgtttgggccagaagatttttatgcaggtgatatagtgtgggccaaagctgggagaaaggaacctttttggccagccattgttattgatcctatgactcaggcacctgagttggttctcaggtcttgtatagctgatgcagcttgtgtaatgtttttagggtatgcggggaatgaggatcaaagggactatgcatgggtgaaccatgggatgatttttccatttatggattatgtggacaggtttcaggggcagtctgagttgagttactatactccttctgacttccaaatggcgatagaggaggcatttttggcggagaggggtttcacagagaagttgatagcagatataaatacagcagctagtagcaatggttatgatgattctattctgaaagcttttcagaaggtcagtggttcaaaccaatatgcaggatatcattttctgaaccagaatcttgaaggcactgattattactgccctacttgcaaagccaagtttgattttgagttatctgattcagaaaaaccacagccaaaagtgaagtggagcaaaaacaatgggcagctagtgcttccaaatagggtcactgttctgtgcaatggtgtagaaggcacatatttcccaagccttcattcgtaa

SEQ ID NO: 57375 - DNA, 948 bp, Glycine max
  Peptide Sequence Number=SeqID_149060
atggcgattatctccgatttcaacgaagaggagccgaaacccgctcactcttcaccaccgcaaccccaatcctcttcttcttcgtcttcgttcagtgctacttttgaccggtcaaatcccatcgctttcctggagagagtcttcgaattcgtctccgaacagagcgactttctggcgacgcagagcgccgagaaggagatagtgtcgctggtgcacgccgccgggaagaagaagagagagcttctcaaggcggagagagaaaatgccgataagaagaagagagaggacctcaaggtcacggaggagagacaaaaggtggagaagagattgaatgaagagaaggaactcaaagccgaagacaccaacaaaaacgaaagcgcctccagagttccaaacaaaggtaatggcttggatctggagaaatactcttggactcagtcgcttcaagaggttaatgtgaatgttccggtgccaaatggaaccaaatcgagatttgttaccgttgagataaagaagaaccatctaaaagttggactcaaaggccagcctccaattattgagggggagtttcataagtctgtcaagcctgatgattgctattggagtatagaggatcagaattcaatttctattcttttgaccaagcatgatcaaatggaatggtggaaatgtctagtgaaaggtgatcctgaaattgatacccaaaaggttgaacctgaaaacagcaaacttggtgacctggatcctgagactcgacagactgttgaaaaaatgatgttgtggttgtttactcagttagcatcatcgtcatcatcgttgcctaagtttgaccagaggcagaagtctatgggcctccctaccagtgaagagctccagaagcaggaaatgttgaagaaatttatgtctgagcatccggagatggacttttcaagggctaaaatatcataa

SEQ ID NO: 57376 - DNA, 60 bp, Glycine max
  Peptide Sequence Number=SeqID_149061
gaagcagctgatgacaatggaatgcagctgctcgcagcagttgccaccggggaaaactaa

SEQ ID NO: 57377 - DNA, 1659 bp, Glycine max
  Peptide Sequence Number=SeqID_149062
atggtggtctcatcctctgcgcgcgattacatcaatcgcatcttgcaggacatctccggcatgaagattctcatcctcgattctcaaacggtaggtattgtgagtgtcgtgtattcacagtcggagcttcttcagaaagaagtgtttttggtagagttggtagattctatttccaagtcaaacgaatcaatgtcgcatctcaaggccgtctacttccttcgacctacatcggagaatatccagcttttgcgccgccagctggctagtcctagatttggagagtatcatctatttttctccaacatattgaaggacactcagattcacttacttgctgattcagatgaacaggaagttgtccagcaagttcaggagttctatgcagattttgttgcaattgatccttatcatttcactttgcacgtgccttcacattacatatatatgctcccagctgtggtagatccttcaacagtgcagcgcttctctgaccgggttgttgatggtctttcagctctttttttggcattaaagcgaagaccagtaattaggtatcaaaggacatctgacattgcaaaaaggatagcacaggaagcagctaaattgatgtaccaagaggaaagtggtctttttgattttaggcgaatggaagtttctccactgctgttagtgattgacaggagggatgatcctgtaaccccattactaaatcaatggacctatcaggctatggttcatgaattaataggaatccaagacaacaaagtggacttaaaatccgttggtaaatttccaaaggatcaggaggagattgtgttgtcatcagaacaagattcctttttcaaagctaacatgtatgagaattttggagatataggtatgaatatcaaacggatggttgatgaatttcagcaagtgtcaaaaagtaaccagaacatccaaacaatagaggacatggccaaatttgttgataattatcctgagtacagaaaaatgcatggaaatgtgactaaacatgttactttagtaactgaaatgagcaagatagttgaagagcgaaaacttatgtcagtttcacaaacagaacaggagttggcttgcaatggaggacaaggagctgcttttgaggagcatgatagggacttgggtattatggagtgcctaagtcccacatcgagtagtatgagatgcttggtggagtacttaagtggcttggcagtgacaaatctactaaacaatgaaagcatatcagatgtggaccgactacgtttggtcatgctgtatgctttacgatatgagaaagatagccctgttcaattaatgcagctcttcaacaaactggcttccagatctgccaagtacaaacctgggcttgtccagtttcttctgaagcaagcaggtgttgacaagagaacaggtgatctttttggaaatcgagatctaatgaatattgcccgtaacatggctcgtggtttgaagggtgttgagaatgtttacacccagcatcagccacttctgtttcaactcatggaaagcattgtcaaagggaggttgagagatgtggactacccatttgttggaaatcactttcaacagggaagatgtaacttggtgtctatcatgattagtgatgccactacattgttgcctgattgctaa

SEQ ID NO: 57378 - DNA, 1095 bp, Glycine max
  Peptide Sequence Number=SeqID_149063
atggaggttaataagactaagatgtctgaggtgctgccattcataatcatggtgattatggaaggttggactataggactcacgatttttgccaaaactgcaataactaatggaatgagcccacttgtgttcattgtttataccaatgctttggccactataattctgttcccttgttcctttttaacacaccaagaggacagaaaggagaggccatcttttactttctctttgttcatgcgattcttgttcctcggttttatagggataacgatgactcaggcctttttattcctgggcctaagttatagttcgccaatacttgtgtgtgccatgggacacttgatcccaacgtttaactttcttctctctgtcattttcaggaagacagagatgaatttgagaagccctggtatgcaagtccaattaattggtatcttggtatcgataatgggagcagtggtagcagagttcttcaagggaccacttgtaagaccctcttctcatgaccaccttaaacacgctaataagcaatatctggtattctcctcaacaccagagttttgggttcttggtggcgctttgcttgctgcttctttcttctctctttcaattttcaaccttttccagaaagaaaccgtcgagcgatatccggaaccaatgaaagtgctttcttattctaacttacttggaaccatccttagtgcaatagtctcgtggatagtagagagggaaataaatgtttggaagataaagcgtaacaaggatctcattctcattgttctaactgcactcgttggtggtgtgattcgtcccaatattcatgtatggttcactcgaatcaagggtccactttatgtgccacttttcaagccctttggtattgcctttgccactacttttgcactttgcttcttttctaacagtcttcattatggaagcgtgataggaacaactacacttggaatggggtattatacagtaatgtatggacaaatcaaaggaaatgaagaagagacaagctgtgacgattgctcatcagattctttggacaagaagatacctcttttgcaagaaaagatggaagaagtgtga

SEQ ID NO: 57379 - DNA, 660 bp, Glycine max
  Peptide Sequence Number=SeqID_149064
atggcattgagactgagactcaaagtgtcttcaattgggtcaccttttctgcagttaggttcttctgcaagtgcagcatgctctgtttccaaacttggttttcatccaccacgcttgcaactcaacaaaaattcacacccaataaggctttttgttcgggctgctagaattgagtccaaaggtgttaccttgggtttcaggaccccacaatttcagcttccggagccccttaccgggacgacctggacattggatgattttgaagcttatccagctctactgaaaggacttgccgtcattgccatatcttcaaattccgtagccacacacccccaggatggtccagaattcatggcagaagatgctaaactgtttggttatcctttcccatacctatatgatgagtcacaggatgttgcacaacattttggagcagtttgtacaccagaattttaccttttcaaaaaggatggtcgaaggccgtttgagctggtttatcatggtcaatttgatgattcacgcccaagtaataatgtaccggtcactggaagagacttgagcttggcaatagatcgtgttcttagtggccaacctgtaccatcagagcaaaaacctagtgttggatgcagcataaagtggcacccagggaagaagttttga

SEQ ID NO: 57380 - DNA, 477 bp, Glycine max
  Peptide Sequence Number=SeqID_149065
atggtgaattcctcccacttccttttcattcaggaacacgtcatagaattttggcaggaggtaatggatgcgttgggtccaaatattaaaattgctgtggtagagggaggtatcagagtggaagatgtgagggtggaagaagtcaaagtgaaagatgtcaaagagagcaaacctatggctactgtgttttgccacttcggttcgtgggtcacaagtatgcacgtagtggtgtgcggtgtggaggtggtgtcaggtggttgctctggtggtgtttcgtgtggtggtgttgttgggtggttgggtggaggtggggcttggtggtcatgtaggtttgggggagaggttactagggtttgctggagagaggaaggaatatcctcacattctttgcagagtggggggacgacaaaaagaaactgcccttcacaaaaggatgcagattcttttggtttagagaagataaagaaggaaggttga

SEQ ID NO: 57381 - DNA, 873 bp, Glycine max
  Peptide Sequence Number=SeqID_149066
atgcagagcagaggatcgagtcacagagtctccagtatgggcaataatcgatcccgcattcccgcgctcctcatctccatgttcgctgctttcgcttctatctacgttgctggaaggctgtggctggacgcagagaatcgcgtttatctcatcaaagagcttgataggatcaccggccagggacaatctgctatatctgtggatgatacattgaagatcatagcctgcagggaacaacataagaagcttgatgcccttgagacggaacttgctggagctaggcaagagggctttgtttcaaatcccttgatagagactaatggaacttactcgacgagaaggccgttggtcgtgataggtatactgacaaagtttggccgccagaagaatagagatgcaatccgcaaggcatggatggggagtggtgcatctttgaagaaaattgaagaaggaaagggcatcattgtgcgatttgttattggtagaagtgaaaatcgtggagacagtcaagataaagacattgatcatgagaataggctgactaatgacttcttaattctcgataatcatgtggaaacaaatgatgcattcccaaagaaggtcaaattgttctttgctcatgctgcagacaaatgggatgctgagttttatgcaaaagtcaatgatgatgtctatgtaaatattgatgccttgggagctacacttgctactcatttggacaaacctcgtgtttacatgggatgcatgaaatcaggcgaagttttctctgagctagaatattttatgattctcatactggtatctgtgaaatatgacaggaaccataaatggtatgaaccagagtggtggaaatttggtgacaaaaaatcgtaa

SEQ ID NO: 57382 - DNA, 525 bp, Glycine max
  Peptide Sequence Number=SeqID_149067
atgagtcatcattcatctagtgttaatggcgagggtactagtcataaagaccctttatctagaatcttagatgagttgagttccctcaagttgtggaaagaaaaacaagagagaaaagaaaaaggtaaaaaaagagtggaagaaataagtcaagatgaaagaaagaaaataagagaggaagaaagaagaaaaataatgaaagaaatgaaaagagaaaaacatgcctcctatagtagtcataactcttgcaagagcctaagtgaagaacttagtgactattacgaaggaaggcataggtcacatcttaaacctcactcccatagaagagaaaaggaaagaaagcctcaagaggctaacattaacctctcatacttccatgggaaggataatgtagaggctaacttagattgggaaataagggtagagcaacaacttaaaaagaagtctacttcaaaatcttatggctctcactcttatccaaagaaagaccaaggtcaaggcatcttaggggtgacaccttctaag

SEQ ID NO: 57383 - DNA, 183 bp, Glycine max
  Peptide Sequence Number=SeqID_149068
atgttgttgaagtatgcgatcaaaattccacgccttccgtgttatggggttgaaccaagctcgtgcttttacgaaaagttcatcgagccaacttcatccttgacaaagatgtcatggaccatgttaaaatctaaattgattcaaccccatgtctgcataaaaattcgcatacttcaactatga

SEQ ID NO: 57384 - DNA, 444 bp, Glycine max
  Peptide Sequence Number=SeqID_149069
atgggtcagctccagcggcaagcttttcgcaaagcttacgttaaaatttgggacctagccatggtagaagtctccacagaggccattgcctccctcacccagtattatgatcagcccttgaggtgcttcatctttggggacttccagctatcacccatggtggaagaatttgaagagatcctaggatgtcctctagggggaaggagaccatacctcttctcaaggttctatccctcattagctagaatttctaagatagtccaaatctcggcgcaggaattagaccacagaaagcaaggatcgatgcttttctcgcctatcatgaccacaaggaaagcccgggttgtcgctatgctagccgacctatatgacacgttcggccgaagatgtgaaaagagcaatacaaggactgttgctgtactccagctctttatgtatggttag

SEQ ID NO: 57385 - DNA, 600 bp, Glycine max
  Peptide Sequence Number=SeqID_149070
atggctataacagagtttctgttattcatattaacagctactctaggaggaatgtttttatgcggcgctaacgatttaataactatctttgtagctctagaatgtttcagtttatgttcctatctactatctggatataccaagaaagatgtacggtctaatgaggctactacgaaatatttactcatgggtggggcaagctcttctattctggttcatggtttctcttggctatatggttcatccgggggagagatcgagcttcaagaaatagtgaacggtcttatcaatacacaaatgtataactccccaggaattttaattgcacttttattcatcactgtaggaattgggttcaagctttccccagccccttctcatcaatggactcctgacgtatacgaaggagtgcgagtcaggaacaacgaatccctttatgataaacagattcattttgcaagttcgttattacgggtagttcctacaaaggatcggactaatgacgaacaagtcatagagattgagaaaaatagatcattcagaaccactgatgaaggattcctcgaaaagttaaggattagtaatccttttgaaaattaa

SEQ ID NO: 57386 - DNA, 472 bp, Glycine max
  Peptide Sequence Number=SeqID_149071
atgacgcgcagagacaaaatttggtcattctgcacccttgtgtcatccagaggcggcgggcctgatgacacgcagagataccttacggttatctgcacccttgtgtcatccagaggcggcgggcccgatgacacggggagataccttgcggttatccgcacccttgtgtcatccagaggtggcgggcccgatgacacgcggagataccttacggttatccgcacccttttgtcatccagaggcagcgggcccgatgacacgcagagacaaaatttggcggcgaacctgatgacacgcaaagacaaaatttggtcattctgcacccttgtgtcatccagaggcgacgggcccgatgacacgcggagataccttacggttatccgcacccttttgtcatccagaggcggcgggcccgatgacacgcagagacaaattggtcattctgcaccttttgttcctctgggatctacaa

SEQ ID NO: 57387 - DNA, 1104 bp, Glycine max
  Peptide Sequence Number=SeqID_149072
gatcccctcgcttacagagggctacatgccctcgccttcagaggactacacgccctcgccttcagagggctacaggccctcgcctttagaggactacacgtcctcgccatcagagggttgcacgccctcacctttagaggactacacgccctctccatcggaggactacacatcctctacttcagagggctacatgccctcaccttcagggggttgcacgccttctcctttagaggactacatgtcctcgcctttaaagggataagcgtcctctccttcaaagggctacacgccctcgcctttagaggactacacaggactacacatcctcgccttcagaggctacatgccctccccttgaagggacgaaacgtcctctccttcagagggctacatgccctcgcctttgaaggactgcacgtcctcgccttcagagggctacaaaccctccccttcagaggactacatgtccttgccttcagagggctacacgccctccccttcagaggactacacgtcctcgccttcagagggctacatgccctcgccttcagaggactgcatgtcctcgccttcagtggactacatgtcctcgcctttagtggactacatgtcctcaccttcaaaggactgcacgttctcacctttagaggactacacgtcctcaccttcaaagggcgaaatgtcctcgctttcagagggctccacatctgcgccttaagagaatttaaggaggaggctatcatgcagctactatgcataccggggcaagatttcactcgtgcctctacaaagagacgagttcggatcatgcgcaccaacatgaccactcttacacatatatggatgacattgctacttagcaacattctgccgagcgaccacaatgccgatcagttggtctgtgccgcatggcatagggatcgcgcccacaagacacccagtggacccagaggagtccaagagggccctggggtttccagttctggttacgggcctctgtcagtcctaccgggtgcccgtccccccagcaagggatcgcacccacaagacacccagtggacccggagaagtccaacagggccctggggtttccagctctag

SEQ ID NO: 57388 - DNA, 687 bp, Glycine max
  Peptide Sequence Number=SeqID_149073
gagaactttgaagctccggaggaagacgaagaagtccgagctctaaaattagagctagggaaagcaagactcgccaaggagaagttcaaatcagccgctacacacatccggaaagagtgcaccgatttacaagaggaaaacgcggccactgcaagagcccttgaacaagaaactaaaagggcccgtaaggaggaatatggccgagagaaatttcagggagcattgtggggtagcaacaatgagctcaagctccgaagagaggaaatagactggtcacgggtgcatggcatgatcttaaaagaagagttagctgcttgtgcaaggtccaagaggagtttggctcaacacttggaagccacggagcaaagcatgctagctatcatagggcaatacaaggaagatttgagccagtctgtgacccatgaacaaaagctagcggaggattttgcacaagtgtacgtcgaaaaagaagcaagagggagggtgattgatgcattgcatcaagaagtgactatgtggatggataggttcgccttgaccttgaatggaagtcaagacctcccgcgtctattagccaaagcaaaagccatggccgaagtatgtacggcccccgaggagattcatgggctaatcaattactgtcaacacatgatagatttgatggcccatataattagaaaccgttag

SEQ ID NO: 57389 - DNA, 225 bp, Glycine max
  Peptide Sequence Number=SeqID_149074
atgactaaagcacgtcaaaaaaggggtatggaaagtaatccttgtggcgtctaccctgacttatcttccttcaccggaagtggcgtctacccagacttatcttccttcactggaagtggcgtctaccctgacttatcttccttcactggaagtggcgtctaccctgacttatcttccttcactggaagtggcgtcatccaaatcttcgtagcctgtatcaagtga

SEQ ID NO: 57390 - DNA, 910 bp, Glycine max
  misc_feature (477)..(477): n is a, c, g, or t
  Peptide Sequence Number=SeqID_149075
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggaattcatggtcaacatgccctcggacataacaaacagaaagagtgatgagtatcaaaaagtatttgtcagaggaaagtgtgttagattctcccctgctgtgatcaacaaatatctgggcagacctactgatggagtgatagatattgctgtctctgagcatcaaattgccaaggaaatcactgccaaacaagtccagcattgnccaaagaaagggaagctttctgcagggaagctgagtgtgaagtatgcaattctgcataggattggcgctgcaaactgggtacccaccaatcatacttccactgttgccacagaatctttggctgtcaaattacccatggccttccctactgtattgtgtggcattatgttgagtcaacatcccaataggttaaaccacatggactctgtgatgaagagagaatttcctctatccctgcattacaaactgtttgaggggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaaaatggagctggacgccctgatcaaaaggctctcagaaa

SEQ ID NO: 57391 - DNA, 456 bp, Glycine max
  Peptide Sequence Number=SeqID_149076
atgacattgctacttagcaacattctgcccagcgaccgcaatgccaatctccccctgcaaaagtatcagttggtctgtgacgtcccgacatggggatcacacccacaaagacacccagtggacctgaagaagtccaacagggtcctggggtttccagctctggttacgggcctctatcagtcctacagggtgcccgtaccccccttagcaaggtcatgccatcccgacatagggatcgcgcccgcaagacatccagtggacccgaagaagtccaacagggtcctaaggcgtccagctctaattacgggcctctgtcatttctacggagtgcccgtcgaccccagcaagttcatcaggcccctattaatcgggctttcatcaagaagtactgcgcccccaggcagacgtagggcgagacaccacagtagcattgggatggccggtagcgggcaatag

SEQ ID NO: 57392 - DNA, 1206 bp, Glycine max
  Peptide Sequence Number=SeqID_149077
atgcaagccttccgcaagacttacggaaagatcttagagttgaccatagcagaggtgtccatagaagccattgcatcacttacccaatactacgaccagcctttgagatgcttcacattcggggacttccaattagtaccaaccattgaagaatttgaggagattctaggatgtcctctcgggggaagaaaaccatatctttcctccgggtgtctcccctctttgagcagaattgcaactgtggtcaaggattccgcaagaggtttggaccgcataaaacagactcggaacggcatagcgggcctaccacagaagtacctagaagacaaagcgaggggcctagcagcaatcgacgctttccttgcctaccaccatagcaaggaaagtccggtggtagctgtcttggcagatctatttgacacatttgaccgaaggtgcgagaagagtagcgcacggatcatctgttgcttacccgccctctgtgtttggttggtttcacacttgttccaacaagacacaagacatccatgtccgctcctgagccatcgctcgtgtgctgaaaagaggagaatggattgggaccagcttttggccgggataggaggtagaacaatcagttggttcccccgatggaagaaaggaaaagaaggagtccttttctcatgtggaagatacccaaacattccgctggtaggaaccaggggttgtattaattacaatcccacgctcgctataagacaactagggtaccccatgaggggagcaccgacggaagaaagcatgtctcctttccttgtgagggatctcggcgcacaaaattccaagactatacaaaggatccataaggcatgggaaaccccgttaaggaaaggtcaagagcttagaggcattcgtaatggcatcattggtgggtaccacgaatggctgaaagttcatatacgaggtttagattggctcgccaagttaaaagtcgtcagcgaagagaattttgaagcaccggaagaggacgaggaagtccaagctctcaaaagcgagttaggaaaggcaaaactcgccaaggagaagttcaagttggctgctacacacgttcggaaggagtgtgccgggttacgggaagagaatgcaattaccgcaagggcccttgacgagagaccaagagggctcgcaaggaagagtatggccggaacaatttcgcggagctctatg

SEQ ID NO: 57393 - DNA, 480 bp, Glycine max
  Peptide Sequence Number=SeqID_149078
atggcagggctgagggactcaaaagtcagagaatctgaaatcactcctcgggccacgcgcaaggctgtgataagggctgggaagtcgagccgtgaggagttggagtatgataacacactccaggtctgggctagtgtcgtcagatccttccttaggagcttccagggcactccttcagcatttaaaacgaactcacgccttggaatacacagcttggaggaaggcattcaaagaggctgcatcgaacttgatcagctccccctgcactcagacttgcttgggggatttgtcttctgggtcataaagatttgcataaaactccttgaccagggctacatctatgtgcccatccatatgcctggagtgaacattttgggaatacctctactaggtagcctcagagatgaatctggtggtgtcataaggctcctggggccgggatacactggacttcctcttcctggaggccatctacattaa

SEQ ID NO: 57394 - DNA, 459 bp, Glycine max
  Peptide Sequence Number=SeqID_149079
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatcggcctcgcgtccaactctgccatgaacaacgccggtccctcggggcggttcaacttcgatggcaacgccctcaacaacacgtacggcgtctcatcaagcttatcgataccgtcgacctcgagggggggcccggtaccagcttttgttccctttagtgagggttaa

SEQ ID NO: 57395 - DNA, 222 bp, Glycine max
  Peptide Sequence Number=SeqID_149080
atggtgtcaggtctccttatatggtggctcgtggtccacaggtgtacctctcgaatttccccaataattggtatcagagccgatggttcggagttggtgataccacaggtggccagaatagctagcagtacagcgtgccccgctggtggagcggggtggccagaatggctagcgggcagggcaagtaccgcaggtggccatggctatactcgtggatcttga

SEQ ID NO: 57396 - DNA, 357 bp, Glycine max
  Peptide Sequence Number=SeqID_149081
atggactggttcttccacatctcgcatcctttcatgacaccaggccacacatcagatcctctgcctcatggtcacgccccacagtcccgagtcatccctcaggccccgcagacggatatctctcacgtgctgaagccaggagcatcatcgacatctgtggaggagcctaaacatgcagtggaaatttatgatgacattgttgagaggttggagcgccatctgagtcaaggggcggtcacgccagactcatcgacacatgaggtgatcgaagaacgcctcaggttggctaagagtgtgacacaggatcatctagtatatgttaggtctagacgcaggcggcgcacgaatcaggcatag

SEQ ID NO: 57397 - DNA, 780 bp, Glycine max
  Peptide Sequence Number=SeqID_149082
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataagggtgaacactatcccatatcaccagctcaccgtctttcattgccatacgaaattccggatgaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 57398 - DNA, 645 bp, Glycine max
  Peptide Sequence Number=SeqID_149083
gtggacccttgggtactagtacctatcttcatcagagggctacacgtccttgccattagaggactacacgtcctcgccttcagagggctacacgccctcaccttcagaggactacacgtcctcgccttcagaggattacacgtcctcaccttcaaagggccgcacgtcctcgccttcagaggactacacgtcttcaacttcagaggactacacgtcctcgccgtcaaagggactgcacgtcctcgccatcataggactacactccctcaccttcaaaaggcggcacgtcctgaacttcagagggttgcacacccttgcctttatgagggctacgcggaggctatcacgcatctactatgcatactggggcaagatttcacccatgctgctgcaaaaagacgagtgtggatcatgcgcaccaacatgaccacttttacatggatatggatgacgttgctatttagtaacattctgcccggcgaccacaatgccaatctccccctgcagatgtatcgggcatcaggccccctactaatcgagctttcatcaagaagtactgcgcccccaggcaggcacatggcgaaacaccacagtagcctggggatggccaacagcgggcaacagacgcaccgccatcacctctag

SEQ ID NO: 57399 - DNA, 621 bp, Glycine max
  misc_feature (612)..(612): n is a, c, g, or t
  Peptide Sequence Number=SeqID_149084
atggccttcattattggagaatcatttggtggtagccatacccgggagggtcttctagccaccctaccccaagtgcacctaatcagtgccggctggctatcgtttcaagaggaaggcccaaatgttaaaactaacccactagctagtcatggaaaggctagcgtaaacgccatccaagagggtgggccatcgcgggcaaggagattaggagaggtggctacttccagacattttatctaccaatcgcttcaagcggcatgtatggtctcccgtggcggaggcgaaagggacgaatgtttgtttcacctcggggagtcgcatgacatggaaacctgtctcatggtagaagaattgcttcagcggctcatggattgcgggcagcttgaagtgtccataggagggagggaagaaccacaaatttgcatgcagttggaagagaaaaaggttcctctaacccccaaggccctagtgatatgttttactaggaaagggaccggctccacacccatatacccccggacagcgcccaagccaacaccatttgcatatcaaagtaataaggtcgtcccgtggaagtatacccctcccgcgttcagcgaaagagtttgcaancgaagttga

SEQ ID NO: 57400 - DNA, 249 bp, Glycine max
  Peptide Sequence Number=SeqID_149085
atgatctcttggtttttgaaaggagagaatgatgcaatcctccctaggaagggaccagtcactagaaccatgagcaagaggctccaagaagattggactagagctgctgaagaaggccctagggttctcatgaacctcaggatttcagagctcttctccgagcacaaaatttcgtgctcttctctccctctcccttcattcatctccttcttcctccaagctcttatccataacctcctatggtggtga

SEQ ID NO: 57401 - DNA, 830 bp, Glycine max
  Peptide Sequence Number=SeqID_149086
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgcaagagtatcattatgatgttctaaagacataccacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57402 - DNA, 300 bp, Glycine max
  Peptide Sequence Number=SeqID_149087
atggtaaagtgtcttgtgaagttgcaaaccaaatttcgagaagatccaacggttaacgaaggctgggcagcatttctaccgaggcagcttcatggtattacaacttcgacctctcagaataaaaaaaggaagaagactaagggtgctgcggaagggacttctcagcaaaagaaacaaaataaagatgaggaatttacctattacttctgcaaaaagtcgggacacatgaagaaagagtgtcccaagtatgccgcatggcgtgtgaagaaagggttgcctgtggagccgactaccaagtga

SEQ ID NO: 57403 - DNA, 1083 bp, Glycine max
  Peptide Sequence Number=SeqID_149088
atggctacctcaccaaaagaaacttcagctcctggttcaccctctgtaccatcatctccatcatccaccaaagcaccatcaaaccaggaacaacctgaattccatatccaacccatacaaatgattcctggtcaagcccctgttcctgagaaactggtccccaaaagacaacagagagtgaagatttctgaaaaccctagccctgcaacaagtcctagggaagtagacccggagatggataagaagatccgcagtattgtgagtagcattttgaaaaatgcttctgtccctgatgccgatgaagatgttccaacatcttccactccagatgtttctgtccctgatgctgagaaagataggaatcaacagaggaagaggatcaagccacagaggagaccccttgcaccacgggcaccagaacctgctccaggtgacctcattgacctagaagaagtagaatctgatgaggaacccattgccaacaagttggcacccggcattgcagaaagattacaaagccgaaagggaaaaacccccattaagaggtctggacgaatcaaaactatggcacagaagaagagcactccaatcactcctaccacatccagacggagcaaagttgcaatcccttccaagaagaggaaagaaatttcctcatctgattctgatgatgatgtcgaaccagatgttcccgacatcaagaggaccaagacatcagggaaaaaggtgcctggaaatgtccctgatgcaccattggacaacatctctttccactccattggcaatgttgaaaggtggaaatttgtgtatcaacgcagactcgccttggaaagagaactgggaagagatgccttggattgcaaggagatcatggacctcatcaaggctgctggactgctgaaaacagtcaccaagttgggagattgttatgaaagcctagtcagggaattcattgtcaacattccctctgacataactaacagaaagagtgatgagtatcaaaaagtatttgtcagaggaaaatgtgttagattctcccctgctgtaatcaacaaatacctgggcagaccaactgatggagtg

SEQ ID NO: 57404 - DNA, 485 bp, Glycine max
  Peptide Sequence Number=SeqID_149089
atgacgcccactaggcaccctttggacccagataagtccaacagggctctgggattccccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgcgcccccaccacctcatcaggctggccaggctggggcatttgacatggagcagtatttacggcatttggttcgccagcaggcggccaaccaccgagcacatggcttcgctcctttttcatgccctactccagaccagttcagggcagaggttgcatggcccggagattggcccgaggcccaggcaggagaggcacccccagaatctcccggcgatggagaagaagcccacgaggatgaggagatggccgatttgcttgacttcttgggagggagtggagacac

SEQ ID NO: 57405 - DNA, 472 bp, Glycine max
  Peptide Sequence Number=SeqID_149090
acagcaaaaagtttatacggataaccactcgggtatttccgcccgtcagcgtgactcaaaagtcagtatgacagatcttgtgagcgcggaagatgacggcgcagaagacgacgttagtctctgcgtgctatcaggcttttcatcttacagacagcaaaaagtttatacggataaccactcgggtatttccgcccgtcagcgtgactcaaaagtcagtatgacagatcttgtgagcgcggaagatgacgcttttcgtcttacagacagcaaaaagtttatacggataaccactcgggtatttccccgtcagcgtgactcaaaagtcagtatgacagatcttgtgagcgcggaagatgacgcttttcatcttacagacaagcaaaaagtttatacggataaccactcgggtatttccgcccgtcagcgtgactcaaaagtcagtatgacagatcttgtgagcacggaagatgac

SEQ ID NO: 57406 - DNA, 547 bp, Glycine max
  Peptide Sequence Number=SeqID_149091
atgggacctctccaaaggcaagccttccgcaaagtctacgggaagattctagatttgaccgcagcgaaggtatttacggaagctgtcgtatccctcgcccaatactatgaccagccgttgaggtgtttcacgtttggggacttccaaatggtaccgactattgaagagtttgaggaaatattaggatgccctcttggggggagaaaaccgtatcttttctccggctttcttccttccttgagcaagattgcagttgtggttggagattcagcaaaagagttggatcgcatgaagcaaactcggaacggcgtagtgggcctgcctcagaaatacttggaaggtaaggcaagggatatggcaagccaagagaagtggggcccatttgcggatatattagctttgttgatttttggagttgtcctctttctgaatgtggacggtttggtggacttagccgccattgatgccttcctcgcgtatcaccacagcaaggagagtccagtggtggctatcttggcagatttgtttaatacctttgaccggagtt

SEQ ID NO: 57407 - DNA, 798 bp, Glycine max
  Peptide Sequence Number=SeqID_149092
gtaaaggcgaatgggccctgttcatagacattttcgcactgttgatctttggaggagtcctctttccaaatgtggatgggttggtggacctagcagcgattgacgcttttcttgcctatgatgaccacaaggaaagcccggtcgttgctatgctagccgacctctatgacacctttgaccgaccgaagatgcatgcctgcctgttagaaagccaccgttcatgcacagagaaaggaagggcgaattgggaccaactcttagcaaacagagagggagcatctgtcaactggggttgcatcaattacaatctcgttcttgcgataaggcaacttggctacccgatgagaggggcaccactagaggaagagctcgcgcctgtcatttcacgagggttcagtgagaccaacgtggagacacttcggaaggtccgcaaagcatgggaagtggtacaaaagaaggacaaagagctcagaggcagtaacaataggcccattggtggctatcgtgagtggttgaaagcctacgtgcaaggtttggaaatgctcccaagtctgagaaccgctaaaagggaggaagttgaggcaccagaggaagacgaagaggtgcaagctcttaggacagaactcgagcaagctcaaacaatcaaagaaaggttcaaattagcagctctgaaaacccgaaaagagaataccgaactgagagatgtaaatgtggctaccaccaaagccttggaacgagaaaccaagagggcttgtagggaagagcacggccggaacaagtttcgaggggctctgtggg

SEQ ID NO: 57408 - DNA, 567 bp, Glycine max
  Peptide Sequence Number=SeqID_149093
atggaggccatgaaagagcaaatggccacaatgatggaggccatgatgagcatgaagaagataatggaagccaatgtggttgcaattgccgctaccagcgctgttgctaaggtgaacccgatgcccccatctggcctcaaccaaatgtatcatccaacctcatatatggtaggcaaagatttgggaagtataggtggcccccattatgcgcaaattcaaaacaagcacgccttcccgccatatggcttgcctcccaactatacaccacccaatacggcgtacactcccagtgagaatgtcaataactccactcccatactcattgagagccgacaaccccaaactgatcatgcacatgtctctcaaaccgtgggggagacacatgaaattccctaccataatctagccgacttcgagccttgcctcagttatgccactaaagggcaagtagttggtggaaaggctcagggtcatgaaggaggcaaagattatgcctttattgacgtagaagagttgttcctagtacccaaacatggtcattcccaagttcaatgtgtcggactttga

SEQ ID NO: 57409 - DNA, 740 bp, Glycine max
  Peptide Sequence Number=SeqID_149094
atggcccacttggagctctcgattccatggcgcggctcaacagagcagccgcaccgtcctacctatttaaagtttgagaataggcatagttcaccatctttcgggtcccgacaggtatgctctcactcgaacccttcacagaagatcagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctccacgagcatatcaacagcccgggcttgggccaccatcgcaatccgcgtcggtcaatgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccg

SEQ ID NO: 57410 - DNA, 49 bp, Glycine max
  Peptide Sequence Number=SeqID_149095
ggctgggcaaagcctttctccagctatcttctccgcaaattccctttag

SEQ ID NO: 57411 - DNA, 330 bp, Glycine max
  Peptide Sequence Number=SeqID_149096
atgaagagttggatgcagaattcaaaacacaatgtctaccttggagcctacctgaatggcgcacactggcaaatggtcgtcattttgcctaaggaaaatctagttgtttggttttgttccttgcataacaagccagacaactaccttaaaggaataattaacagtgctttgaaaggacttaatgatactccacaacctaaatccaaggctggtgctaggtcgattgttgttaagtattttaatgatgttagaccattggaagcagagagattgaaggcgcttcgcatccagtgggcacaatattatctcaaagttagaaataaaacttag

SEQ ID NO: 57412 - DNA, 473 bp, Glycine max
  Peptide Sequence Number=SeqID_149097
gctaccctatgagaggtgcaccgtcggaggagatcatcttgcctttcatcgcacgaggtttcaatgaagccaatgtgaagatacttcagagaatccatagggcatggaatacaatggaaaggaaagataaggagcttagtggaagcctaagtgggaaagaagctaaagtccctgaggaaagcgaagaagtgaaagctttgaaagcggagcttgaaaaaatgagagtggtcaaggagaagctaaagatggtagtcactagggtcaggaaagacaagaacaagttccgaggggctctatggggcaacaacaacaagctcaagcttagaagggccaagagggatgagttaaggatggaaagcatggtgttagaagataagttgaaggcttgtcaaagggcaaaaagaagtttgatggaacagctgagcagaacgaaagagaatatgttgacaattattgatcaatataaggagaag

SEQ ID NO: 57413 - DNA, 288 bp, Glycine max
  Peptide Sequence Number=SeqID_149098
atgagttctggatgtttgctagtcgatcccaacggtcacaatagtttttctgccctttgccctgttttgcttggctatgataattttgtgctgtttgaatgttgtattacttggatgttgggaaagcttgggaggattgatggggacccggtgttgagaggaacgaggatatgggctacgtgggagtacgtgagatcagttggaggtgggcaacaggggatggtgggtttatgcacgctttgtggatgtggaaaacttgttgtgcaccatcgcccgaccgccacctag

SEQ ID NO: 57414 - DNA, 197 bp, Glycine max
  Peptide Sequence Number=SeqID_149099
atggcagaagagcatgaccagaggattacccttgaggattactcaaggaacttatttcaaggattacctaatgaagatccctatgcacacttggcaacattcattgaaatatgtaacactgttaagattgccggtgtaccggacaaagctattaggctcagccttttctcattcttattggcaggagaagccaagag

SEQ ID NO: 57415 - DNA, 1086 bp, Glycine max
  Peptide Sequence Number=SeqID_149100
agggatacacgccctcgccttgagaggactacacgtcctcaccttcaaagggctgcacgccctcgccttcagaggactacccgtcctcaccttcagaggactacatgtccttggcttcaaaggactacatgtccttgccttcagaggactacacgtcctcgccttcaaaggactacacgtcctcgccttcagaggactacacgtcctccccatcagaggactactcgtcctcgccttcagaggactacacatccttgcctacagagagctgcacgccctcaccttcagaggactacacgtcctcgccttcagaggactccatgtcctcaccttcatagggctacacgcactcgccgtcagaggactgcacgtcctcgtcttcagagggctgctcaccctcgctatagaggacaacacatcctcgccatcagagggctacacgccctcagctttagaggaatacacgtcgtcgccttcagaggactgcacgtcctcgtcttcagagggctgctcgcccttgcctttagaggactacacgtcctcaccatcagagcgctatacgccctcaccttcagaggactccacgtcctcaccgtcagagggctatacgccctcacctttagaggactccacgtcctcgccatcagaggtctgcacgccctcacctttagaggactatacatcctcgccatcagagggctagggctgcacgccctcacctttagaggactgcatgtcctcaccttcagaggactgcatgccctcaccttcagaggactacacgtccttgccatcagatggctgcatgccctcgccttcagagtactgcacgtcctcaccttcaatggactgcacgtcctcaccttcagaggactgcacgccctcaccttaagaggactgcacgtcctcaccttcaaagggcagtacacactcgcctttaaagggcgacacatcctcaacttcaaaggactgcacgccctcatgtttagaggactccatgccctcacctttagaggactgcatgccctcccctttagaggactacacgtcctcgccattagagggctgcacgccctcaccttcaga

SEQ ID NO: 57416 - DNA, 318 bp, Glycine max
  Peptide Sequence Number=SeqID_149101
atgaagaaggagttgctcagaaatctggtggtgaggacagcttgcacacaatttcttgaatctttcccagtactcatacaagttttctccactaagttgcctgatgctgaaatgtcttttctgatgacagtggtcctagatgcaaggaagaatttctccgagaacaccctcttaaggtcatcccagctgaaaatggacctgggaacaagattaaattcaagacaatacttcaagattacaagtcacaacatcaagatgatcactagtatattaggaagggaattcctaattgaattagcaaaaggtttggccaagtaa

SEQ ID NO: 57417 - DNA, 354 bp, Glycine max
  Peptide Sequence Number=SeqID_149102
atggcaaatttgagctttctgagcatgctagacttgtcttataatcatttgaagggaaatattccaacaggaactcaattgcaaacctttgatgcctccagcttcatcggcaacaatctatgtggtccaccactgcccataaactgcagctccaatgggaaaacccatagttatgaaggaagtgatgggcatggagtgaattggttttttgtcaatcatggcggtatgcctattttcatttccttgatcatgtgtggttcaaacttcaatcttttcgctcaggggagagtagctgaacgtaaagagggtaaggataggaggtgtggggaaatggaactaaggatgaccaagtaa

SEQ ID NO: 57418 - DNA, 352 bp, Glycine max
  Peptide Sequence Number=SeqID_149103
taccctcaccttcagaggactacacgtcctcgccttcaaagggatacacgccctcaccttcagaggactagacgttctcgccttgagtggactacacgtccttgccttcgaagggctgcacgccctcgtcttcaaaggactatatgtcctccccttgagaggactacacgtcctctccttcggagggctacacaccctcgccttcagaggactacaagccccccttttcagaaggctacacgctctcgcctttagagggcgacacgtcctcgccttcggagggctgcgctctccctcgtcttttgacggctacgtgtcctcactttcagtgggctccatatccacaccttaa

SEQ ID NO: 57419 - DNA, 240 bp, Glycine max
  Peptide Sequence Number=SeqID_149104
atggcagcggaatggagaaggaagagagagaggagatgcctcttcaaggagaatatgagtctagaagaagctcacgaccataggaggccatggataagagctccgaggaagaaagagatgaatgaagggagagggagagaagaacacgaaattttgtgctataagagagctctgaaatctgaacccactaatccaagatcaattccaagattctccactaagtgtgctcaggtgtcatga

SEQ ID NO: 57420 - DNA, 339 bp, Glycine max
  Peptide Sequence Number=SeqID_149105
atggccaaaatacaaggccacaaaagaagaaaaatcttttctactatttacaaagaagagtggacccaaccttggcccatgggctcaaaaatctaccctaaggttcatgagaaccctaaggccttctttatcaactctagcccaatcctcttggagcctcttgctcatggctctggtaactggtcctttcctagggaggattgcatcaccatggataagagcttgaaggtaggagaagatgagtggacggagaaggggagaaggagcacgaaattttgtgcctcaaaagagcccactaatccaagatcaagtccaagattctccactaagtgtgcttag

SEQ ID NO: 57421 - DNA, 894 bp, Glycine max
  Peptide Sequence Number=SeqID_149106
atggctccgaagaaactctccacgaagaggtctagaagagatgccgcagcagaagggtccagtgccacccccgagtttgatagtcatcgtttccggagcgccgagcaccaacacgcttcgaggccatcaaaggatggtcgttccacaaagaggcgtgtccagctcagggaggatgagtatatagactttcaggaagagatagctcacagacattggacgtcgctggtgactcccatggctaagtttgacccaaagatagtcctggagttctatgctaatgcttggcccatagaggagggagtgcgagacatgcgttcatgggtgaggggtcagtggattccctttgacgcaaatgccctcagccagttcctgggtggcccgctagttttggaggaaggccagcagtgtgagttcaaccagaggaggaacagggtgtggatcatgcgcaccagcatgaccaccttgacccagacgtggatgatactgctgctcagcaatgtcttgcctagcgataataactccgatctccctctgcctaagtgccagttggtgtatgccatcctgacacggatgagcgtccacgtggcccaagtgattgctgacgccatctatttgtttgcaggtatgccacccaccaggcaccctctggacccggataagtctaacagggccctggggtttccggggttgatcacgggtctctgccagtcattcggggttcccgtcacccccagtaaggtgatccgaccgccgatcacccgggccttcatcgagaagtactgcacgcctaggcaggcacagggtgatgcacatcaggccgcagacgcactgccaccacctcatcagaccgatcccgttggatcactaggcatggagcgttatctacaacacttg

SEQ ID NO: 57422 - DNA, 842 bp, Glycine max
  Peptide Sequence Number=SeqID_149107
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaatttgtcagtcaaaggtgttggcatatctacagccgtattcggggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57423 - DNA, 204 bp, Glycine max
  Peptide Sequence Number=SeqID_149108
atggaggtacaaatagcaatcaggcccacttgggccttccagagtcttcctctagaaggctgttgcttctggaggaagcaaccttgctcgcctggggagaaggggttcagccttcttggcacttcttattctctcgaaattgctgaggaaaattatttccgtgaagaaaatccaagccgaggcgcttccgtaacgtttccgtga

SEQ ID NO: 57424 - DNA, 590 bp, Glycine max
  Peptide Sequence Number=SeqID_149109
atgccctcaccatctagaggactacatgtcctcgccttgagagggctacacgccctcaccttgggtactagttaccgtcaccgtgaggggactacacgtcctcgcctccagaggactacatgtcctcgccttgagagggctacacgccctcaccttggaggactacacgtcctcaccatcagagggctgcacgccctcacctctagaggactacatgtcctcgcctttagagggctacacatcctcaccttcagagggctacacgccctcgccatctttagaggactagcatgtcctcaccttcagaggactgcatgtccttcaccattcagagggctacacgccctcgccttcagaggactacatgtcctcgcctttagagggctacacatcctcaccttcagagggctacacgccctcgccagcagaggactgcatgccctcaccttcagaggactgcatgtccttaccttgcagagggctacacgccctcgaccttcagaggactgcataggactacttctcgccgttaaggggctacacagtagtttccttttaacggttcctgggccaccccctgatattggagg

SEQ ID NO: 57425 - DNA, 49 bp, Glycine max
  Peptide Sequence Number=SeqID_149110
tttcctacatgatgcctatgatgaagttgagttgtggctggatttgtga

SEQ ID NO: 57426 - DNA, 504 bp, Glycine max
  Peptide Sequence Number=SeqID_149111
atgtctcattttcaagaatttttcaaaggaaggcggcaagcaacgataactcgtggtggccaccagtggtcgtgggtggtggaggagaagatctcacttagtgagctcgtctcactaagcaaaacttcacttttggtgctgagcgtgacctctagcgctgagcgagttacctcctcagactcacaaacatttgatgttactgaggatcaacctcacccatattggagtatccatacggtaaagcccacctcatcaactcaaccaaatgagcctgagtttacagcaaagcctagctcacctaacaaagaactcagtccttatagtgaggatgaagacaaagttctacataatcaaccccaggaagatcatgaggaagaagctgagtctgtttctccaataacaatcgtaccattatactacatgctaccacacatgcataattttgaagaatctaattttgaagattctgaatacggtcatacgtttgatcacaaagaagtctaa

SEQ ID NO: 57427 - DNA, 390 bp, Glycine max
  Peptide Sequence Number=SeqID_149112
atggcagaggtctccatagaggccattgcctccctcgcccaatattatgaccagccgttgaggtgcttcacctttggggacttccagttatcacccatggtggaagagtttgaagagatcctgggatgccttctagggggaaggaaaccataccttttctcaggattctatccctcttcagctagaatttctaagatagtccaaatcttgacgcaggaattagaccacagaaagcaagtcgaaaatggggtggttggagtaccgaggaaatgtttggaagcaaaagcaagaatcttggcagcggcgatcgacgcttttctcgcctttcatgaccgcaaggaaagcctggttgtcgctatcctagccgatctatatgacaccttcgactga

SEQ ID NO: 57428 - DNA, 1132 bp, Glycine max
  Peptide Sequence Number=SeqID_149113
gaacaacctgaattcaacatccaacccatacaaataattcctggtcaagcctctgctcctgagaaactggctcccagaagacaacagggagtgaagatttctgaaaaccctagccttgcaacaagtcctagggaagtagacccggatatggataagaagatccgcagtattgtgagtagcattctgaaagatgcttctgtgcctgatgctgagaaagatgttccaacatcttccaccccaagtgtttctgtgcctgatgttgagaaagatgttccaacatcctccactccaaatgctgaagtccttccttcacccagtgaagaggagtcaacagatgaagaggatcaatccacagaggagacccctgctccaagggcaccagaacctgctccaggtgatctcattgacttagaagaagtcgaatctgatgtggaacccattgccaacaagttagcacctggcattgcagaaagacttcaaagcagaaagggaaaaaccccccttaagagaggaaagaaaatttcctcatctgattctgatgatgatgtcgaactagatgtctcgacatcaaagagggccaagaaatcagggaaaaaggtgcctgaaaatgtcctaatgcaccattggacaacattctcattccactccattggcaatgctgaaaggtggaaattcgtgtatcaacgtagacttgccttggaaagagaactgggaagagctgccttggattgcaaggagatcatggacctcatcaaggctgctggactgctgaagactgtcaccaagttgggagattgttatgaaagcctagtcagggaatttattgtcaacattccctctgacataactaaccgaaagagtgatgagtatcaaaaagtatttgtcagaggaaaatgtgttagattctcccctgctgtgatcaacaaatacctgggcagaccaactgatggagtggtggatattgctgtttctgagcatcagattgccaaggaaatcactgccaaacgagtccagcattggccaaagaaagggaagctttcagcagggaagctaagtgtgaagtatgcaattctacacaggattggagctgcaaactgggtacccaccaattatacttccactgttgccacag

SEQ ID NO: 57429 - DNA, 82 bp, Glycine max
  Peptide Sequence Number=SeqID_149114
atggcattcaacataacttttctgcacctagaacccctcaacatcaagcttatcgataccgtcgacctcgagggggggcccg

SEQ ID NO: 57430 - DNA, 558 bp, Glycine max
  Peptide Sequence Number=SeqID_149115
atgacgcggcagctcatggcatccttcaaccagatgcagtcccagattcagacccagatgcaatctcagggacttgcactgccacccaggcctctggttggtcccttcggtcttcgagtaagcacaaaggggagttgtgttgatcccttaggaaacgatcttaagacgggtgactcagataggtgtggcttgtacatcgaagtagatcttgcccgcctggtttccctggggagagtttatgagggatccactattgttcataacactcctttgttgcctggccaagtaaaggtgagtgtggaagaggttacagatgcagatgctccagttcctatacccactgatgaggtttccttagtggggcagacacttcacaccttccttgcttggccgacacatctggtcaagtctttatcacagcaggttaaatgggatgccaccgtgttcggggtctttaatccagatttcccgctctacataaagcacgaagacctctccgaaatcgcacacggtggtcaatgtctcagcatatcagtgttacagttgtggattctataa

SEQ ID NO: 57431 - DNA, 528 bp, Glycine max
  Peptide Sequence Number=SeqID_149116
atgctgaggacgggtgactctgacagttgcggcttgtacatagaagcagatcttgcccgcctggttgccatggagagagtttatgagggatccattgttgttcataacactcctttgttgcctggccaagtaaaggtgagtgtggaggaggttacagatgcagatgctccagttcctgtacccactgatgaggtaactgtgtctctggcaaaaccaccttcgaagcccgatccagaggttagatgggatgtcaccgtgttcggggtctttaacccaaatttccccctctacataaagcatgaagacctctccgaaatcgcacacggtggtcaatgtctcagcatatcagtgttacagttgtggattctgcatctcactgaaacatgtatgcgagtgaggaattctgatatctatggattcctcgagccacagtccattcagaggtctgggcaatcgcagtttgagtctgaaagttccactacagcggacactggcagatggtggtcatcctgcccaaggaacacctag

SEQ ID NO: 57432 - DNA, 762 bp, Glycine max
  Peptide Sequence Number=SeqID_149117
atgtcagccagtgatcatgtcattctaagagacagaacccatcatcccatgaagaaaatattgatagagctatcatcacatgacgctttattcgcacagaacaagttactttctaagaaacttgagattttaacagaaacactcagtaaattgccaactaagttgtctgtgggtcaacctatgcattcttctattttgcaggccaatgtattcccactgaagaaaacactcaagaaattcattatatgggaaatcaacagcgacaagggtatactcaaggaggattttcaggctttcagtagggtccctataatcaacaaggacagtagaggacacaccctgatagctgacaagtcatccaacacttttgtggcaaatacagaacagaatcccaaggaggaatgcaaagttgtgatgacaaggagtaaaaggtttgtggaggctaaggatgaggatagtgttgtgcataagaagaaaactgttgacaagaaaggtactgatggcacgaaaaataaggtgaaaggagaaagtaatcaagagaaagaggaacaaataatggtcaagaataaagaattgaaggaccaagaaaaagaaatagaagtagaaaaagaaatagaaaatgaaaaaaatgaaaaagaagaaaaaaataataagaatgcaaagaagagtagaagtgaaaaagctgtggatgaaggtgtggaagtaccatatcctatggtaccttccaagaaggaaaaagatcgtcatttggcgagattttag

SEQ ID NO: 57433 - DNA, 156 bp, Glycine max
  Peptide Sequence Number=SeqID_149118
atggcttcgggcatctcaatgatggaggccatgatgagcgtgaagaagataatggaagccaatgcggttgcaattgccgctaccagcgttgttgctaaggtgaacctgatgtccccatccggcatcaaccaaatgaatcatccaacctcagatatg

SEQ ID NO: 57434 - DNA, 771 bp, Glycine max
  Peptide Sequence Number=SeqID_149119
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtttgagatcacagtggacaattttgacattgacaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaaa

SEQ ID NO: 57435 - DNA, 565 bp, Glycine max
  Peptide Sequence Number=SeqID_149120
atggtgctgcatgctcttcagcagcggctgcgacaggccgaccttcagcggcagccccttcagatcgatcaggtgctgcgccgccggtttggcgttgcccgcgcgctgggtgagcttcagctggcgatatttacccagctgcacgttgtgcagcgtttccaatgccggggtcgcggagcccatcaccatcgggatatcctcttcccgggcgcggaacaccgccagatcgcgggcgtggtagcgccagccttcctgttgtttataagagctgtcgtgctcttcgtcgatgatgatcacgcccagctgacggaacggcgtgaacagcgccgaacgggtgccgatgacgatggcggcttcgccgctgcgcgcgcgcagccaaaccgccagccgttcgctgtcgttcagcccggagtgcagcacgtctaccggcgcgttgaagcgctcgcgaaagcgggcgatggtttgcggcgtcaggccgatttccggcaccagcaccagcgcctgtcggcctttggccagcacgttttccagcacgctgaggtagacttcggtcttgccggagccg

SEQ ID NO: 57436 - DNA, 288 bp, Glycine max
  Peptide Sequence Number=SeqID_149121
atgttggtgcacatgatccgcactcgtctctttgcagcggcacggttggtcgccctccaatatcagggggtggcccaggaactaataaaaggaaactactggccccttaaccgggagcgcaagtctcggttaagcattgtcgcaagctacccttcggcgggagggcgacgcgtgactcacgggatgcgtgttccacgaaaggaatacgcgcggagtcgccaccaacgtttatttgaggaaaacgtcggaaaaaccgggaaagacgcgatctacgaactttttaagtga

SEQ ID NO: 57437 - DNA, 266 bp, Glycine max
  Peptide Sequence Number=SeqID_149122
caaaagaaagtttatacggataaccactcgggtatttccgcccgtcagcgtgactcaaatgtcagtatgacagatcttgtgagcacggaagatgacacaataaaaaagaatgtttatacggataaccactcgggtatttccgcctgtcagcgtgactcaatgtcagccgcagaagacgacgttagtctctgcgtgctgtcaggcttttcgtcttacagacagcaaaagaatgttttatacggaataaccactcagtatttccgccc

SEQ ID NO: 57438 - DNA, 626 bp, Glycine max
  Peptide Sequence Number=SeqID_149123
atggggaaaaatcaaaacggaaaaagattttatcaagtcaaggttaagggtctagatgtcaccagcctcaaggaattgggacgattgatgagacctctcaaaaggcaagccttctgcaaagtgtacggaaagattctagatttgaccgcagtggaggtatttacggaagctgttgtatccctcgcccaatactatgaccagccgttgagatgcttcacgtttggggacttccaaatggtaccgactgttgaagagtttaaggagatattaggatgccctcttgggggaagaaaaccgtaccttttcttcggttttcttccctccttgagtaagattgcagttgtggtcggggattcggaaaaagagttggatcgcatgaagcaaactcggaacggcatcctgccgcggaaatacttggaaggcaaagcaagggatatggcaagccaagagaagtgggtcccgtttgcggatatgctagctttgctgatttttggggttgtcctctttccgaacgtggacggcttggtggatttagccgcgatcgatgctttccttgcctatcaccatagcaaggagagcccagtggtggctatcttggcggacttatttgatacctttgaccgaag

SEQ ID NO: 57439 - DNA, 762 bp, Glycine max
  Peptide Sequence Number=SeqID_149124
atggccaaaatacaaggcccaaaagaaggaaaacctattctaatattcacaaagaaaaatggacccaaccttggcccatgggctcagaaatctaccctgaggttcatgagaaccctagggccttcttcagcaactctagcccaatcctcttggagccccttgctcgtagatctggtgactgatcccttcctagggaggattgcatcagtcccaatatacttctttgccaagttctttacagtggcaatttgccaaggattgaagatgaataatgactcttttggtagctctctaatacctgaaagtggtaatgtggaaggtgatgaattatcttttgaatctgcttttagtactgatggccaaattttaagtcctcatcctagtcgacttcattggactactttaaaggcattgatgtgtacgagaagttggttattgagtgctaacattgatggttctttgaaatctacaatccttgaacaaattaatactttggtgaatgagataactacagatgatgaaggattttataagcatgtcagggataggatagggcagggcagggaaaagccgatcccgtcgggggcagggatgggggtaaatctatcgccctatcaagttttaggggtgggggaaactggggagttggggcaaggtaagcaaaaaccagccttgacctgccccgttgccatgcctaataagttcttagggtactatctcatttatttccttttacgctcctatgacctctttagagtgtaa

SEQ ID NO: 57440 - DNA, 288 bp, Glycine max
  Peptide Sequence Number=SeqID_149125
atggtcattccacagggagaggcatgtctagctcagggaagacgagtaccccgacttccagggagagataactcgcaggcattgagcacgtctagaatggcgcctactaggcaccctctagacccagagaagtccaacagggccctggggtttccggcactgatcaggggcctctgccagtcctacagagttcctgtcacccccagcaaggtaatccgaccgccgatcacccgagccttcatcgagaagtactgcactcctaggcaggcgcagggtgacgcacattag

SEQ ID NO: 57441 - DNA, 511 bp, Glycine max
  Peptide Sequence Number=SeqID_149126
atgagatctccttccatcatgttaccccgtccgaggagcgtgctaagatcaaatgggagcactaatgctacgttggcgtctatgggttgccaggaagactattacgacgcgcaccggggatctgaactacaaaatgtgaatttggtgtgcgaggacttaagacccgcgctaattgttggccaagatgaaaatggaaggacggtaaaagccttggtatttcgacatcaagcgatatgtcgtaagcaaagatattcacccgccagagattgccgacaactgcatataaggacattgagaagctttggttgcagaaatggatctgccaagtttgaggcaaatcacatgaactttgaggaagtcctgagggactcgtttggaaagaacaacgccaacgggcatgctttgatgcactcaggaagatcctatagaaggttatgcgactggcttacctatgaaagtggctgttgtgtccatgtgaggaaatgccacaaatgtaacacttctcaagaag

SEQ ID NO: 57442 - DNA, 577 bp, Glycine max
  Peptide Sequence Number=SeqID_149127
tccagcgtggcgaggtagacgcgtcccagcgaggtcagttcgatcggcacgcgctggccggagacgacggtgcgcagcgaggccttgcggttgtagcggatcgattccaggccgcgcgcatcgcgtgccccaggctgagtaccggcgcggccaggcggtaggcgcgcgcgcgccgatcgtgttccaggaagccgctggtcaccagggtctgggtcaggcgactgaccgttgccgcggacaggccggtgcgttcggccagttcgccgttgccgagcaggttggtgccgggcttgaacgcgcgcaggatttccagcccgcgctcgagcgaccggttctggctgacgccatcaaagcgcgggcgcctgtcggtgggcggtcgggcgggctgtcttgcggtcattcaattccactctatggaaataggggcgtgccagccccccaatgtagcgcctaccgtgtcgtcatgccagaagaaagctgccccgccgggcaggaccgatcgaacagcaacggagcgagacgatggcggactacgaattcatcacactgcaacgacatgaaggggtggcgacgctga

SEQ ID NO: 57443 - DNA, 252 bp, Glycine max
  Peptide Sequence Number=SeqID_149128
atgatgtgttggtgggcacctcttttgaaaatcactcatgctcccaacatcttcatgatttgtgtacatagggactcattaggtagtgatcaaggcatggaccctaagagaataaaggtcattcttgagtggcctactccatcatttgttgaggaaagaatccctgagtttcatgaaactgtggatttgaggtcaaatccttttcaagggggagggaatgatgcaatcctcccccccaagggcattagatag

SEQ ID NO: 57444 - DNA, 669 bp, Glycine max
  Peptide Sequence Number=SeqID_149129
atggcaagagctggtgacaatggtggtgtatatcatcaattggacgaatctcagcgcttatttctggacgtgtggactacacaaatgcaacgtttgttgaaccgtaacaaagaagagccctacagacgaatagccaaatcttcctcgtttactcttaaacctctatcccctagaaaagtgtgtgatgaccaaatcagaatgagagaaaagagagaacaagagaaagaaaatagtgaggcaccacaaaggaatatgaaaaagaagagtgacacacccgaggaaaagagtgatacacaagagagagagagtgataattctaatcagttaactatttatgtttctcctagtgttcaacccttattgcaggaatttaaagatgtctttcccaaggagattcctcatggactgccaccttcaagaagcatagaacatcaagtcaaagttgagtatgtgaaaagattgtatgaccaagtgaaggtgcaaattgcaaagaagaatgaaagttatactaagcaagccaacaagaaaaggaaggaagtgggaatgatgagaatcatgaaactggccaaatacaggctaaaggcccaagtggagaaggacgaaagcctaagtggagaaggacaaagcccccgagtggagaaggatgaaggcccaagtggagaaggatga

SEQ ID NO: 57445 - DNA, 382 bp, Glycine max
  Peptide Sequence Number=SeqID_149130
atgactaaaggcaatccatctaacttacaaccctttgatcctgagatagataagacatttcatagattagttaggcatcattttataccttttgatcatcctgagcattccattactggtgaatctgtgcatagtgttattggtgattttgaacatcctgattttgagcattacaattttgagcattctgattctgagcattctgattttgaacattctgaaaacatggcacaacctccaccccgtgagaggactctaagggaaatggatgcacctgatttcaccaacgaaagcttgtgcatccaataccctgatgaggatgtcccatatgttcttaaaactggactgattcatttgcttccaaagtttcatggccttgcag

SEQ ID NO: 57446 - DNA, 180 bp, Glycine max
  Peptide Sequence Number=SeqID_149131
atggagcgtgagaagaaactcagtatactttatcaaaaacaaggacgtgcaacccagttttcaagtaaagcttctcgtgataagtggcttcaaaaggagattgatgatcttgaacgagtgctttcttcaaacaagggccaggcaagtattcatggcatgaagatgtctgcttttctttaa

SEQ ID NO: 57447 - DNA, 93 bp, Glycine max
  Peptide Sequence Number=SeqID_149132
atggcaagtcctgtagctttggcgtttttgaaaggaagacacaagtatgcgctctctacgggtcagcgttcgcttactcgaaccccatttagg

SEQ ID NO: 57448 - DNA, 339 bp, Glycine max
  Peptide Sequence Number=SeqID_149133
atgtaccctctcttgttctcagtcacaacaactcaagtagatgtaccctctacttgtaccacaaaggatgtaccctccaatgtgttaagacaaagttctcaggcgggaagaatcaaaagaattctcagactgtgtcgttttgaattctttgacaagggagaagggggacacaaaagaattcaggcggttagtcctttgttcttttggaaaagggagaagggaatgaaaaagatgaatatcacacttttgttttcaaggtttagaaaaccagaaaactttagaaagcttttggcaaaggaagaagaagaagaaattcaagaagatgttcaaagagattaa

SEQ ID NO: 57449 - DNA, 54 bp, Glycine max
  Peptide Sequence Number=SeqID_149134
atggcaatcatgaaacttcaagcaaaccaacttcagatcattgagggctacaag

SEQ ID NO: 57450 - DNA, 426 bp, Glycine max
  Peptide Sequence Number=SeqID_149135
atgaccactttgacccagacatggatgacattgctgctcagcaatgtcttgcctagcgatcacaactccgacctccctctgcctaagtgccagttggtgtatgccatcctgacatggatgaacgtccacgtggcccagggccctggagtttccggtgctatcacaggcctctgccagtcctacgaagttcccgtcacccccagtaaggtaatccgaccgccgatcacccaagccttcatcgagaagtactgcacgcctaggcagcctcaccaacagtttggggctgaggtcacattgcctggagactgccccgatgcccaggcaagggaggagcgtgcaggatcccccggtgaggcagatgaatcccatatggatgaagatatgactgacctgcttggttacttgggagggagcggagccatatga

SEQ ID NO: 57451 - DNA, 201 bp, Glycine max
  Peptide Sequence Number=SeqID_149136
atgcaaattactattactcctgaggatcaggaaaagaccacattcacctgtgtcgcaacctacccttcggcgggagggcgacgcgtgactcgcgggatacgtgttccacgaaaggaatacgcgcggagtcgccaccaacgtttattcgaggaaaacgtcggaaaaaccggaaaagacgcgatctacgaacttttaagttga

SEQ ID NO: 57452 - DNA, 580 bp, Glycine max
  Peptide Sequence Number=SeqID_149137
acggctacacgccctcgccttcagaagactacacgtcctccccttcagagggcaacatgtcctcaccttcagagggctacacgccctcgcctttagaggactacacgtcctcaccttcaaaggactacacgtcctcaccttcagaggactacacatcctcccctttagagggctacacgccctcaccttcagagggctacatgccctcaccttcagaggactacacttcctcgccattagaggactacacgccctcgccttcagagggctacacgccctcgccttcagagggctacacgccctcgccatcagaggactacaagtcctcgccatcagaggactacaagtcctcgccttcagaggactacacgtcctcgccttcagaggactacacgtcctcgccttcagaggactacacgtcctcacctttagaggactactcgtcctcgccttcagagggctacacgccctcgcctttagaggactacacgtcctcgccttcagagggctacacgccctcgccttcagagggctacacgccctcgccttgcctttagaggactacatgtcctcgccttaa

SEQ ID NO: 57453 - DNA, 450 bp, Glycine max
  Peptide Sequence Number=SeqID_149138
atgaagaaagtaactacgggtatccttatactggtgttatcttcatccctagctgttataaacgctcagcaaaagaagaagaatgatacggtaaagacccaggacattgagggagtcgttgtgactgccttgggtattaagagagagaaaaagtctttggggtatgcttcccaggagattaaagcgagtgcactctccgatggtactacaaatacgggtaatattgcagctcagctatctggaaaagtagctggtcttaacgttactaccaataataattttggagggtcctccaacctgcttatcagagggatgaaaacattaggaggaggtaacccgttaattgttattgacggatcgcctgttaataactccaatactcaggaaaaaaatattgattatggtaatgctctttctgatatcaatcaggatgacatcgaatcgattaat

SEQ ID NO: 57454 - DNA, 267 bp, Glycine max
  Peptide Sequence Number=SeqID_149139
atggatctcaaggtgaaggcagcaacttccttgaattcaaatgccaaaaagaaggcaaatttgtttgctgaaaaaaaggagagaatccggctgccaacatataatgatgatcttggaggcaagaaatatcacatcagtgaatttctgagccaacctagcggaattgcagccgtgttgaatacgaaggccttgcaatcatttgaatctcttgatgctaacacatacaggtctgccgcctccttaattctgttttggtggcctgagtag

SEQ ID NO: 57455 - DNA, 376 bp, Glycine max
  Peptide Sequence Number=SeqID_149140
tattttcgggcaagatgtcctggacatcgtatccgacatcgtggatcctgcaacttcaatgcttttagcaactccagtattttcgggcaggatgtcctggacattgtatccgacatcgtggatcctgcagcttcatgcttttagcaattccagtattttcaggcaggatgtcctggacattgtatccgacatcgtgaatcctgcagcttcaattcttcatttgacactttatcttgccttcactcaggattcagaggtagcttgtgctgcacaatttctaagctcaaaccaggcatatcttggtaagaccaagcgaagatgtcttggtagtgatggaagcttgcttgtggagcttctacggaggctggatctttga

SEQ ID NO: 57456 - DNA, 473 bp, Glycine max
  Peptide Sequence Number=SeqID_149141
ggtacatcctttgtggtacaagtagagggtacatctacttgggttgttatactgagaacaagagagggtacatctcttgtggatcagttcaagtggaggatacatccacttggttgttcaaagagaacaagggagggtacatccattgtggatctttggcttgtaaaggattttacaaggttgaaagaaatctcaagaaccgttggttgcttgggaactggatgaaaagatctcaaaaaggttccccaacacttaaatgctataagtgtaatcgacccggtcacataaaggcacactgccccacaaatgaatcatggccagagaagaatgagaagaaaagccatgaagaaagaagatccaaaaaggcgtatattgcttgggatgataatgactcatccgatggttcggagaaggaaatcaaccttctatccaaggactatgagagtgatgagaacatctctcaagaagattaa

SEQ ID NO: 57457 - DNA, 396 bp, Glycine max
  Peptide Sequence Number=SeqID_149142
atggcgcctaccaggcaccctctggacccggataagtccaacagggccctgggttttcccgccttgatcacaggactctgccagtcgttcggagtccctgtcgcacctagcaaggtgattcggccgtccatcacccgagcttttattgagaagtattgcacgcagagacaggcccagggggatgctccgcaggccgtagacgcgccgccacctcatcaggccggtccagctggatcgtttgatacggagcaggcagaggtcacatggcctggagattggcctgaggcccaggcaggagaggcaccaacagaggctcccgacgaggcagatgaggcccacgaggacgaggagatgaccgatttacttgatttcttaggaggaagcggggccacatga

SEQ ID NO: 57458 - DNA, 576 bp, Glycine max
  Peptide Sequence Number=SeqID_149143
atgtcctcaccttcagagtcgtcctgcagaggactacacgtcctcgccttcagaggctacacgttctccccttcagaggactacacatcctcgccttcagaggactacacatcctccgctaaagaggactacacgttctcgccagagcactacacgtcctcaccttcagagggctacacgccctcgccttcagaggtctgcacgctctcgccttcagaggactacatgtcctcaccttcagaggactacacgtcctcgccttcagaggactacacgccctcgcattcagaggaccacacgttctccccttcagaggactacacgtcctccccaaaagaggactacacgtcctcgccatcggggggctacacaacctcaccttcagagggctacacgcccttgccttcagagggctgcacgccctcaccttcagaggactacatgtcctcaccttcagaggactcctcgtccttccctaagaggactacacgtcctcgccttcagaaggctacacgtccgtcaccttcagaggactacacatcctcgtcttcagaggactgcacatcctcgccttga

SEQ ID NO: 57459 - DNA, 603 bp, Glycine max
  Peptide Sequence Number=SeqID_149144
aagcagcatatccctcttccattccctccaagagaaatttcaaacaaaaaattggaagagatagagaaggagatcttggaaacatttagaaaagtagagagctgtgcactaataagcgaaagcttaaaggaagtgaaaaaaattagcaagggcatgaatgtctccgcattgattggtaaatatgttacccaaatccctgaaaagtgtaaagatccaggcacactatctatggagtttggtgatataactgttcattggaatattcttgatgctataaaacacccatctggagatctttctatatttcgtgctgaaataattgaccatgttgttgatgaatacatgactgatcttcattctaatatgcatgcttgtcactcttcatgcattgaatctgaatttgcacttgattatatgtctgaatttgatgctgagagtgaatatgaatttgaatctagtgatgttttacctcttaagattgattttatagagtcagatagaactaaccatatttcaggaagtacacatacctctaactttctttatgaggtacaggctgaggaaccatctctttctaccgctatccagccagccacaccataa

SEQ ID NO: 57460 - DNA, 495 bp, Glycine max
  Peptide Sequence Number=SeqID_149145
atgcaacaaggacagacatatattctcgtagctacattccctgaacctaactatggtgttaaaatggaaaaccacgaaggtctgaccgtggcttcgttctcaaccgaaaccgcgaggcaagtttggaagattctgcttcgattgaagggttcctctcagtgtggggtttcaacggagaacaacggcggtctgtggtggccaccggtggttgtgggtgatggagaagaagcttgggacattggaaatggttttggaagaaggaaggagaaagaaaatggtgtttttccaaggttacatgaaatacaaaggctgaaacactcaaattcttctgctcttgggaaacgaagcgttgtggaaatcggtcctatgaatctccaggccaaatttcgaaaagatccaacggttaacgaaggtagaaggttgcttttaccgagacagctttggacaacttccttgagaagcttcattaagaggcttcctcgtgaggcttcttga

SEQ ID NO: 57461 - DNA, 168 bp, Glycine max
  Peptide Sequence Number=SeqID_149146
atggagaattggcgaacagcgctacgcaataacttcgccggggctccagactcgaagtggagaatggagaattggcgaacagcgctacgcaataacttcgcggggctccagactcgaaggtgtaggacacatgaacagcgctacgcaataaattcatgggtgtactaa

SEQ ID NO: 57462 - DNA, 564 bp, Glycine max
  Peptide Sequence Number=SeqID_149147
atggaacttgaattttgggacacaaatccctttaaggcgacgaccaaggctttctcatcaggatttcactacaaaccaactatcatcctgaagtcaagaactttttatgaattgattttcgtagattcaaattcagtatctatcaaatatttcaaagatccaaaagaccagacattaaacacccattccacaatccaaatactaaaagttcttcaaccaagacactttggttcagacttaaacaaaggaaagagattttcagtgctgtttgacccggtaggttatacctattgggattatgttgatgcttggactaaggtgttttggcaccaaaatacccgcttcaagcattcatggttgatatatttcaagaccaacacaatttacaattttccaaattggtttttacaatggtgggatttctttggtccaattccagagatcttcccggaaacagtccaacaaggatttactcaatttgaaagacaatacaattcgcaggaatcacaaattccagcagatcttaaatacttctcaagttttgctctgtcatggattttctaa

SEQ ID NO: 57463 - DNA, 255 bp, Glycine max
  Peptide Sequence Number=SeqID_149148
atggttatgctgagtaatagggatatcactagtgcatcttcttctagctcttctagtgagagtgaaagtgaatgtgatgtacagtccttggaaggtgatcttttgacggttaggaggttaatgggtagtgtgttccctatggagtctagccatctcttacttggaaggtcttggcaatatgatagggatgttgtccacaatggtgtcacaaacaaattttcatttgtacataaagggcaaaaaggttacccttaa

SEQ ID NO: 57464 - DNA, 147 bp, Glycine max
  Peptide Sequence Number=SeqID_149149
atgaaaggtgcggataaccgtaaggcgtctctgcgggctactagctcttggatggtaacaaaaagcggtgtggtcgacaaaagcgaggctcttgctcctacgtatcctccaatgaggaactcagacctacgtagttctggaaaactt

SEQ ID NO: 57465 - DNA, 325 bp, Glycine max
  Peptide Sequence Number=SeqID_149150
gttagaaaatgctccgacaaaaccaaccacaatccaagatctccaaacagagattaataatttaaaaagagaagttaaagaacttcatcaacaacaagaaattcaccaaatcatcctttctcagcttgaaggaagcagtgattctgagaatactgaaaaggatgaagaaaatgaaactgaaaatctggaagatgaaatgtttatgggattaatcaacaagattaaaatccaaaaattttacataaacattagaatcattattaatgatttcgtcttagacacatggccttatttgatacaggggctgattcaaactgcattttag

SEQ ID NO: 57466 - DNA, 527 bp, Glycine max
  Peptide Sequence Number=SeqID_149151
ctggcatccatgcatcctctacttcagccccattcccagctttagcatacttatctgcccagagctctcagactttagatgccaaattgcaaagcttgtttgaaggacatattctcattatacaaagcttgcaggaactagctcagcaaaggccaattatgagtgtagagcagttcattgagaaggcacctcaacagcatgagccagaactagaaaatgataactcatctgaagccaccatctttggagatgttgattgtaaaaaaagaaaattagagacgagatctaatgaggctgctcatcatggaccaatgccagcgtcagctaatgcaccatttccaggagtggatccatctctacctcagcacgcagtagactcttccattcatgtcttagagatacatgagggccagactataccagttttgccttttgacacttctcctccagctactccaatatggcatataacagatgagaagaatgttcagatacaggacaatcaggaccagtcacaggaattttaa

SEQ ID NO: 57467 - DNA, 983 bp, Glycine max
  Peptide Sequence Number=SeqID_149152
gcgacgtgtggctgaacgccaacgaattccccaccgccgtggaattccagttaaccgaacagacgctgaaccgctatccggagccgcagccgaaagcggttatcgaaaactacgcgcaatatgccggcgtaacaccagagcaggtactggtgagccgcggggctgacgaaggtatcgagttattgatccgcgctttttgcgaacccggtgaggacgcggtcctttattgcccacctacctacggcatgtatagcgtcagcgccgaaaccatcggcgttgagtgccgcacggtgccgacgctcgccgactggcaccttgatttaccgggtatcgaagcaaatctcaccggcgtgaaagtagtgtttgtctgcagcccgaataatccgaccgggcagattatcaacccgcaagatttccgcgccctgctggaaatgacgcgcggtaaagcgatcgtggtagcggatgaagcctatattgagttctgtccgcaggcgtcgctcgccggttggctaaatgaatacccgcacctggttatcctgcgcaccttatcgaaagcctttgcgctggcggggttgcgctgcggttttacgctggctaacgcagaggtaattaatgtactgctaaaagtcatcgcaccttatccgctctcgacgccggttgccgatatcgccgcccaggcgttgagcccggcaggaattgccgctatgcgcgcgcgagtagcgcagatccttgatgaacgcgcttacctggtcgatgcgctgcgcgagatcgcctgcgtcgaacaggtgttcgattccgagaccaactacctgctggcgcggataaccgcctccagcgcggtgtttaaatctttgtgggatcagggcattatcttacgtgaccaaaataaacaaccctcattaagcggctgtttgcgtatcactatcggtacccgtgcagagagccagcgcgtgattgacgctttgactgcggagaatgtatga

SEQ ID NO: 57468 - DNA, 279 bp, Glycine max
  Peptide Sequence Number=SeqID_149153
atgaagaacaacctgttaagcattggtctattactccagaaaggattcagcatgaacctccatgatggcacaatggagatctttgacagaatgcagaagaaaatactgaaggccaaaatctcagagaacatgacctttcaagttccctttctaggtgggaataggttctttgtgtctttggttgatgaatttagcaggaaaatgtggacatacttactcaaggttaagagtgaagtatttgagaacctaaagaaattcacaaccatgactgaaaaataa

SEQ ID NO: 57469 - DNA, 216 bp, Glycine max
  Peptide Sequence Number=SeqID_149154
atggaagttggagaaacaaagaaacaaagaaaacagaatatgaaggaagatgaatggagaggagcgaaaaaggaagatggagaaacaaagaaacacagaaaacgaacatgcagtgagataaacgaaaatggaaccaaaacaaaaatagaaataaaacagaatatgaatatgaagaggaatggagaggaacaaaaatggaagatggagaggatgtaa

SEQ ID NO: 57470 - DNA, 434 bp, Glycine max
  Peptide Sequence Number=SeqID_149155
accatgtatgggggctgacgcctgcccagtgccggaaggtcaaggaagttggtgacctgatgacaggggagccgacgaccgaagccccggtgaacggcggccgtaactataacggtcctaaaggtagcgaaattccttgtcggggcaaagaaggcctccttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccg

SEQ ID NO: 57471 - DNA, 387 bp, Glycine max
  Peptide Sequence Number=SeqID_149156
atggtgaaagttggaacctcttacgtgccgatcaacgtctcattttcgccaaaagttggcccagggcttcccggtatcaacagggacaccaggatttatttattctgcgaagtgatcttccgtcacaggtatttttcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 57472 - DNA, 243 bp, Glycine max
  Peptide Sequence Number=SeqID_149157
atgaaagatttaactaaaatacctgaatatcctcccatatcaaatccttctaagcagcagggacttgcttctaattctcgatcgacatggaccagcggtctctcgaccccaactggtctagtcaccaatgatcttagccgtgtggcttttcttgtccgcttcaaggtagacaatgactatgatgctgcactaggaggaggaggaggaggaggagaactgggtggtgtatccatttgcctataa

SEQ ID NO: 57473 - DNA, 357 bp, Glycine max
  Peptide Sequence Number=SeqID_149158
atgtcatcagatacaggggatcatcgacctcatgatctgggctttttggaggttttgctggagacacaactgcctgttgatcaaacattgaaaacaatttgttttggttctttggatagtgaagaaaattatgaggattttctaaatgatataaattatcaggcattgaatgaatctcctattggacataaccagttccctaaagttacctcagaagttgtggccatcgctgaagatataaatgacatgtcatttatgagtgcacaatcagctgaagtcacctcacatacaatagaccttggacgtgatggtttattggaggaagatgaaaatggagcagagcaaaggatagtataa

SEQ ID NO: 57474 - DNA, 261 bp, Glycine max
  Peptide Sequence Number=SeqID_149159
atgtctcctccacctctaggacctcacaatcactcacaaactcatctcaagctttcaggacggcttgatgaagacatgaccaagagcaaggtcaaggatccacttgaaggacttggagggcctatgacaagggctagagcaaggaaagccaaggaagctcttcaacaagtattgtccatactatttgaatacaagcccaagtttcaaggagaaaagtccaaggttgtgagttgtatcatggcccaaatggaggaggactaa

SEQ ID NO: 57475 - DNA, 562 bp, Glycine max
  Peptide Sequence Number=SeqID_149160
tcgggaaacctgtcgtgccagctgcgttaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcgtttccccctggcggctccctcgtgcgctctcctgttcctgcctttccgtttaccggtgtcattccgctgttatggccgcgtttgtctcattccacgcctgacactcattccgggtaggcagttcgctcctagctggactgtatgcacgaaccccccgttcagtccgaccgctgcgccttatccggtaactatcgtcttgagtccaacccggaaagacatgcaaaagcaccactggcacatccactg

SEQ ID NO: 57476 - DNA, 687 bp, Glycine max
  Peptide Sequence Number=SeqID_149161
atgtcccgagtcgatcggcggaccggctctcaccgttccacatccgaccgggacacatcgccggcccccatccgcttccctcccgacaatttcaagcactctttgactctcttttcaaagtccttttcatctttccctcgcggtacttgttcgctatcggtctctcgccagtatttagccttggacggaatttaccgcccgattggggctgcattcccaaacaacccgactcgccgacagcgcctcgtggtgcgacagggtccgggcacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatccttgttagtttctttcctccgcttattgatatgcttaaactcagcgggcaggcgtgccctcggcctaatggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcgtgacgactcccgcgggacaccgtctccgggcccccgggagtcgcacttaa

SEQ ID NO: 57477 - DNA, 282 bp, Glycine max
  Peptide Sequence Number=SeqID_149162
atggcctttactagtaattgtcaacaatttgtcctcgacgttggttgtgtggtgttaagcgtaatacatgaggctatgggccaattgaagactgacagtgtggttcgagggggcaatcatgtcaaatgccctattggtgtgagggtacacggtacacaagctacatacaggactgatgaggacacgattgctaaaagaccttacatggcaatgcaaatgagcagaaactacgatggaatggttgcatcatcggctgattgcgtcccacgtggaagaagatag

SEQ ID NO: 57478 - DNA, 294 bp, Glycine max
  Peptide Sequence Number=SeqID_149163
atgcatagcatgcgtattcccgagtctttcatctctatgaaatgttgtcaaagtattggcgatcgaaattgccattccttggattatggggttgaaccaagctcatgcttttacgaaaaggttcatcaagtcaggttgaagcatggaagtaaccatcttgcaaaaattggggcaaaagatggatcgagttacatcgctgcttctctactgccaaacacatttaggattgttgatgtccttgttacttccagtttcaccttgacaaagatgtcatggaccatgttgaaaatctaa

SEQ ID NO: 57479 - DNA, 291 bp, Glycine max
  Peptide Sequence Number=SeqID_149164
atggctaccaccaaagccttggaacgagaaaccaagagggcttgtagggaagaacacggttggaacaagttccgaggggctctgtggggtagcaacaacgagcttaaactcctaagagaggaaagggaccaatcacgaaattgccattccttggattatagggttgaactaagcttatgctttttcgaaaaaaaagttcatcaagtcaagttgaagtatggaagtaaccatcttgcaaaaattggggcaaaagatgaatcgagttacatcactgcttccaaacacatttag

SEQ ID NO: 57480 - DNA, 532 bp, Glycine max
  Peptide Sequence Number=SeqID_149165
atgactagaggcaatccatctgacttacaaacctttgaccctgagatagataggacatttcatagattagttaggcatcattttataccttttgatcatcctgagcattccattactggtgaatctgtgcattctgttattggtgattttgaacatcctgatttggagcattataattttgagcattctgattatgagcattctgattttgcacatgctgagaacatggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggtgaagacccgcacaaacatttgaaagaatttcacattgtctactccaccacgaaacccccagatgtccaagaggatcacatatttctgaaggcttttcctcattcattagaggagtggcaaacgactggctgtattaccttgctccaag

SEQ ID NO: 57481 - DNA, 361 bp, Glycine max
  Peptide Sequence Number=SeqID_149166
ggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcgggctgcgcaactgttgggaagggcaatcggtgcgggcctcttcgctattacgccagctggcgaaagggggatgtgctgcaaggcgattaagttgggtaacgccagggttttcccagtcacgacgttgtacattgagcaactgactgaaatgcctcaaaatgttctttacgatgccattgggatatatcaacggtg

SEQ ID NO: 57482 - DNA, 1019 bp, Glycine max
  Peptide Sequence Number=SeqID_149167
gaggactacacgtccttaccttcagagggctacacgccgtcactttccatggacaacacttcctcaccttcagagggctacacgtcctcaccttcagaggactacacgtcctcgcgtttacagggcttcacgtcctcgcctttggagggctacacaccctcgccatcagagggctacacgtcctcaccttcagagggctacacgacctcactttgctacacgccctcgccttcagagggctgcacacccttaactttcgagggctgcacgccttcgccttcaaaggacaacacgtcctaaccttcagaggactacacgtcctcgccttcagagggctacacgccctcgcctttagaggactacacgtcctcgcaatcggagggctgcatgccctcaccttcagagtactacatgtcctgtctttaagaggactacacatcctcgctttcagaggactacacctcctccccttcagaggaatacacgtccgcacctttagaggactacacgtcctcgcctttagagggctacaagggctacacgtcctcaccttcagagggctacacgccctcactttcaaaggactacatgtcctcggcttcagaggactacacgtcctcgcgtttactgggttacatgtccacgcctttagagggctacacgccctcactttcagaggactacacagggctgcacgccgtcaccttcagagtgctgcacgccgtcaccttcagaggactacacgtcttcgccttcagaggcctgcacgtccttgccttcaaagggctgcacgccctgcccatcagagggttgcatgccctcaccttccgagaattacacgtcctcgccttcagaggactacacgtcctcgccttaagaggactacacgtcctcgccttcagaggactacatgtcgtcccttcaaaggagtacaggtcctctcgtttagagggctacacgtccttgcctttagagcgtacacgccctcaccttcagaggactacacgtcctcaccatga

SEQ ID NO: 57483 - DNA, 216 bp, Glycine max
  Peptide Sequence Number=SeqID_149168
atggggctacggaaaaagtggagaattggcgaacagcgctacgcaataacttcgcggggctccagactcgatggtagaggatgcatgaacagcgctaggggggcccggggctccgaaaaaagtggagaatggagaattggcgaacagtgctacgcaataacttcgccgggcttcggacttgaaggtggaggacacatgaacagcgctaggcaataa

SEQ ID NO: 57484 - DNA, 797 bp, Glycine max
  Peptide Sequence Number=SeqID_149169
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggacgcatgaacgaaaacgcaattgatggggctccaaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57485 - DNA, 1038 bp, Glycine max
  Peptide Sequence Number=SeqID_149170
atggcaaatcaagaagagtgggtcccgtttatggatgtgttagcattgctaatctttggggtcgtcctctttccaaacgtggatggtttggtggacctagccacaatcgacgctttcctagcataccaccatagcaaggagagcccggtggtagctgtcttagcagatttatttgatacatttgaccgaagttggttcccccgatggaaggaaggaaaggagggagtccttttctcatgtggaggggacccaaacattccattgataggaacgaggggttgtattaactacaatcccgcgctcgctataagacaactaggggaccccatgaggggagcaccgatggaagaaagcatgtctcctttccttgtgagagatttcggcgcgcaaaatttcaaggctatacaaagaatccataaggcatgggaaaccccgttaaggaaagatcaagaacttaggggcattcgtaatggcatcattggtggttatcatgaatggctgaaagttcatatacgaggtttagattggctcgccaagttaaaagtcgtcagcgaagatagtttcgaagcaccggaagaagacgaagaagtccaagctctcaaaaacgagttaggaaaggcgaaacttgccaaggagaagttcaagttagctgctacacacatccggaaggagtgtgccgaattacgggaagagaatgcaactaccgcaagagcccttgaacaagagaccaagagggcttgcacggaagagtatggtcgtaacaaatttcgcggagctctgtggggtagcaacagtgaactcaagctacgaagggaagagagggaccagtcgcgagcacatagcatggtcttgaaagaggagttagttgcctgttcaaggtccaaaaggcgcttgtctcagcgtttatgcgagacggagaccaacatgctagctatcgtcgccaagtaccaagaagagttaagtctagccacggcccatgagcagagggtcgaggacgagtatgcccaagtatacgcggaaaaagaggctagaggaagg

SEQ ID NO: 57486 - DNA, 396 bp, Glycine max
  Peptide Sequence Number=SeqID_149171
atggctaagttcaggaggttggctctagagattgaaggccttgtggctgttagcggactaagtcctgtgatcgcatgttccctagatacgggcgatcgaagactaatgttcgcttttgtggaacgttggcataaggaaactagtagtttccatttgctcgtcggagaggtgactatcaccttggatgacgtggcattgttgctacatttgcctatcgtaggagcattccacagctttgagcaacttcatgtcggtgatgctgtcgagatgttggttgaattactcgaggttagcgctacaaaggcgagagctaagacgattcaatgtcatggctcttatgttcgactgtcgtggctacaagacgtgtatcaaatgaagatcaatgcatgtcactag

SEQ ID NO: 57487 - DNA, 141 bp, Glycine max
  Peptide Sequence Number=SeqID_149172
atggctactccacctgcctcgcctcctcctcctcctcctcctacagacacatcaacgtctccatctaccttgaagcggacatgcaaggagaaacggctacgatcgttggccactagaccacctggggcagagagactagtg

SEQ ID NO: 57488 - DNA, 609 bp, Glycine max
  Peptide Sequence Number=SeqID_149173
atgacctgggatgaagttgtagataagtttttaaagaaatatttccctgagtcgaagactgcagaagatgggttaagaccacaatctaagcagcttcttgatgcttcagctgggggtaaaatcaagatgaagactcttgaagaagcaatggaccttattgaaaacatggctgctagtgatattgccatcttaagagatagagcccacatcccaaccaagaagagcttattggagcttacatcacaggattcattgttggatgtacaatccgtggtggagctcatgactctggatgttgtatccctagtgaagaaccaattattcaactacatggggaatcagcccaaaaatacttttaatgaaggaggatttaccggattccaaaatggccagcaataccaacaacagagacaatggcagaaccaccctggcaatcaattcaacagagaccagggtggaccgtccaataggcctcagcagcaagtgcctagtctctatgagcataccacgaagttggaagagactctagctcagtttatgcaggtttcaatgtctaaccagaagagctcggagtccgccattaagaatcgggaggtccaagtgggctag

SEQ ID NO: 57489 - DNA, 756 bp, Glycine max
  Peptide Sequence Number=SeqID_149174
atggaagaaattctccacctcgtggaagggcaattggaagacccgggtctgccacggggtccacatgtgcaagacctacgcttctgttggtttgaactggatataaatgataattccagtcttaccgatcttcaagacaggaggggttcactaagagggggaatactcctccaggttataaagcccactaggactactaaggaagaggaggaaaaaaaagcttatgatgagcatctatttgagtcgattaatcatcccttgcatcatccttacaccggttctcttatccaaagtcttctcttacagactggccttcgcgctcttttgcggcttgtgggttgggaggttcccctcatgattattctttgtgttctttcgggcctcgaatccgggtatacgttgcacatgatggatccagcaggaggtcagcctgctgccaatcctgcagcggagcaaccctcaaacgtgccttcaggcgcatcgacctcgggctggagaagtttcgaagaaggtgttttgttagaatcttcaaacgaatccagcgaagcgagcgtgaatcagcagcctgtgattcccgaacttgaacctccgcttctcgatgacaacacccggcgagcagagctcgctgttcgattgagggcgaattggtgggggatcgcttataacgagcgaatcctcgactccttcgtccggagtcaacttgcaatcgaaaggcacatagaggccgcacttgtggcggacggatattccccgcaa

SEQ ID NO: 57490 - DNA, 324 bp, Glycine max
  Peptide Sequence Number=SeqID_149175
atgccccacaaagaaaaccatgatcatgagggtcagacatttatagtagtcaagagagactacttctgcccttcctctagtggaagtgaagatgaagtaagtggtgaagagtctagtgaggaagtctacccccatgaagaatgtgacctcttaatggttagaaggctccttggagagatctcccctcttaggacaaatttgtgttgcacattccctcctcaactatgctatagggagcttcaaatggatcaagctctaaagcttagacaagataaggagtatgagtttgaagaatatagacaacagaatggaactactttttaa

SEQ ID NO: 57491 - DNA, 270 bp, Glycine max
  Peptide Sequence Number=SeqID_149176
atgccgatttccccctacggatgtatcagttggtcagtgtcgtcccgacatagggatcgcgaccacaaggaacccagtggactcggaggagtccgacagggccctggggtttccagctctggttacgggcctctggatcacgcccacaagacacccaatggacccagagaagtccaacagggccctggggttcccagctctggttacgggcctctgttagtcctacatggtgcccgttccccccagcaaggtcacgccattatgacatag

SEQ ID NO: 57492 - DNA, 417 bp, Glycine max
  Peptide Sequence Number=SeqID_149177
atggtgaaagttggaacctcctacgtgccgatcaacgtctcattttcgccaaaagttggccccagggcttcccggtatcaacagggacacctggatttatttattctgcgaagtgatcttccgtcacaggtgctccagtggattgtgtttctatcagctgtccctcctgttcagctacagacggggtggtgcgtaacggcaaaagcacccccggacatcagcgttggcaagtgtagcggtcacgctgcgcggcgcgtcccattcgcccttcaggctgcgcaactgttgggaagggcgatcggtgcgggcctcttcgctattacgccagctggcgaaagggggatgtgctgcaaggcgattaagttgggtaaccccagggttttcccagtcacgacgttgcaaaacgccgcccagtga

SEQ ID NO: 57493 - DNA, 486 bp, Glycine max
  Peptide Sequence Number=SeqID_149178
atgccaccgtgttcggggtctataatccagatatctcccctctacataaagcacgaagacctctctgaaatcgcacacggtggtcaatgtctcagcatatcagtgttacagttgtggattctgcatctcactgaaacatgtatgcgagtggggaattctgatatatatggattcctcgagccacagtctattcagaggtctgggcaatcgcagtttaagtctgaaagttacataaagagttggatgcagaattcacaacgcgatgtctatcttggagcctataaatgggttccactgcagcggacactggcagatggtggtcatcctgcccaaggaacacctagttgtctgcctaaatcaaaggcttctgctaggtggattgtcgtcaagtattttaacgatcctagaccattggagccagagagattaaaagcattttggatccagtgggcacaattttatctccgagttagagatagggcctag

SEQ ID NO: 57494 - DNA, 285 bp, Glycine max
  Peptide Sequence Number=SeqID_149179
atgcaaagccgtgttatgctccctcccctcgatagggatttcctcttcagcgaaggcgaggtagttgttggcggtgatgctattgacgagtcccccaaagccttctacggagatgtcttgtgctacatgagcttcgttcaagacctttaccagcaaagcctaatgaggctcggagctcatgaggagttccaaaagagagactctagccggggttttgttgagctgctcaatgattttgaactcactttgttgaataatgcggaggaactcgcctgcctcctctag

SEQ ID NO: 57495 - DNA, 240 bp, Glycine max
  Peptide Sequence Number=SeqID_149180
caacaaccacagtcacgagaacacaagattgcaaagctcccaaaacttttggcagcttcgcatatgattcttcccagtttccatgaatcatctctaacactctttgctttgctaactgatgcaatcctccctaggaagggaccagtcactagagccatgagcaagaggctccaagaggattgggctagagctgctgaagaaggccctagggttctcatgaacctaaggatagatttttga

SEQ ID NO: 57496 - DNA, 243 bp, Glycine max
  Peptide Sequence Number=SeqID_149181
atggtgaccaaaggttggagctttaatggaggcttcaatggagaggaagaagaaagaaaaagcaactccctcgcgtttctctgcgctcgtcggggccagttttcgaaagtaggcaatatatatatcaaaacgctcagaatgaaaccccgagcgtggttcagaggatgtcacagggggagggggtttatagggttcctagggtcagaagtggagagaattgagagaagagagaaagaagaataa

SEQ ID NO: 57497 - DNA, 609 bp, Glycine max
  Peptide Sequence Number=SeqID_149182
atgatgttttctgagcatcagattgccaaggaaatcactgccaaacgagtccagcattggccaaagaaagggaagctttctgcagggaagctgagtgtgaagtatgcaattctgcataggattggcgctgcaaactgggtacccaccaatcatacttccactgttgccacagaatcatttgctatcaaattacccattgccttcccaactgtattatgtggcattatgttgagtcaacatcccaatattttaaactacactgactctgtgatgaagagagaatctcctctatccctgcattacaaattgtttgaggggacacatgtcccagacattgtcttgacatcagggaaagctgctgcttcaggtgctgtgtccaaagatactttgattgctgaactcaaggacacatgcaaggtgctggaagccaccatcaaagccaacacagagaagaagatggagctggaacgcctgatcaagagactctcagacagtggcattgatgatggtgaagcagctgaggaagaagaagaagcagctgaggcagaggaagatgcagcagaggatacagattcagatgatgatgatgattctgaagccaccccatga

SEQ ID NO: 57498 - DNA, 189 bp, Glycine max
  Peptide Sequence Number=SeqID_149183
atgggagatggagtgatgcaatcctaccccccaagggcattggatagaagactccaagaagattgggccaaaaatgcaagagaaggccctagggttctcatgagccttagggtagatttcgggcccatgggtgatatgaaccctcatggcacaaaggtggttcttggcataaaatggatgaatgggatg

SEQ ID NO: 57499 - DNA, 863 bp, Glycine max
  Peptide Sequence Number=SeqID_149184
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaacaatcagttgaagcaattgataccaaagcatgccaagacaggatggcaatttgataaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 57500 - DNA, 207 bp, Glycine max
  Peptide Sequence Number=SeqID_149185
atggggggtgtagtgaccttgttggatatccttggtggagaaaatagagtgtttctcatgatgaggaatacttgtacttgggggcatgtcactcggtttagaactcccttgagactcaggctgatcaccatgggaggagttgcctgtgcacgacagggtgacctcgacacttattgcctagttttcttaagtgagagtgttgtgtag

SEQ ID NO: 57501 - DNA, 388 bp, Glycine max
  Peptide Sequence Number=SeqID_149186
tgatcttccgtcacaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgatgaagaaaataatgaagagggcgaatgagtacactagtaacagtttggctattgtcgctaatattcacaacttgttacaacgattctacatggcactccactga
